United States Patent 7,868,149 (PLANT GENOME SEQUENCE AND USES THEREOF) - sequence listing, part 60

SEQ ID NO: 32344 - DNA, 25568 bp, Oryza sativa
  unsure (1)..(25568): unsure at all n locations
tgtcgactgcatggcatttattctgggggtgaaagcaaatcgatgcatgcatctgtatgtacatgcatgtgcaattcaaaaacctgcaggcgcaggataaattcaaatagaaaagaaaacgtcttctagtaccaaacatgaatccacaaacttccaaacacattaatcaattccaccaaattacagcttggatccatgaactttcaaatttgatcccgctatttccacctggcgtggccacagcagctggcagagacgtaatcagcctaattatgcttgccgttgacattcccaagcatagttggtatcttggttctctctttttcctcggttaaattaaaatataggttgcaaatgtgcgaaaagtctcaaacttttcctttctttaaactaacctttactctaggacgcccctgttttgcgagtggagtagaacacgtcgtcattgccaaatgacactctctcttggcctatcttttcttaaataagttggattaatgtgataacgataagaatgatagtgtttgagccgtcttttcatgaagagacgaaaaaaataatcaattaattaattaattagcattgaaatgaataagtagtactatgtatcattgtgttcttggattacttcataagacgctcgatcgtgaaaatagttttaataaaatttcaacaaaattatgttcgaaacaacaaatatttgtgatcggaagtacttgtatattcacctttagaaaatagaaatagatataccatgaactcattcatacaacagccggatagatatacatcactactcatctagaccgttccatggactacatacatacgtatggtatatctttgctatttatattctatatatatatccagcctatatatagaggaaagaattgaatgagatagatattggagatggcctacagctactacaaaccgtagaaaatacatgaagatagaaacgggtgagcattgaagggagagggaaggaattataaatggcaggcaataaaggccttccaaataggctcccttcatccctctataaaagcaccccttccccttgcaacctttcacccatcaacagcaacaaacaatagttcttttctttctctctctccctttgtaggtgtagatgttgatttcatggctcttctgatcttcgtgttctagtctctcagtattatatgcatagttgaagttttttttggttaacatagtatttctgaagcctctgatgtttgcttttgctattgcaaatcttctagttttgtttatgctatatactatatgtttcagatctctcttggtttgtggttttgtttctttgttggttgtttcttgaatatgtggttgcgttttggttatgaagtggagctcctttcgttccaatgaaaggtttatctgaagggtgatacagctgcttgttcatggttcccactattctatctcataggaaaagagataggcttgtggtttgcatgaccaaggagccgaatcaactccttgctgaccactctttggattgaagggagctctgcatcttgatcccatatagtagtacatgtcactactgattgcatgtcttatatatttgccccctgttcatgttggatttgattttttcctggttccccatgtgtagatctaatgatttttgataatgcttgtacttcaaaccagtcatatatagcacctgcatattcgatggagagatgatctggttttgcaagcttcgttgttttggcgttacttcagccactgttgttatttttaattacatgtaaaggtttcttatgtttcaatctgaagtatgatctctttagctaatcaagagattcagatttatttattttttgggtatcattgcgttgaatggtgtactttgcatcgctttattcccttgttggtgagatgttatgtcactgttgaattattccatcactgtttgtctttgcaccagcgtgttgtccatctgttgtagggacaagcagatgttgttagatcttgctttgctctttggacagtttgatctatctctcctgaacactgcttgtgtccactctttttttcccttttgctacacctggttctgatagatttgcatcagatacccttatgcttggatctactagccgctcttagtattttcattgcttcgtacaccggtcatcacatgttcgtctgtttatgtgtactgtactactcactgacagtgtgcagctgtggttatttggcctcactggcaaccgtgcatcatgctatgcatgttctctttctttggcccaacatatgctcttctttgttaattgctcttttttttgtagcattaacacgtcgagattgattctgatgcaaacatattaggtgtagatccgtcctggagaatggagattatatgatgtctattgtttggaagaagagaaatatggaagactgatgcaaacctttgccggcatggagtggagaacgttgatcaaagaaagttttctttagttgatgattgggttaaatcccaagtgtaaccataaaacaattcctgcttgctagtcctgtcattctgtatatctgaatgatgtttcacaatactcaaatgccaagttttaagatatttttttgtacttgtggattgtacttataaatcaatggataattaatcatttctaccgagaagggtgctctttttccttctatatggttaattccgaagtgtaacacaaaccattcctgcttgttatttagtccggcaatctgtaacactgaaatttctacacatagtcccctttttgctcttcacccagattgtttatttgaaaaatttagacagcaactggcggttcgtaccctatatcagtccattcaatgttatatatcttgcagattaccctaaaccgccgaattaaaagtagcaaacaatgatacttcccgacatctaccaaaaattatctaggtttttcgagttacagatcgatatgagtgtcagataagatcaaatccatttaatttactagtaccttgcatttgctgcgccgccgagcttgctatcttcgtggccggccggcggcgtggtcgacggcgatcgacgaggaagacgaacccatggccaactcatgtgtgatgatccgattcgtttgtgggtcgtctggttcgttcatctttgtttttatgggcctccatttgctagccggcccaaacagcgatactctccggttttcagctgctttttcacattttttttagcacactgtatcttcattgtagagactttatttctgattgatctcatgcccaacaagagccaaaacatgcgtgaccactaggtccatttgctagctcgctttttttttaataatagaaatggtttacatctctgattttcgctgaaggcgtacaggacaagttctcaacttctctcagaattataagttttttttgcgaggaccagaattataagttaagattacgctatcaaaagaattgctagctattgtgcttgaacaatattaactttgtcgcccaaaaaataattatacctatacacctggacaaatagtacttgtcaaaatgcattgtcagaatcacatttttgtatggagataacaattggtaggagtaattcataattgctcatatacaaaggaatattcatgtagacgaaatgttaatttgacaatctatatttcttttcctgtaattgaaacgataatcaaatcaaacattacatatactagtttttttagataaaattaaattagtataaactagaaagaacacaagtgtgatcatccatggttagcttggaagctaagcttctagtgttggaggttggagaggagagactgggaggcatggaggaggccggagacgaggacgaaggcggtggtcggaacgctcaccgccaccgctgccacgatcccgacgccgacgccggggcgggagctcatgaggaaggcctgcacggcgcccaccagcgcgcacacgtcggcgtcgtagctcccgtaccactccttctcccacgccgcccactccgccggcggctcccacccgctctccgccgccctcatctcgtggatcctccgccgcagctcgatcatcccctcgtccaccaccccgccgccgccgccgcccgagaagaactgatccgcgtcgtcgcgccgccgcgacctcaccgccgccggcttcctcaatgtcactgacgtcgtcgtcttctgtggtggtcgccggtatgggagcgccggtccagccaggcgaacggcggcggcggggaattgggagatcgccggttgcatttttggattccgataagaagaattgtgcagctagcgaatgctgtgatttgattcagctaacgaaattcgcgattcgattaaggagagaatcagaatcgcgaatttgaaatggattttagaggaggatggagagtggagaattggtggaatgcgatttgattgatttggagcttgggctggttgcttgggtttatatatatagtgcgtcgttgttggcaaaaaaaatttaaaaaaaataaaaaaacgcgtggcaagaacgttccaatggctgattccgtgtgattacctatcattttttttctgcaaaagttcagacattgtggcatccaggatagttttggtcaagataacattagttgtcttaacagaaaggagagctgttctagaaatgagttaaatttaactacaagctccatcatatcatgtcctaaaaattattataattcttctgttcttaattgtttcctccctcgacccctttctttcggcctattcaacatttagaatgtcgacatggactcttagagacattaggctgtgttagctggaatgggttgggaacactaattaaaacttaaatctcctgcatacgaaaaatggagtggtccattagcacataactaattaggtattagctatttttttttaaaaatagatcaatatgattttttaagcaacttccatatataattgtttttaagaaaacacactgttcagcagtttgggaagcgtgcgcatgaaaaacgaggcggaaggagttgggaattacgaacagagcctaaatgtgtgttcttttatccctttttataacttgtacctcttatttttcgcgcgtacgcttttcaaatttctaaacaacgtattttttattaaaaaaaaggttttacaggaaagtgctttcaagcataggaatttgaaacacgtcgacgtggctatgttcgtttcaagctgttaaatgatattccctctgggctgataatacttatcgttttagataagagtgaagtcaaactttagaatatttgattataaattatttttaaaatatttgtctttcaatatggttactatatgtatagattagtcttaaaaggtactttaataaaatcatatatttattaacacttttgtacatattataataaaaaataatggttaaagtagttttttttggaaaccgtgcccttatcgaaacgacaagtattatcaacccggaggaagtacgcttttggtaaaaataatctctaaaaaagttgctgtaaacaattcatttcccctcgtctcaaacgcacccaagagactaagagtcctttgaaacacacgaatttgaaagcacaaaaatataaagaacacgggtcacatgccttataaattcctacataaattagaagcacaactgcacaagagtatttcaaaacagtcgtttggattacacacgcaaaaaaaaaaagaaattgtagacatgtacaggaagagaaaaccatgagttggactttctcatgtttgttttagtctaaaattgtaatggaatgctttattccttaggatgttcatagaaaacttttaaggacatgctctttattccagataacttcatatgaattttatttccaggattcaaatgcttcaggaaaaactaaacagttcttttcttccaaatgagcctaaaacatgtttaatcattattttatattgcggattaacgtaggcggatataggaaattaagtgcgacacggttggatttggacgatagatcgatgtgacgccggtcggccgatatatatacgcgttgagagatcgagtggatcgaaattcgttggaaattgctgtaccatatcatgctgttgcttgcttgtactgatcctatcatgcatcattgtgtgaatatcctagccagtgctgttcatcaatagtgggtcaagttgtaattaagcaagcggccggcgattggctccacacgaaacgcgtttccttaactccctggtcttctgctccctgcagcatgcagctagctatcttcgctttgcttgcactacttttcttccagcatatatgcacaaattatagattatactccctccgtacttaaatgtttgacactattgacttttttaaatatatttgatcattcgtcttattcaaaaacttttgcgaaatatgtaaactatatgtatacataaaagtatattcaacaataaatcaaatgataggaaaagaattaataattacttaaattttttaaataagacgaacgatcaaacatgtttaaaaaagtcaatggcgtcaaacatttagagacggagggagtactagcataagcaagaagcagcctagcataactgcattatgaccatttattttgtgctggaaggactgaataactaaatgatttatggtattttcttcgtcttataataaatttatttttgcttctcctatttatcttaaaataagtttatttttagtaatcattgtattagggtttatgaaaatatgaaataattacatcaaaaataggtaagtgaggaataattgtactcggatttgataaagtaagggtattctagtccttttaattttatatcggtatgtgtgggatgagtaaaaaaataaacttattttttggaaagagaaagtacttcataatattttagctactccttttgtacatccacccaaaatcctttatattatgggaccgatagagtactaatgaataaattaacttattataaagttaaaaaatatacatatttaaaacaaaattttaaagaagtttatatgtggaaagtttagtttaaaaaaattcccaccatttagaaattctgaaaatgtgcacatttatatatatatttgtccatgaagcagaaaagagcagcagagtatgtgacgaccagatcatcaagctaacccatgcgcacttgctactccctccgtttcacgatgtaagtcattctagcatttctcacattaatattgatgttaatgaatcttaatgttaatgtaggaaatgctaaaatgacttacgttgtgaaacgggggaagtatatagctaatcagccggtgtcgccgttcgtcgcagctgagttacctattcataataagaatttttgcttgctcataattaaacgacggtgatcgttactacgtacgtaaatgtcgttcgcacgcatgtgcaagacgcgtaaaagcgtatgcaacgcgcatttcgtcaattaattaattcttgtatgcacttaatttctcaccaaatgttagtactggcttagtcgtagtgtatcatgtaagtagcagggaaacggggaacagcaaattaattaattggttggacgacagcttaatccctcgtctgaaacaaaacaaattaagcgaaagaaaacgaaagcttctcatcatttcgtgattgattgatcgaaaatcgttgtaaaaatgatctttttccaaaaaaagaaagttgtaaaattcttctagctaagaggaattttctttttgcaaggagataaaaggattttggaagatatatttcttctggcacaatatataataataataataatattggcattagctagctctgtcatcttttcattctttttactggagttgtggatgtcgccgtcatcgatccaagatgcattgaacgaaacgttgctccagtcctcaacacagcaagatatctcttcaatgttggcagctagccaatgtcgttttttcaagggctttaattttctcctggatataattgattagatcgatcggctagctaggctagctagctaattaatatgcaggtggatcctactatttgtgttttgtttgtttaattaatcatacaacaagatatgtttcatgtgacatactgcctgacgcacaaatggttgtataatttccatgccggtttattagttttagctttgaccatactgcgttatataaatataatcctagtatttgttgggcaaggtccattgaaattaatcagcagcaaggtcatctctgaagatcaagctcctgattatttgctggttccttcagagacgaatatatatacgtattataattccatatcgattattggatataatttcctgaagattcctttgagtgaggtcaaattgcacattttatttagcacatttgtttgactttctacattattttttctgacaccatctctccttccataatcaattatcaatattattgtacattttcccacatagtgagtgtctgatctacttcatgcgttggcacttgtgatatttgaatagtacttcatataggaggacatttccctctcatggctcttgtattacaaatctcctttgtttactgaaggccgcgttcttcaatggcttaaatagaggaaaactttttcgtttttcgtacgcacttttttggaactactaaaaacatgtttttaaaaaatacttccttcacaatgtaagtcattctagaatttcccacattcatattgatattaatggatctaggtagatatatatttctagattcattaacatcaatatgaatgtgggaaatactagaatgacttatattgtgaaatggagggagtatatatattaaaaagttgctttaagaaatcatataattcgtcatttggaatatatttatctccacttatgttttatcagtgttcaagctagattctggggctgtttggcacagctccagctccaactccacctctcctggagctggagcctagccaaacaattaatttcagttccactggaaatgggagcggagttgggtggagcactctcacagaatgaactagagaggtggagctgggtttagaatgcttcacaactccactctagacccaactcctggagcataatttaggagttcagctctaccaagcagactctccatctcggacaactgtatccactggacgcatcggatcagacatattttgatatttaactttaatcgaaaccgtcatttagtgtacaaagaaagtaataagaacaaacacccttgaagataaatcaccgacaaaatcaggattgatggtaccttaatatttcctgtaatttttttcaccttggtttgtgagtgtatgtatttagccgtgtatattttagttatatagaggctgagattgttctatagacatatatatcatcccgatataattgattgagtttaataaaactttcattatcttataaaatcaccaacaaattaaatttaagatcaactacacaagatcagctgtgtatagcatatcattctatctacatttaacactgcgataataatgcagggttaattcctttctaacacactcttgtttacaagttggaaatcagtttcaggcaacattttagctgcaaggtagagatgatgatccggtcaaggaacgacgtggtgctgcaggagcacggcggactccgccgccagctgcgccaggtggtgcacggcggcgacggcggagaccggcacgccggcgaacagcagcgcggcggcggcgatggcgacgctggggcgggtgcccatgagcagcagctgcagcgcgccgacggcggcggacacgtcggagacgtacgccgggtagtaccgcttctcccacgccgaccaccccgccggcgcctcgtagttgttctccgccatcctcgcctccctcatcctccgccggagcaccgccatgctcgagtccaccagcgccccgccgctgtactggtctcgccggaaggcgcagcacgccgccggcgacgacctcctcgccttcaacgccggcccgcgccggccgagctcggccggcgacgtaagcaatgacatcgacgacgacatggccatccaaaaaccaaaaaaattgttggcaaatcgcagtagtgaggtagcaagtgatcaagagaagaagcaatggaacaaatgaacaatctctgagctgatgagaaatctagttcaaatgggtacatatatatataggagtaagcaaacgcgtgaagattaaaactgatttagtcatcgtctggaccaaccacgtggagacacgtgtgcccaaccaggaagtactagtccacatggcacattttggccggtgatttattcagggaaggaatcatggaacaataaatagtttagaagtaatcacatcgaatgcagcgactcgtcgcttccaaccaacaccggccatctcccattattgagttgaatactattactacgagtacttgcttgacaaaaaagaaaagaggaaattaatcattcagttgagttgatgtactgcttcaaagtgatgggcttgggcggctaattgttttattgccgcatgatttagtgatcctctcattctcatgccgagatgctgtgaagaaggtgcagcttctctctgataagaaaaaaaaaaagaaaacagttagcaattggcaaagaggagaaattatagtactatcatactattggctaagttgtttatcacatagcctgaatgctagtgcagatccctagctgccatcagttggcacatggtcaaggagatattagtatatggcatcatcagcaaagctactcaaatgggctcaagggttcaagacttgaagcaattgcagaattgagtgcctagaggtcacaagaaacacaagatgcatggatcttgaagtttacaacatgggtcatgattcctgatttatgctactgtcaactaaactacttcccaaacaccatatctgtagcaattagatcttataaaggcttcagagttctcggcttctagcaatgttaatctaagtgggtacaacaacttgatgacaatgcatttctgggcaactaaaaacgatgtgcttgataacaagacagtcattctgggaatggggataagtcttctatagatgcaagactatagaatgaaggaatgcttgctacccccaaaattatttaggccataatttcccattcagatgctacaaaaagaatattaactacaaaaagggccatacaactaatgctcaatatgatacaacagttacgttttctaattgcagtacatcctgacaaaaaatatttcaggagattaggaccattgtgtgaaacgtggttaatgctaatgtctcttttacctttgctggcaaaatgttgctggcagcacttcatttcacttccttaacttgctgcttattttgatcttcctcagatggtggtagaagctgctgatactttggcctgtttttcttcagaagaaggtaggttaaccagtaccagaacatcagaattctaccctgtgccacaagcgtgtctgcaatgcggattcctcctaatgaaaacctctccagggcctgccatagaagtaatgtgtcaaaagcagatcacttcccctccatagaagaaagatatgccaaaggttcacctttttacccaggccccagttacaattcaaggaaaattttcaattcagatttttaattgaatgtgatgataacacatgaatagtgtctgggccaattttctgtttgagtgcattatcattcaaacattaacttaggtcgagcaatatctcactggcacttaaccaagtgtgtgtctgcatttttgtaacagtaaaaatgtaaaactgccttttgcaggtccacatgaacaaccgtacctgttcaccagtttgaatgtcataggaatgctgttgctcaaattgcaaacctttgaactcattaatgcaaagcccttggaaggccctgaaatcaatggcaaacaaagttgaaatatagggtcattaactatcccacggtcccacctagcttaggagccaaaatatgatataaggaagagggttaccatctaattagggatacttttgggatccagcgaaaaatgacgggggtattatcagggttaacatagtatcctccaaatacaatgaaaactgtcataagggatggtccaagggccatggcggcttctgttgtaggagccatagctccaacagtaaggcccatggctgatgcagcaaatgattcaacagtcacgatgccacagaacttggcaaatctgaaagtgtagcatggaatgttgtttgatggagcataaacaaaatagtatcgaactatcgatattctactatttctgcgtggcatgtaataaagtgcctcagattcatttctaaattagagggaggataatacttacctagaaaatgtaggatgaagtttagacattggataaagaatggatccaaatatcaatgggaatgcagccccaataggaatttcagccaacaacttagaagaaaggtatggtcctagtgcataggaacctttggcccgttctctgtcaactatagcccgctctttcgggaaaactcctactgtctttgtcagtgcagccattgctgtgtttatagcagttaccttaactcataaattgaaaaagggacagatcaaaatcagaaaaatgctcagacacaatgaaaaagcttgtaccaaagtcaatattaggaagagaatgaatgtaagtccaaaatctgaagcatgtgcaacctagcaaattcaactcaacgagtcataaaaaatccaacatattctacctgaagaagtcccatcctgtcttgtatggaagtctgagttttccccattcgccagaacacagatccaaatatgattgctgaagcaacggacattcttgctctcactttgtttgttggtccatcacggaaagcctaaaacacagaaggtcctattccaatatcagacacaacagcgtggcagtaaatctttagctaaaccccatctaagcaactgcgctcagattattaatgggtacccaggcaaactataaaaggcttgaacattagtcagataacctcaaccacaatccaaatccttatagttccattagcaaagtgtttcctttttgtttacaatcaaccacaatccaaatcctcatagttccattagcaaagtgtttcttttttgtttacaagtatgtttcatgggcagttgcgtattacacctttttgaggcacagatttggcaaaaactaaatcatggatccaaactcaaatatagtaacatgttcgatctaaacctcctaaattcattacattatgtatatagtttactcaggctaaaagaatatgtaagaaaaacgatttttttgaaaggaagcctcacgagtatctgataacttccacagcaaataataaataaacatatcaacttgatttaaagaagcagcgggaagcagattaaaagaggaagctgcaactgagaattaaatgaattttaataaaacctgcatccatgctctcttaaacagcaaacggaattgtctccaccacccacgtctatgcttggtggtggacttctgaataagtttgggagaaaattcagagccttctggatttgtcagcgaactgttgctttcagtaattgcaactttattagaaaattcttcaatgaggttttcaatccttttccgtgatgactgcacactttcagcagaactataatcaacagaaatgagatcagccaagaactcagcagggttcacatgatctggacaatgatacctgaaaaatatgaagtaatcaaactcaagttattgataagcaataatagcaggcagaaaaacaagcagcatagcatattgacagtatacatagaatatagaaaccaacacatctgataatagataaaagaacttataaaagcaagataatctccattatggtgtgaacaagtacacaagccagaatctgcatgcctaattaaaattctgagtaaaattctagcataccgtacactggaattttggatagtgccactaacaaggacaaatatgaccactatcatgttatgcaccaaggtagtagagtattacagtctaaataaaatcagtacaatgcacacatcgaaaacaacaggaaatgccaagtaaaggaaaaggtgagcgaataccaaccccaatgatgcaaagtacaataacggttcctcttttgctggccccatgtatataacttctccctctgacagtagtacaatatcatcaaatttgccataaactgaacctcttggctgatgtatagaacatatcaccgtgtgtccatcttctgcaagctgtctaagagtttccatgaccttctctgcctggaacgcatcaagacctaaaaggatggcacatatgtgaacaaagtttatgcaatctcacttatgttttgcacttttgtcacatcaaaggaccaatgaatgcgctatctctaatcatggaagctcaacacttcagataaagtaaatgtgcaacactttgtccagaagggatgtagcttgtatatcatatcaagaatatattttgtttgcagcattcaatgacaaatctaataaggcaagtcccaataccatggtgcttgattaaagatgccaccaagattatgatatgtcatgtgttaaccattagagtagcagtcttagtacaagaaacatgcatcatcttaaagcaattcttgtggcatgagaaaaatgtggtgtatctattgaagccattttaatgcaactatcgcagtattggcaatctattttcacttgaatccggcatggctacaaattttctttttctttgcccttaggggctgtatttttctcctgctatatttaatgaaaaagcacattctcgtgctggttccaataaaaaaaagaagcatggcacaaatttacaaagaaacagtagatttgaagaagtgatcagaacatttgcttgcaactagtcatgtatttcctaacgaaaacattaagaggagatgagaatgcttattcaaccaaggaagggttaaataaacactacagtcaggtaaaagtaccagtagttggttcgtctgcaaagatgatagaagggctagcaatcagttcacacgcaagggagagacgcttcttttcacccccacttattccacgtacttttgcatcacccacaattgagtcagcacagttaacctacaaccagttataataaaaagaaataaatacctggtgatacaaaataaaaagggaaatacttgaacagacagcgatagatattatgtaggttctgcccatcaattgaaaaacttagcatacttgtcatctatctgagcaccaaaataacaatgcttttcatgtgtaatttgacagattttctccaccagtgctagaaactacaagttcgtatccaacatttgatgtagtgcactaaaaccaattggttcaatttcttcgaacattttaaccatcatggataactttttctttagaaagcagaccatataccatcatggataacttaccagcccaagacgaaacaaaaggtcattaacatagctttccttcctctcaggagtcaacgtgcggcgaagctgaagttcagcagcaagcgagagcgtttcacgaacagtaagctgtgagaagaaaaggtcctcttgcctcacgtaagcaatcctacacaaggaaaagcaatgagtatagctcttctctgtaaacctgactaaaaaattgtgaaagccaactgaagaagcatagcttaagcttacttatagccaccttctgagataggtcggccattgatgtacagaaacccagaaaggtgcaaagaaggtgatgctgtgagctgaccagcaagcacattnnnnnnnnnnnnnnnnnnnnnnnnnnnnnnnnnnnnnnnnnnaagcagcctccccgatttcgcctccccagacgcatttgacagcaaaaacctcgcctggcatgcagcacgttataaccattacaacaatcacccagagacgcgcagaagcaagaaattccgattattgatggcactcaatgtacaattcgacatacagaatacacagcttcggtgtgttcatctactgattgaagctgcagagtgcagacggtgaaagtgtgaaacaaatttcgcaaattacttgttcgacgcaaattaatatacaattctacatacagactgcagaatgccacgcaattacttagcccgttagccaacagcggaagtgcgaaacaaatttcagcaacctgttcatctaaaatgtgatgagtcagtgccacatcgacaggtagggcccagtgtcagtctctcagacagcacgcggctctcctggctaatcctaagcagatgattttttttttctttccgtgcgcgcagcgccgccgaccaatgcgactcctccggcgagagggaacggaatggatgattcgaggcagagcgactcaccacgtcgccgcgcttgttcttgagggcgcaggtgatgcgggcccaccttatcgtcaccggaggcacgccgcctccttccccgccggcctccgggtcggcgtcggagtcctcgtcgtcggccggagggaggagcgccgggcccgggccggcgacggcgcggacgaacagcgccgcggcgagcgcggccaggagctggcccagacccctgacctccatctcgcgcgcgcgcgggggacgagcggagagaggcctgacgactgttctagaagcttctggaaggttcacgtcgcgtgcgacgaggagtgaagaggaggaagacgaggggggggggggggtttagcgtggagttcgtgtggtggtggttgctttgtttgttgcgcgaccgatgcgaatgggccttgggccttcttcgtcatgggccttttgcgtagtaggctgatgggcccacctgtaagtaacacccaattgtgctgggccttctgttgcagtgggctatagcctacaggcccatggctacaccttttacgtaccttactccgcagaggcgcggagtattagctgagggcttatttgtaaataataatagtaataatcacccaaaacaaatcttggagcggattggaactgcaaatttggtccatttttttcctccaattcaaaaactccgtcacgaattcataaatgctgacggaatcttgatgtagctgcactcatgctgaacgtatgtgtaaactgacgacaagtgagtgcacgcagcaattgatgccgtacgcacatcacatgtgcatctcagcagactcagcatctgtctcaaggaaaactagctgaactaacaaactgaagactcaagctgcaacagcatatgcagctagttacttacttggatggctggatttattactgatttacatcgctgaaaattcattctggccgatccaattttgaccttttcatgaatggagtgtattatcttggtcccaaaatactctctctgttcttttacagtatatgacgaccaatgtcatatattaaaggatggagatagtataacaacttttgctatatagcaaaaaaaaaaagagttgtattttttgaacggttagtaaaaaattaaaatgctactagctgcacagaaaactccaaactgtttgctacagcgaggttaaaaacgactctcaagtgagaatcagccaggttgtgccacctgacatccaactcaggagcttcagagatgctgctgatttcagatacacatctgctgaaaatgagagtgacccgtgactagtgcctaaactcaaagtgctactgtagtacagacagctcacggctgttagcaatcttcccatttttggatcgtccgagttattagcagaattgattgcaattcttataacgtgatttaaggagaggaccgacgagatttctgacattttggctttcagacagtggaagcttaattgcagttcgtcctggtcttcttggctggagtaactactatacttcagcttggtagtggtaagctagcttcagtaacaatttgtttgggtgatcaaatttgtttactccaagttggttaattagggaccagggagggtgaccaccatggagatcaaattgagatactacaagtaaacaatacccatcgagaccatgatagataggctttccaaacttcctagccagccaagcataatctgaactttttagtatctgtggaggcagagccaatctgtgggtgccacgtcacttttcacacagaggcagtacaaagtactacaaagcagagctggtagattgtagtacgtggtagatacttacttactcctaagtcacgaaatagtttaacttaatcaacaagagaaaacgactaatgagaagtaaagtccggatttcgtcctttatcttgaaaaaaacgaaaactaatgacagcgagcgaaatcgcctttctcctcaccaagctgaccactctctggaagcatcagcgccactgccaggtgggacccacgacgacaccctgccacgtgagcaagggccccatgcgaggcaagcgccgttggccccgtccgacaacgcaccttccgcccccgttactctgagccgagggacccacacgtcgactcaccccataccccgtacacccagccagaaagagcccactgaccggtgggccaggaggagagtgtgccccacatgtcagtgatggtagaacagaagggtctaggcgggcgcggggtacgacgtgttccgggtgtagaaagcgacagcgcccctcacaacgctcgcctccctcctcctccgtctcctcctttcatctcttcttctgtgtgtgcgtgtctgcgaagcgtgagagagaaacgtacgcgacgcgacgagctcctactccgatctccccgatgcgatctcgccaaaccctaatcccacccaccaccgcgccggagtcctagcgccgcccgcagccgccgccgccgtccggatgctgcggccgtgacctcctcctcctccgcctctgacatcccagccatgggagccgccgacaagtggctcctcccgctcgtgtcggtctccttcgtctcgctgctgctcttcctctccgcgctctcgggcttctccgcctcctcctcgctcttcgcgcgcctcccgccgccctcctacgtccgccgcggggcagccgcgccgccgtccttcgcgtacgtgctgtcgggggggagaggggaggggaggaagctgctgcggctgctgctcgcggtctaccatcccaggaaccgctacctgctccacctctcggccgatgcgcccgagtccgagcgcgtcgagctggccgccgccgtgtcgcgcgccgcgcccgccgtgcgcgccttcgggaatgtcgatgtcgttggccgccccaccgctggcacaccgatgggatcctcgggactcgcggctacgctccgcgccgcggccgcgctgctgcgcctggattccgagtgggactggttcgtcacgctcaacgccgccgactacccccttgtcacccaggacggtaaggttcacaattcgtgcctccgattagcatgatttgcttcggaacatgctggtttctgcacggccttgcccggatctagtactaatcccacgcttttacttttggtcgttacagctaccccagaattgcatttcgatcggaagcttttcttttctctgaatttgggatcaatgatgtcatcgatgaaaattagcaataggagcatctttgctagtttagtactataggagttgctggagctaggaaaaaataattgttttcctttacacaatatatgaggtgaacttggcttaagtggtagttaatgtttctcgtcacattgtacacttatatgcataataatataccttgaaaggaccaatgcactaggaagcagcttggtggtgctgctaggtttggacaatttggaagaacctctttgtttggagtacttcttttggacacttgtaccaaaagctgtcctaggtggaaatctaataccacaatactcaattggcatgttttcagtttctaggtgtcatctaactcaaccactcaatgacttattattttctcttttcatagtgaagttcctcaactcaatcatgacacatgaaccatggccattactgtcagtcttgagctatgcgactctatctgtgattgtttgtgatactcatatgaccgctcatttttgtcttgattgttttttctgacacaactcattacaacctggcatattgataaaccaggaccaaattactgatagaaagttggggaattgttttatgttatggaaattgcacagcattcatgcgatcatcttacatctgaataaccactatctgtataccaagatcttaatttttaagtcctcacttttataccattaagattagacaaagttggtttcggcattctgttttattttattgtgtggcttgttacaaacaactgaatgaatgggcgctacaagagagtgagaaggtggggaagggatagatcaattggaagttaacattatgtatcactgtgagaatgcactgtagtcttgtgtaggtttatcttgaatataccatttgaggctctgatactgttatctttgcatccttgctgtctcatctatttttcagttgcttcgcatatgcaaataattaccatgatacagggtgcatgcattgcagtctagttggtgtaaagtacacaagtcagtgggagtgtagaaaccttatctttcttctttgtttccaaagtcatcctcccttgatttcccctcctcaaattgtcaaatgtattaatctgcattgcacgtaggagccacacggtgttattgtcctctagcaatattatatacctgttcttagattgtgcaatgtaatgtggtcatgggcatattcttaaatttactttattcagaggctttatggtgtcctccttttaaacaattccggtactaatgatcacatgttaatacattagttttgagaacacacaaataccatgcacatttttgcatataaagaagaaaatgaagtttgatgcaacacggtgacagatgactgcacagcacattactattgttgtacctctagtgtgtgaaacaaaggcatgttccaacttagaaacagaaaagagtgacagtgaaaaccacagttacaccacttacattctcagtgctatcagaaccaactgcgcagcagctgatgcctgcgtacaccaaggagtccctcttgctgaatccctttcatctcttcttcatcaatctctgcttatcattgaaaaagcttgggattttctttcttcctttcttggctgcaagcaaaccaatgtaattaaccctttactgaactcggaattcctctatgggaagacaggcacattacagtgccatgttctcgtagtatagttaatagtataatacatatatttacccattcctagatctgaccacttactacgaatatctcgtatttttccttactaagtggagtatgtctaaactactagttccatatcgcaatatgtagtccccagatcttgtgctgcctgtcatttttttatctccttgagaaaacctactttgttgattttttttttaagaaaatcagttacgttctcgacttggcttgaaccgcttctatatattgtcaacctatcagttgtttagtttcgcatgtgatatttacattctagttgatgtttgctgcatgtacatatttattttcctgactgatatttcatgtttatggtgattgatacagcctgaaatccttgcttttcagatatttatgtttttttatgttgtcccttgctacagacttgattcatgtcttctcctcagtgccaaggcatctcaacttcatcgatcacactagtgatattggatggaaagagtatgttatatctgaacttataaataatttatctgcgcaagtattagtttcaccaacatgctgtgggtaatactgttacaggactcagagagtgcaaccaatcatagtagatgctggaatatacttggcaggaagaaatcagttcttccaagccacagagaaacgtgatactcctgatggtttcaaattcttcacaggcattttctgactcctttcacttcattttccttcgtttgatcaactagttctgtgattcatgggtttcctcacatacaggttctccgtgggtcattctaaatcgacggtttatagagtattgcatatttggttgggagaatctccctcgaactcttctcatgtacttcacaaacgtaatgctacctcaggaagggtatttccactcagttgtatgcaactcagacttccgtaactccacagttaacagcgacatgcggtatatggaatgggatgatccaccccagatggaaccccattttctgaacacgacacattatgatgagatagtggagagcggagtgccttttgctagaaagtttcgggagaatgaaccgctgctggacaagattgatgaaagagtactccaccgttggcgtcacagacctgttcctggtgcctggtgcacaggcagaaaaaggtggttcaatgatccatgctcccaatggagcaatgtcaacattgtaagacctggtccccaggctgagaagttccgcaaacatatgaatcagatcatagaggaatctgcatcaggcaacaactcatgcaagcaatagcagcaatgaagcgcgagatttcacttcccatgtttgaagcgatgagcttttctcattttgcatagaggggctcttcacgaacttcagcagttaacgcttccagagcgaacatttttgcacctgggttacaagcacacgtccaaaggtgagatgggtttattctttccagattttttggtaactgtcatggcttcaagggcctcactgcatagcgcatactagcttagttggaagtcagagtgctgatggtcggagcaccaaagctaataggcagtgtaattattagtgatcagttgaatgacttgtgcgactgtttatagaactgatggaattctgggtgctcccatacaggattgagaaaaatgaagagtgggtgatggtggttggattcttactgttgtggttaatacaatgctctttgcgcccatggcacctcactaactatttaatatcatgcattgccaggatttgagtagtactgtggtgggctaatcatctggtatggtatgttattaagagttctatacacacttttttttttgcggggaagagttctatacactctttaggaccttttggcatggttttgaattatgaagtgagccatgtttcactagaaaatctaaggcagtaaatgaatacgaagtgatttaacagactattacagtaaatgaaaatctaaggcagtaaatgaatatgaatatgaatattaagtgtcagagctgtaaccacagagacagctcagagtttaacagactatttcaggccagcaattgtggatgctatgttcttccatcttctgtttgtactcaactcaaaagcatgcttcacaatcagattcagataagtcagggatccagacgtacgcccggctccgagtgttacgaactccgaacaaattcaatcctgttacaccggttcctcgcgtcggcacgtgggtgcgaatggcgattttttttttacctatttagggcctactgagattagtgccattttcaatcatactattttttagcttagttgctaaaaatgtgtctacgcttagtttgttgccaaactttggtaaatacataagaaatcttgccaaaattttgacaatattgctaacttgccaaaattttggcatgtttattttggctacaactgaatatgcctttaattttttttagtaaattctacaaattatatgcactttggtcactacataaaaaaatacagaattaagaatatatttttcataaaagtacagatttaacataaagaaaaatcactctcgcccttcgcgctgacctcctcacagctgctctcgcaccaacctccatactcgctgcgtctggtgagatgagaggagaggacaggatggattggtggggaggtggataagtggtggagagagatgtgaaagaaagaagaggggagtaacgaggaagaagatgaatctgatgtgtgaaacccacgtgcagatgaggagatggatggaaaatgtgacggcagtggcacggttctaattttgtaaatttcaatgtcaaggttacaaataaacgaattgtaatggcatttatatggaatggcatatttgcactggcatggatcaaattaaccctaaataaacctaaaaattaattttagttggtcgcatgcaacacattttcttgtaaaatgatgattattttgaaaagaccttaagaaccttaggtgttgatcaaaatgggatgtgagtaggaattccatgtgagtagagtctgccaactcttatgggctgaaagatgtgacgcggcctaaaagaggccacagccttgaacgaacgggccgggccagactgggctgtaagatttgaggaaatcgcgtaggataatattagggcttgtcaagagaatttttcgataaccgctaatccccaactccaaggtagccgacacaaaaagaattaaaattatccactaaagaaggcgatacatcatccaccaaggtgagcaactttcttctttcaacgattgtttgttctcttggaccaaaatcgatctgcttcttctgttcttcagtcatgagtttcttgcgaggaaaacacgggctgtatgattagatgaagatgatgatgatcttaggatttagattaactgctattgaagtgattattgcgagtatagtccttaagatatgtgatcaatttgttctcatattggtgcttagcatcctaattccgattgggattaatttcgacagccctgaaatctctgaaacattctgaattctgatacgcttccaacatggcggttttacagatggctcgtgagaagaggtcgtgtccgagagcttcagagacgcagcagaacaattcagaaaagaagggaaaggtggatggtgagagtgcagctcgagacaagagggctatcactgtcactgtagatcctgaggttctggaatgtgatgtctgtttcggccctctcactcccccactttatcaggtaaataagcatatattgatccttcttcttgctgatcatgattccatttacaagtttgtttattagtatttactttgctcttcgtgttataagtttttcagtgtttcagaaaagaaactttaatcatgttcaggtcatatctgcattatctgcaaatgtctcaattcttaactctttgtagtagaacgtccagtgattactcattcagtttcaagtttcaacaaactgacacgaatatgtgctgaataatcatcgaactttgatcatactacaatattatttcagatttataggactgtctgaacattctgaaccagcattccatgcctgaacactttctacttctatttcgatactctccttacgacatcctgaattcttgagaatctgcgtgctataatattgatcacattgttcatgt

SEQ ID NO: 32345 - DNA, 2248 bp, Oryza sativa
aggcgcacgaggcggcgtgcgcccactcgccgtgctactgcccgatccgcggctgctcctcctccccttactccggcgtgtccctggtcgaacacctcgagcgcaagcacccggagatcggccgcacccgcgtcgaccgcaccaccctctccccgctcagaatgtgccacggcgagccggcccggctggtgtacctcgccggcgacgacagggacagggcggtgttcctcctcgccgtcgaccggagcgaggcgccgcgaggctggtcgctgtggatggtcaggctcaaggcagaagaagaagaagaagaagacaagggggagctgaggtacaagatcatggtggccgccaatggcggcgtgctgtcgctggtcggcgagacggagagcgtggggcggctgacggcgccgtacagggcgagctccttcctgttcgtcccgggcgccatgctggatgctccccctgaggctgagggcctcctcgtcttcgtcgagctcaagtgagctcaattagcgctgttgcaatacgtattacaagttcattagagtctactgatagtgatatctccattgatgggatcatgcaagtgtgcaaatagatatacaattgttctgaatcgattatttgaaaaaaaaaaaaagaacaagctcaacagaggctataatggatgccttgtggatattggccaacagggacaagtccatcatataggttcagacttcagacctcttctcctgataggagtttcagatgctgtgctgcatgcaacaaaagttagcagcaattttttctgtattcgtatacatgaatctagaagccgacacgtggatgcgaaggttgtgccaaagaaaatactgtgacaagttgtgtgcattatacgatcctaactactgtatcatggctatatttataggtgcttgcgatcgaataacttgctttgaaagcatgcaagaacccaactatacatctttaggcgcaaaattcccatctttatggtgcttggtgccatgaactgaccttagtggcaatgaatgattattactgatctgagaaagcctacgatatcttcagacttgaggcatcaatatacagaaaatgacaactcaacacgacacactccctcaacatcatcttcttctttgctatgggtcttcagtgcaaaaccaaaagttcatcttttcaagggcaaatcattgagtagtacattgctgataagtgataacatgcgtaatcagtcggcttcttgttatcatcatcaaaagagacacaacaatcgtcagtagcgactgactggcacttgattgttggttgattgcctcatgttcagcttaactgaatcaattgaccagtatgcacgtgttatgttgcttgtttgtaggtagttagttagcaacaacaacacgagttaattgtacttataaatcacattgcaatcttggcatgactcaacagctcacttttggtgaaatgatcagtagtgaccgaagccaaaagcatctatctgcgacccaagaaaaaggtggtcagctaccccgtccattggagtggagtggagatatggtggagcagaacaagagggcgagggccaatggcgaggtcaagcaggagcagcagcaagaggaagaagaagaggttgaggaaggagaagtgagccaagaagaaacccaaaggacgggagctttccctctggtgaccatggccgccatggagcagacggaggaggagacgcagatcgacgtcaggatcgccgtcgccttgctccactgccatgcttgcctccaacctctcaagcctcccgtcttcaaggtcactgctctctgttgatctaattcggatgcaaagattcctatcttgatccttctttctcaccctctcttcttaacttctcaagactttgatagagcgaggcttgtgttgattataagggttaggttttgaacgatctcggccatgtttctttgttggcctaggattataatcctgtaattttttcctactctatctatcaatagaatttcacactatgttgtgcgagtcgttaaaaaaaagattcctatctcgatttaatttcttcttgttcttcttgttgttgtgtttgtgattaattgcagtgcgatgaggcgcatatcgtgtgctccggctgccgctgcggccaccatgggcagctgtgcggtggcgccgccgtgtacagccactgcgccgagctggacgccatcgtcgccactgccaaggtgccgtgcgcccacgc

SEQ ID NO: 32346 - DNA, 9874 bp, Oryza sativa
cccatcattcccatgtctgtaaaaggaagtctactgcaccaggaattggacacaaaattcatcacctgcatttcaatgccaagcagtgccgcttcacttcaatactaccatctgtgttccagtcaggacttcagaacgtatgacaaaagatggtatgtagtagtatgaagtatgaacttgaatgactccatgctaattttctattatgttgtttccgctgttgaaaatagttctgggtgtgtttagttctttgggtgtaaagtttttaaagtatacggacacacatttgaagtattaaacgtagactaataataaaacaaattacagattccgtatgtaaactgcgagacgaatttattaagcctaattaatttgtcattagcaaatatttattgtagcgtcatattgtcaaatcatggcgtaattaggcttaaaagattcatctcgcaatttacatgcaaggtgtacaattggtttttttccacatttaatgtatccatgcatgtatcaaacatttgatgtgatgtttttagccaaaattttttagatctaaacaaggccagatatactattgatctgaatccatcatccacaaaatgtacaagctcaacagaatgacagatgatgatgagggccttttatgggttgtggccaacagagaccactcaatccataggttcaggccacagcacgggattgctaacttcttgagggtgtttgcctgtttggtttagagacacgtgaaatgggatcagtctttaaaattaatattcttcccttaggttcatgccagccttatacagtgaaaatcgacggagtaatctaactgacttctctctcgctaacatacggaccacattatcctatctctcaaaaacaagataatcccatttctcatgttgtatggatagttaggatcttcccctctaaatgcgaggatgagtcaagttcattctacttcgttcctaatccaaacgcacgctaactcttccaagttttagtctttacaaaataaccaccgttcaatgctaccattgagttgcaatcatgaccacaacgcagtagaaattcagtatatcaatcattcaggtcttgaggaggcaacacaaggatgttgtatgagaaatgagacctttcacggtgtttgcatttcaaaaagagtaaagagtcaacgcttcataatgaaaagtaccctgtaaaaggtatttgagtattggcataggcactttacacattgttctttgctccatgttcccaacccctctccctcgtattccgcgcgcacgcttttcaaactgctaaacggtgtgttttttgcaaaaattttctataggaaagttgcttaaaaaaatcaaattaatctattttttaaaaaattattaatacttagttaatcacgtgctaatgaaccgctcccttttccgtgtggaggagatgggttccaaaccagggcatgcgaacacagccttaggtaccaagggcaaaaagataaatttgctagtagagatgagaggaaagagttgtctgcaaatttagatcggtaccgcgtcggcaccagttaagttgtttgcatgatactccctccgtcccaaaataagtgcagttttgcactatccacgtttaacgtttggccgttcgtcttatttgaaatttttttatgattattatttgtattactattagatgataaaacatgaatagtactttatgtgtgactaaatatttttaaatttttcacaatttttttgaataagacgaacgatcaaatgttggacacggatatccacgactgcacttttttttggacggaggtagtactagcattaaagttctaatttacgtggttttctctagatttatattttgttcccaagaatatcgtagaactcttcccattaattatccattacgttatttgcatagttattttgatatttatattttgttcccaagaacatcaaatatcactcaaggtttacgtcaatttaagttttgcattttattcatggaaaacataaactgtagataaaatatttctaatgattgcatccatctgaacatgctatggtaggttaacaaacaagataccagagcttctctctcgaccctatatccttcaggttcaactattcaaaccctagaagaagaacagaaagggatatctcattttagtcgcttatacgaaggaatttgttaactatgtaaataacgaatcaattgtgtaaataagtataggagcagaggagatattacccgatgcgcttgcgcctagccgtctatcggcccatcttgaaccctcaaccgtgccgatatttcctcctttgtctccttctagtggaacaattcaaaccctagagcaagaacaaagccagggtcgaagaaaggaggcgtcgatctcttctcttttttttttttctggtgcagaagcacggatcgattgttgcattgaattgtccgaaagatttactttgttttctacctaacaatactggtgattggacctaggtatttgattcactcaaaatgctcttcttcttttagtagttaattactctattggccattgctattagttatgataattttattccgtacttgttgtagcgcccgttccgtcgtggcgcctagcgggaaaatttaaatactaaaaaccctaattgcgaaatctgtttctttgcttgttgtcagtctccgtgccaatccctgatctcgaatcctcgatctatcgtcaaattcaaatcccggatccaaaaatcctccccaaatcaaattcctccgcaaaagtctatttttcctctcttaggttcggtgggccgatttcctctcggcccatctctctctctctctctctccctccctcagccctcctctccctcgtcccgcccgtgcgtcgcacgcgcgtgcgcgtgagccgacgccgagccgagctctccctctttctcgttctcctgctctccctccccgtctctctcttcccggcgagccccgcccccgagttttgaatcccccgcgccattgcttcccgcgcgcgcgcgcgccgtggtggccgaccggccagtcgccgccgccgtcagcgcctgccgccctgtagccgcgcccttccaaaccgcccccgccgtcatcgccgtcgttacgacccggccccgccaccaccgcgcatgctcccaaggattggaggcagagctcctcctcccactgcctcgtcgccctctctctccttccttcttttcccaaagtggcaagaggcaagtctcctttcccccttcctttcttcctttttctccccgccggcgtcatcctccctatcgccgttttggccgtgaccgccgagcgccagcttgctctttgaccgccctaggtcggtttccaaaccggcattgccctcctattaaaccaaggcgccctcccttcctttccctccccattccccctcgctccaccacgccattgccatcccctctgtctctctatcgccgaccgctgccgtcgcgtgtgccggaggagccggtgtgcgctaggacgcggaaggggactctgggcgctcgtcttcttcctcttccccggcctgaggccggagagatcactcccgtgccgtcggcctctcgtcacagcgccctcctctacagcggtagtgcatcctccccgttctccctcctcgttcctcctcttccccttagctttcggtagaagcttgtatagcctccccgtagctagctggcgccgccccgaccgttgccgccgctcgctgtgtgctcgccgccgtcgccgcccgtgctcggtagcgcccacacgtcgccggcctctctcgtagtgtctccgtccaatctgacgctagaaacggattcccggagtcgcgtagatgctctagctcgcccgaatcgacctcccgtcgcgccgtcgccgtttcccccttccctcgccgacggttgccgccgccgcaatccgccgccgtcgagctccctccggcgaatccgagccgttggatcgtctcccctcgtctcgtgcaaccacccggtgtgcccgcttccgccggtatcgccgtggttcgccccgccgttcgtagccgccgtccgccgtccgttttggccggcgccgtcttcaacctcccgccggcctgtgtggcagccacgtaggcgccacgtcggtgccagctcggctaagaccgggtcaagccgacctcggtccgccgctcccctctgccccgctcgcgcgcgcggtccaccatgagccatgaggctgcgcgtgggcccgccgcaaccgcacccccgcgagccgcgcgcgtgcaccgcgtccctcccccaaatcctagcgcgcgccgcgtgctccctccgcacggtgaaccgtgccaccgacaagcgggtcccgctcgggaccacgcgaggtgagcccggcccactggctccccctctcctcccctcccgcgcgtgccttgggccgccttctcgggccggccggcccattaagctcagccgagccgcccttttctctcgggtcgcaccctagccgcccgagggaagtctgtttcccctccctctttcttttctctttttcaaaagggtttaattaaatcctttttcctttagaccaaaaatccaataatcttagaaattcaatatcttcttaatcgtatgtcggtttgactctgttcaacttctaaaattcttcaaatctcgagatctatttaatggcacgtttagaggtcaataatagagctttattttcgttgtttgttgagttgtcccgttttgcgtgtagtttcggagcccgaagacccgcagtgcgaggatttcgaggatcaagctcaagatctcgagcaaggcaagtcacctttgatcatcttgcaccgataatttaaatctaagtatttcttttccgcaaatattgcatgaataggatttacacaagtaattcggccgcggcttgcgagatagcctgccggcccccaatcctaattgctgcaattaccctccttgaattgttgaacacttaaaccttctttgtcacctgttgtgcttcgatgcacgggccctcgggcacgcgcatcggaacacctcccctcaaatttaaaatatctaacgatgggtaaaacttgggttttacaaaagacttggaaaacccgacacctgggtcggtgcttgcgaactaaatgaatttccaaaatcgcggatcgggaaatgtaccgggagtacggtttcccgctcttgcacttaaggaccgttttcctttggaattacatccgagcatacaatagtgcgaccacatgggtggaatggggcacccctggctgagtaattagctaatcaggggagccttgatgccgagagacaagtggattcgccggggtggtgtcggggaggacccttgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttattaaactgttcgaacagccatgcccacggtcatgggcggatgtgaggtgattcctagcgtagttttgtttgactactgctttgtgaaattgctgttgtggaatgggatcgatgtttggaaaatctgcggctgatgggatcagctaggcccgggtggccgtttgaaagttgtggccgggtgccaaccttgaatcaattcaaagactgatacatcgcacatactccggccggacgagacgcactgcctcatccgtgtcgtttgagaatcactcacttagttgtttcaaaaaggagtttaaataaagtcatttgcaaaaacaacagccttacctttgaagcctgcattaaacacttaattcccatggcttgctgagtactcctgtactcacccttgctctatataaataattcccccccagttgctgaagaggatgaagtggatcccgctgacgaggagtttttctaggagcaagtcggctacgatgagttttagggtttcggtctagttcccaagtcgtgcctgtgatgatgggtccaagtcttggcttccgctttcccttttgtaatgcagttgtgagctcgggatctgtccgcagcccaacatgactgtacacctactctgtaataaagagacctctgttgctgtgatattctgtcttcctgggactggtatcgattaacaggttaatttggagcgtcacgggctagttctgttcggggctagttcggggcgtgacacttgtctctcttttaattaatggtttatattgttccacctctcaatacatttaagtactctcaaacaccgtaaaaggtctcatgagaaattgcattgcgcctttacggttgcttgatccaatgatctgaccaccttgtagagaaaggggagatagagaagattaggaagatacgcaaaacgaggtgagttattattgcatgactaatgagtattaattattttaaatttcaaaatgaactaatatgatttttaaagcaacttttctatagaaaatttttacaaaagacacaccgtttagtagtttggaaagcgtgcgtgtggaaaatgatgtgctttctatctctaatctcctaggctgtgtttagatctaaacttccaactttttccatcacatcaacctatcatacacacaacttttcagtcacatcgtaccaatttcaacccaaacttctacctttgaaagtaactaaatacagccctaaacaaacgcatagtggcaaaggaaggccaaagtggttgcaaactggcaatgatgaacggctactgatatactccctcatatttttttttaaatgtgacacaccctaatacttatatgtcgcctccttaaacagtgtattaggctacgtttagttcacattaaaattgaaaatttggttgaaattagaatgatgtgactgaaaagttgaaagtttatgtgtgtagaaaaattttgatgtgatgaaaaaattgaaagtttgaagaaaaaaaatttgtaactaaacactaccttactgaactagtccgtagtaactcaacagtaatgcgtgatgaatcaacttgtgtcatcaatcaagtaaaaacaacaaatcttgggtccagaggctagttaatccccatatccgtttctgggaaccgactgatcctgtgatgttgcacactgtctcacttcatttggctcatgagctcatgctcatctcttcccagtcccaccacatgactcaacaacacattctctgtctctctctcgctttctagttcttggcttcttgcaatgaactgattactacgttttgttctactactaccaccaccaccacatcatctccggagactgcagaaatggctgagcagaacaagaggagctcgtcggcggcggagaacggccacgccggcggcaagaaggcgagggccaacgtcgaggtgaagcaggaggaagaggaggcggaggaaggagagatgagccaagaagaagagagcgcaaagacggggcctctggtggtggccaccgccatggacgacccgcagatcgacgtcaggatcgccgtcggcttgctccactgccatgcctgcctcctccccctcaagcctcccgtcttcaaggtctcactctcactctcacttcatttcaagattcctctcttgatttcatttgtttctttttgtttttcttctcatgtcgtcgaatgtttgatagcttttgttgtaatcttggatttttgtgtttggatcaaatcttcttttgttgtgtggttttgcagtgcgaggcggcgcacgtggtgtgctccggctgccgcggcaaccacggccagctctgccgccgcgccgccgcgtacgcccactgcgccgagctggacgccatcgtcggcgccgccaaggtggcgtgcgcccacgcgccgtacggctgcgacagctacgtcgtgtacggcgcggccgccgagcaccagcgcgcgtgcccgtgcgcgccctgctcctgcccggaccccggctgcggcttccgcggctcgccggcggcgctcctcggccacttcgccaccgaccacccctggtccgtcacgcagatcagctacgcgaagccgtgcaggctcgccgtgccgctgccccggcggtgccacgtcctcgtcggggaggacgaccgcgccatgttcctggtggtgtccccgtccccgtgcggcgtcggcgtcggcgcggcggtgtgcgtggcgtgcgtccgggcgaacggcgacgacgcggcggcggcgcagtacaagtgcaagctgtgggtggaggtgccgaccaacagcgacaacatggtgatgatgacgtccaaggtgaggagcagcgacctctccggcgggttcccggcggcggagcaggggatgttcttggtggtgccgccggagctgcttcacgaggtgtccggcgagacgccgatcctcagcatccgcatcgatcgagctgctcccgccattgccaagcccaccactccacgagccaggtccctgaggagattgcagtgaagcttatgtgaatccaatagagtatatgcttaagatgacagtctggtattagtacttgatcttttgtgtattgactagcactagccaatatatgagtaatggagtatggtttaactcatgacttgtgtaggaattttgtacggtttgactctaatgttgttagtaatttaacttgagatttgtgaaccgatgatgaactgttcatgtatgatgctaccgtttcagaaattggacgccattgctcacatgcatgatttcgactattgcatcacgcagtgctgcaccagaggaggaagagaggtggtccaatgtttatgctccctagttaaaaaaaaaggcaaattttgccacaggacatcgtgactttacggttttagctgtagaacaccgcgcgaagtgacttttgggggaatacactctcaaaatgtggttatttgctggtggacaccgcacccattaaattaataatttccagttgaataggagagagaaattgtgtgaaaaggagagagaaattgtgtgaaagttctaaaatgtccttgggtccatatgtcaggtctttccttctctcttctctctatcccctccttccacactgctattgctagtgcttctccgtcctccatgtcgacgcgaaggagatggctcgtgctgggctaacccacaagcaggaacccggcgagggaggccagctgattggagccgtatgccggcgagggaggaagcgccacacgtcgggcggcgctgtggggtcagggagcggagcagagaagagctgggcgtgggggcggcggcgggggcagtcgtctacggtggcagcggccgtcttctgctgcagctagtgccgcacagccacgccagccgttgctccgccatcgcgccggccccgctcctgcacaagtgcaccaccgtgtcgcgcgccgcccgcatcacgccgcacggttgccgcgagccgcgtcgtccgctactccaccttcgcggtggcccgtcactcctgcacgagggcgccattgcatcgctagccaccctgtgcggcgtcgccgattgctagtatcgcccaatgccctgtgcggagtacccgactgctcgtatcacccaatgcaatgtgccacgtcgcaggcagctcgcatcgcccgccaccatacgccacgtaaccacgccggtcgttgctccgccatcgcaccgaccgccgctcctgcacgagtgcgcccccgcgtcgcgagccgaccgcccacaacgcgccgcacggtcgccgcaagccgagacggccgctactccaccttcgcgctggtcgccactcccagacgagtg

SEQ ID NO: 32347 - DNA, 5747 bp, Oryza sativa
ctccaccttcgcgctggtcgccactcctagacgagtgtgccatcgtgtcacccaccgccctctgtccctgcatcgcgcgccgcacggtcatcgcgaggcgcgccatcgagggagagagaggaagaagataggaagagaaagaggaataaggggcaatttagtcaagtcatataaaaaagtggagccatctcatctagtcagcacagaaatcattaatttaatgggtgcggtgtccaccagcaaataactacattttgagaggttccctaaaaatcacttcgcgcggtgtcctacagttaaaatcgcaaagtcacgatgtcctatggcaaaatttgccaaaaaataaccaacctcctactaatctggatatatatatataatgtctcatatcctcgatattaggttggctagtgctagaaatttggatagttttctaatatctaaatatgttttttataaaaaggtttatttattttaaaatcagataaacttattttgggaaggggggactaccagtccaaagcttgcttcaactttcaagtcgatatctgcaaaagaggcgtatagtcgtatagaggcttcaagcgtggcagaaatgtacgtactacaggcttcaagttgcatcctagtagaaatatcgtgtacaggcttcaatagccaacgctggtgtgcagtaaaattttgttgcagtattactactgtactacctccgtcccaaaatagtacagccataagtttctatgtctaacttgatcgtccgtcttatttaaaaatttttaatacttagatttttgttgttacgagatgatgaaatatgaataatactttactcgtgacttatgtttttaaattttgtttaaataagacgaacgttaaagttgaccgcggaaaaatatagccgcacttattttggaatggagggagtacttgttactctgaacattttacctcactgaaacatacacatgccactactatgcattattgcaaccgccacctcttttcatgtttggatgtaacaattctgctttaatacagtgccaacctactcctacacatatctcttcttgtgaaagatctttttttctcttttgttacaaatggttcggtttatttttttactggaattcagaggtatactgctacagtactactctaaagtaaatgcagtgctgccctgttgacgtggcgtgaacccagaacgtttgaaatactgaagaaagagagtaactttccactctataattattacaacaattttgtactccctctatccccattttaaatacaaccattatttaacatgtccaattttaatcgtccgtcttatttaaaaaaattaaaaatataaatcacgagtaaaatattatttatattttatcatctcataacaataaaaatactaattttaaaattttttaaataagatggacgattaaaattaaacgtaaaaactcatggttacattaaaataggatggacaaatacagttttactacctcacctcccactctactgctactcaacaatgcaccagcaacaaagttcatgccttttcaaagttcataatgtaggagcttgttgaatgaccccccccccccttcccggttcatgccttttggtttattctctctctggtcgtctattgctgcaaactgcaaccaaccaccgattgtttgttcatgctgttgcagttttcagtcaacaaggacgcacacaagagccgatcgccgtagacgacgatgcagcacggcgagcagagcggcgccaagaaggcggcggcgtgggtggtgtcgcccaacggccaagtcaagcgagaaatggcggtggaagcggcgcgcggcgagggagctgctgcagccgccggagccggagaagaagaagaagaagtccaagccggcgggatgatcgccgcggcggtgggcgacggcttcgagggtgtggagatcagcgtgcggatcgacttggccgtgctccactgccccctctgcctcctccccctcaagcccccgacctaccaggtaccagctgttcgtccaattcatcacctattcttcttcttgctgtcgattcgtgaggtgctcggctagtgacgatttcttggcgtgcagtgcgcggcggggcacttggcgtgcagcagctgccatggcgacgtcccgggcaagaagtgccacacgtgcggcggcggcggcggcggcggcgtctacgcgcgatgccccgggctggacacgttcctccgcgccgccaagatcctgtgccccaacgacctgttcggctgccggagctatgtcgcctaccacgacgtcgccgcccaccagcgcgcgtgcccgcacgcgccctgctcctgctcggagccgcgctgcgacttcctcggctcgccgccgatgctcctcgcccacctcgtcgccgaccactcgtggcccgtcagcaaggtcccctacggcgaggtcctcaccatccacgtgccggagtcggagcggcgccacctggtcgtcgcgggggccgccgggggggacgacgagcgcgtgttcgtcctgtccgtgggcgcgctcggcgtggcgagggccgtctcggtggcgtgcgtcagggcgaacgccgcggcggggccgcgctaccgctgcaagctctgggcgcacgccccgggcggcggcgccgcggacttcgtccacatggactcggcggtggcgagcagcgccgccgcgcccggtggcgaggtcgccgtcgacgaggaggccaggttcctgacggtgccgccgtgcttcctccacctgctcgacgccggaacgtccaaggagatgctcatcaggctcagcatcagcattgacattgacattgacatgtcctgatcgatcgacatgaaacatgatggtctactagtaatgtcctaaattcgtgattagtgctctgatgccgttcaagtttaggtgctagtttcaagttctaaccagccataagctttgctatttggaagtttgaactctgatgttctaaattataattttcgtaaggaaaactcgagttaaaaattcgaacttgtactttccttcaacctcgtttttaatcttcaatggatagaagtagatgccaaaaagatcctaattgaagcaaactatctttaccccaaaccaaaaccaaacactgccggcctccgtcccaagaaaaacccaacctttactaggatggaactaggggtgaaaacggtacggaaatttccgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccgtcaaatttccgacaaaattccgaagaaggaagtcggctgggcctggctagcaggaggagcaaaattccgaagaaggaagtcggctgggcttggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacaatgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtattgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctagatggaacgcaacctaatataacaacgaatctagacgtagagtatatctagattcgttgtactaggatgtgtcatgttataaaaccacctccgaaatcgacataggtagctaaacgcgaaaaaacgccatagaacatccaaacatgaagacgataccgaggcacgatatttgataacagagtttagccgaggcctacatcttcggagcactgattacgggcgctactccccgatccagcatattacagcgtatcagagttacaacgactcacggtcggacgccgtcggcaaccgcttcctctcgctatgctaagtcgttatgcggtcacaacagtcacgccccactatttatgagagagactaggatagagtccgactcttactctagttctatacctagtacaactccaagtcctaaattataaccgactttgtacacatatacaaactctaacatgttccaacctagtgtaaggttgggtcttcttgtttttttttttttgaacggaaggagtgcgacgattttcattttttgtgggggctaatggaagcataatatcatgtacccatattacatgaggtaattggaggttttgaattcacctcaagcagattattcaaacagatgtggctgattgttttgtttactgaaaatcagacatgcttgaataatgccaaaaaaaaaaaactccaatcacaaaaaatactcctctcttcacacaagcatatgtgcgcattcaatgggatagatggactttgtgagatgctgctacgtttgattttgattagcagggacttgtccttgggtagatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgcgccccctcgatcggttagggtttatggggtgga

SEQ ID NO: 32348 - DNA, 5798 bp, Oryza sativa
ccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtggattctttatcgcagtataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctgctgccagggtaaacatgtatcccgatgttaactttgtattatcttttgcaaagtcagaatccgaataccccactatctggagcgattctgcttttctgtaagacatcatgaggccttttgttccttgcaaacacgcaagactttctttaccaatttccagtgcactgggcctggattactttgaaatctgccaaataacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacgagtcgcactttaaacttttctatattccctctagagtcatatttggttttgtagacccatttacagcctactgttttggctcatttaggaatttcttctaaatcctagacatcatttaatttcattgatttcatttcatctttcatggcttctcatggcctcttcatatgagatgggatcatcctccatatgcgactctttcaggccttctaggggcctcctattctggcacattatctgtttgaggctgtttcatctcctcctctgatgtggcaataatttctgttgaatcctgtagaacaggttcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcgaattaccgagctccccctaatcatttcgtcttccaagaagacgacgtgtcccgtttctacaaactttgtataactgtttggacagtagaaacgatgaccctttgatcttttagaatagccaataaaatggcagcttactgttttgggttaaatactttatcctttgcaggactcccccacacacggaggatccatagctcatacggtgttttgggcaccgatgcattctatgcattgtatgcattgttctaaaacagagaactccaatggaggaagaactacattcttaaccagtctctcaattctccccctcgaaatatggcataaacaacagtgccataatttcgatgagacatcagaagttcgctttcttttcttttgtcaacgaggacacaacattcacattctcagaaagaaataaagctgatcttgcaacacaagaccaatacattcattattataccatagttcacatttgccatttccaaaatggcaatcatatctatcaaaatccaatttggatacacttattatcaagtttctttgcaaagaaggaacataaaaacgtctggaagtaaaagtgtgaagccattcgcgagttctaggcgaagatctccagcctcaacttttgcttcaactccattggcaactctaatggatctttcacttctttgcatagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttttcttgcaatgtagacactgatcttgtctcaactgtaaactgttgcttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataatacatgtaaaacaattcaaaattctattgtaatttgcatgaaaaatacaaaatacatgttcagaagcatttctcacatttatctattctctaaacaattttcacgttggttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccaggccgcaacctgggcctgggccgggaaagtggctcgccgtgcgctcccacatgggccgatttcggtccggccgccgtcggccgtccgatcgctagggtttcgatcggacggtcgcgcgggcggatcgggcaaacaaaaccgcccccggccgccggcgccgaaaccctagctcctcttctcttctttctcttgcggttgcacggagcggcgtcgccgtcgccgaaaccctagcacagcgccggcggcggcatggcgacacggcggcgccgtcgcactccccttcgccgatgcgcgcactcactcaagggtgagtgcgccgccgtcgagcggttgtgccgcggcgccctctcctttctcttgcgggcgtgcgccgtgccgagcggcgtcgccgacgccggcagccttcgcgccgccgcgccatggccgacgccctcgcgccgccacgccctctattcttttctcttctcccccccaccgtctcacccctccacgcgagtgaagagtgagagaccggcgacgacggagatggtggcgccgccgcgggccccctcgccggcgcgcgcgtgcacccgcgggtgcgcacgcggctgtcgagtggctcctcggcggtgcctctttgcccctctccccctccgtggccggcgtcaacgacggccggcgacgaggtaagattagggttagggtttcgatcttttcgatccgttggatcgtttgcttttctttgcctttcttttggatttctttccccaaccaatctaaactctagggtggctttgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggccggtcccgtcccgtcactggctgcgccccctcgatcggttagggtttatggggtggagtggcggcggcggcgacgaacctcgttccttgtgtcgttatgccgtcccgtcttccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcgtcacggttaattacc

SEQ ID NO: 32349 - DNA, 12950 bp, Oryza sativa
gcaaagaaagcggaagccttctcgatgcagaacgatgatcgccgcggcggcggtgaccggccggccggggaatacaagaagcaggcgcgatggttgtggcaccggagccggaggccatcgccgtgaggatcgacatggccatgcttcactgccccatctgctttctccccttgaagcctccaatcttccaggttccttgcttgttgctgcaatgtctgatgcttcatccatttcttgtttcatggttgcattcatatgaatcgtttctttctttgtccatcgatttatgcagtgcgatgctgggcacatggcttgcagcaactgccgcggcaaggtcgccggcggccggtgccactcgtgcgaaggcgtcggcgtcggcgtcgtctacgcccgctctcgcgccatggaggccttcgtctcgtcgaccaagatccagtgcccctaccaggcgcacggctgccggagctacgtcacctactacgccgtcgacgaccaccagcgcgcgtgcccgcacgcgccgtgctcatgcccggagcccggctgcggcttcgccggctctcctggaacacctcgccgcggcgcattcctgccacgtggacaaggtcgagtacggcaaggccctgtgtctccgcgtgccggcgtctgagcggcggcggcgcctgctcgtcggggaggaggacaagcgcgtgttcctcctcgccatggccgcggtcggcgcggccagcgcggtgacgttggtgcgcgtcgcggcgagcgcggagacggcggcgcggtacaggtgcaagatgtgggcgaacgcgccggcggcggcggcggcggcggtggcgggcgcggcgagcggcaaggcggacatggtcatggtggacatggaggtggcgagcagcggcgtggcgcccggcggcgtcgccgtggaggaggcgacgttcttggccgtgccacccaagatgctgcacggggagcacaaggagatcattcttggcatttgcattgacaagaagacctcctgagtccggatcaacctgacacttggccattagcagtagcaaactagcaataatgccaaattttagtttagtactaatgatagtaggttatgataagaactattccctagggttttaacaacagtaatgtggagtacatggatgaaaacaatctcggaaatgagtactgctacacgtacaacccaattgtacaactcgtgtataaccgtataactagagacatgtagccatatatcaatcaaaacatatactttctccgtcacttaaaaaacaatctagtactggatgtgacatatcataatacaacgaatctggatgtcaatcatagatttgattttttgggacagcaggagtatgttcatatgcattgcagctgtttataaccgtttatcaaattcaaacgtacgtgagtctgataattggatcaaatgcatagaaattacttacggactgactcgcctttctgaagttgcatcgaccgaaccatccggtataggtaatttgttgaaaacagtagaattacttcttttgatgtgtttcccttgaatagttccgtttctgattttccattattatcgatgtcattttcatttctagctctaccgtttcaaatattactttacttaaacactgtgggaatgctgaagatttagcgcgccacatcatcggttcttttggaaaaaaaaaaaccccacaattcctattaattgtgtctcggttcctgccgctatcatccgttcgatcacacgctagggacgatctaaccgtccacgtgtcccatcgtggctgctcatctaccatcgtgagatcgttggatcaggaacggacggccatcgattgttacgtgccggagattaaatcgacatctactttagagtcgaactctaccgtttaaaaaactatttgttgcccacgagagaggaatggaccatgtagatatcattagaagctcacgcaagggaggatgaacggtagtgattgaatagatatttatttatgtgggtcccaccgatcgactttaccactacaactatcgaatctttgattcgttcgtctcccgtggcaggcatgagtcgaacgacgctgtggatgcccttagagcaagtttaatagaataactaactactagctccaatttatttatagccaatctaaccgttcattcatacaatagttacatactacactattaatacatggtcccacctgtcatacacacactgcgtcttggagtccgtgctacagctggctataaatctgtagcccgctgctcttctctctccttatttatctccttaaaatatgtttgtagctcgcttacagcctgctattgtacttgctcttagcaaacctctaccctctagccctgccgggattaatggcggatcggggactcactggaggtggtggagcgggagcttcttcttgcacgactccaggatgtcccacaggttcttcacccctatctcccgcccgcacttccgcccgaccggacctcaccggacttggaggagatgacggacctcagtggcggcagcggcaactccggcttgtacaacagcctcgaaccccagcaaaagcccggcgccggcaagccgacatcctcgaaccagccctcgcccgcacgccgccgtcgccactccagcccccggctgccgccgccaccgatgcttccgaagggggaagagaaaagggagagagaaaagagagagaagggagagggagggagggagggggaagaagtgaaggagaaaggatgacatgtgggccccacatgtcggtgggtcccacaatatattttgtgtgtgaatgacagatgggtccacataattttttttaattctaatgccacataagcgttatgtggaatgaaaaccgggttagcaccgccacgtcagcgtcacgtctgcaaaaccgtcctccaaaaccgctggaggagtcaaattgggtagtttcaataattcggggagtcgtcctatctggttttcccgtcaagggttacgatttagattcggtgaacaattaagggagtctaagtagactttttccttgctctgagaggcaacagggagggttaatgggctgaggcccaattcgcgttttctgctaatatatatatatatatatatatatattcatcggtcctggtggaggctttaggtttttgccccttctcttcctctctgcggcggcgcctagatccatccaccaccaatgccaaccaggggaggacgcggtggcaggggaggacgcggcgggaggggaggccagccgggtgagctcggccaaccgggagagccgggccagggcggcgggaggggaggacgcggcgggaggggaggccagccgggcgagctcggccaaccgggcgagccgggccagggcggcggcaggggaggacacggtgggacgggaggacagccgggcgagcccggccaaccgggccagggcggcggccccggcggccgcggcggatccgcgttcggccctcacggcggcgacggcggcactggcggcaccggcggctttctcggcattggaggccgcggcggtcgcggcggcgacggcggcctaggaggcaacggaggccgcggcggcgacggaggtcaaggtggacctggccaacggggcggggacggcgggcggggcggggacggcggggacggcgggccgagcggttccccgttgcgaagagcgccctcgtcgcgtaaacggcgtggtgggccgagcggagcctatctgcataggcaggaggaggagcagcttgatcagatatgagcgaagatctatcttatctttatctgttggtacttggtgttgacacgtaaaattgattcacgcaacaacaatgataaccgtcgtgctttcgtgacgacgaacgactagttttcaagcaaagtagcaaagatcttcactttcgtggaagaacccgactgattttcagcgcaaaccagtaaagatcaaccgcaccctagataaccaggatttggccaaagaaacaagagcaaaagtacgatgaaaacggtagaagaaaataatatatgatgataattgttttcgagccctaccaagtgcaaaatccatagtatatagtaaaggaatacgctgtactgcatatatagaaaactctaggtaaatccgtgattaattctatgtaatgaaaaccgtccttttttaacgacagcttccatgtagacgtatacaagcctcagccgaaagtcgcctccatcctgcaacgctgctccagcccaactttcagaatttgtctccccttgctctggcaacaatgtgatcctgtgtggctagacttcaacaggcatatcatcaaacatagccatgcatccaaccccagccacataaaatcaaccagtgaagcctcacatccattgaatcggcaaaagctccatcgctgcatgctaagctgcttgaactgacaaaatctgagaattgcagcctcccaagtcccaaccttcttctctagtttctgcagctccccagcaactcgtacacctcccggtgcatcacaaattcctgccctagtcaagctaaccaattcttaagcaaaccactaaaacaattacaccaactattctatataatttggcctgtctaaaatgacctaaccaaaagccaaattatgctactaacacttgggtgtgatctagtcgctgtagtagaactgtctgttgcagtccatctatctatctttgaatatagctagtagaagagtcgatgtcgctgtagtgttttatgtggtcaagagttttatgccatggtttacttttctgaaagcatcatcttgaaattaagtagaaattatgttggacgaacacatctgatctgacaaacaagttcaggggtttaacttggtgatcgcttgcgcctaagctgctactgctgcgcgcgcgcgcgcaaattaaagtgagatggccagccctaggctggctgatggtgaccccggaacaagatcgtcggacaaaaatgaggtcgcagcagaggatggtcgccgccacagattggtgcatgcgagaccattaggcatcacaattcacagaaataatcacattcacagtcatttcgatacaaaactgaatcacaaaaattctcgcaatcacattcatctggccaaagaacaaaatcacttcacattcacaatcatttgggcacaaaacaaaatcacaaaaatcatcacaatcatattcatctaggcacaaaatagaaaggataactccatctggcggcggtgcggtggcggaggaggcggccggcggtcagtagggaggcgtggacggatccgacggtgcggtggcggaggaggaagcggccgacggtcgggggagaggccgcgatggccggatccatggcccccaaacttgtcgaggctggatccggcggttgacagtgcggtggaggaggaggaagcggccgacggtcgggcgagaggccgcggtggccggatccgcgcccccaaacttgtcgaggccggatccggtggctggcggtgcagtggcggaggaggaaacggccggcgatcgggaaggaggtcgcggtggccggatccgcggttagcggtgtagtggcggaggaggaagcggccgacggacgggggagaggccgcggtggccggatccgcgccttgtaggccagatccagtggccggcggtcgggaggtggggaggcggcggcggcggcggccgacggtcgggaggcgaggaggcgtcagcgaccagctctcgagggggggccacggcccgatctatgagggagagagtgaggagggagagaaggaagatgagtgggagggagtgagtaaaggagagaaagaagatgagaagggaagatgaggagggaaggggaatccaaggggaggagtagggtcgcaggggtggggtggggcattttttttgtaagccatctctgacggctataatttttttaactcgtttgagatgagatatcaaatctttgacgggttgcaaatttaacacccctcacaggtgaggtcaaactagtaatgggctggagagcaaccccgtcactacctcacctgcgacggcttaaaattctggcccatcacatgtaaggtgatacatgtgacgggccacggccggatgcctcaccgatgacggcaaacctaacgacccgtcaaagatgacggtcatctgtgaccaatccttaggcccgtcattggtgtgccgtcacagatgtagggttctggcgtagtgacttaaatagctaggtagacctatattgtacccatcgaattgatagggattagctgcattgtaatctctactcgccgaaataatacaagaagcagcacctggacgtacgtaaactcgactacgaggttccgaaccagtataaactccgtgtcagctgtgattgctcttcgcaccaagcacggttcacaacgatccaaatattacgtgtctactgtgattactcttcgcaccaagcagagtgcacaacgattcaaatatctgccggtctaaaacagcgacagaaccatgtcaggtaggggatctaacagcgacagtaaaacagcgacagaagcgcgtcaggtggatccaggcgacgacgtcatcgtcacagtcggtggtgggacccaagtggcggcggtgtcgtcgtcgcggccggcggcagagggagagtagagcagagggagaggagagggaggggagccgcacctcccctccgcgcgcgccgctgcctcacctcctcgtcgtcgcgaccagcgacagagggagaggagagggaggggagccgcacctcccctccgccccacctcctcatcatagcagcctctcctccccgagaccggccggcggcggcgtcgtcgtcgtcttgcggtagtcgtcgtcgtcgtgaccggcggcggaggagagtagagccgagggagaggagagggaggggagccgcacctctcctttggccgcgcctccgccgcacctctcctttggccgctgcccctcccctccaccggatctaggaggggaaggaaggaagggaaggggagcgagctggagggatatgagagagtcgacgaaatgggaatggggcccgtcaaaacaattaaccaagcaccaaagcacttccgaagagggaactaatcggaggtcgtggttgcaggccccggtcttgggagcccgggaccgcctcaaggttgctcgggggctgccttgcccccccccgccccccccccccaaagtttgcatcctggggagttgagaaaagtgttaggttcggacctagagtcccgaactaactcgggcccgggcacatccgggagcaccaacaaggacgtcttctcgacaagttatgtggtgaaggcagccgtggtctcggcatgtccgggacccaggccggcttcgcccctagtatgaatcgctcctcttgccccgaaggaagagcatggaagcttactagggaagtaacacggagatatctgtccggttgtacctttctcgtaaggtacggtagaaatatcctaactatcgccttaaagaatgtcaggggtgtgaccttaagtcccgacgggaggtgtgatgtcttacggccagccgaaagtcagatggcagagacaagaaatcgacgtgacggtatcaagggtagttaggtaatattgtgagctcctccttacactataaaaggaggggactagcaactatttagagaggccgctttggagatagcttcccatattggcacacatagcttgtagctcctttcttaggctagcggatccatcttgtactccgccggccggccttccctccggttgtcagcctaggggagttagtgaaagccaaaacacaggagtagggtattacacctccgggtggcctgaacatgtataaacctcctcgcctcccactgcgtggccagctcgggccccgcgcactcacgccctcgtcctccaccatgccttgcgacaccctccacgccgcctcgacacggcatccgtccaggcgccgactaacccctggccaaatctccattctcacagggaggggtctccactccccgctgtccgtgggatcgtccccacgacacaccaccctgaaaatcagtcaaaggcttgattgtctagatattgtgtttcttttcatacttagtgctggattagtacattcaacctactaagtcttgattagaaccacaatctctagcctacttcttagttgccaataagggtttcatcagggtttcagccgatgaggtatctaaatgttgtatcggcatacaaggatagcatatatgttgaatttagccgatgacaataaaggtttcactatttatctaatattgtagattttatgacatcaaatctccagccgatgtatgctttaaccttcggatctatcatatcattattggatgattagtttctattgaattatattattgtttcattatattattgttactgtgaaagcacggtggcctgggagatctgcttaactccagtactggtccaaggcttgcctcaaagtgctaagggggtgccagctggtttgatcccgcaaccagtaaagaaacaaaagacaggattagttagccgatagccaatcggctgataggccgatagcgcatcattgatggtcccagccgatgggataagaccgaatacgacggcctgggagatctgcttaactgcagtgcaggtacagggcttgcctcgaagtgctaagggcgtgccagctggtttgaccctgcaaccagcaaggaaacaaaagataggattagtcaaccgatagccaataggccgataggctgatagcgtattgttgatggtcccagctaatggggtaagaccgaaccggctatagtcttgataaatcaaagaatataaaaccctaaatatgccctatcggctgtaatactgtccataaaggttaataaaagattttaagacaatattgagaaaatagccaatataacaatatttccggtataacaatatttagagcaataaggataacgtactagctaatactccagtacaaatctatataagcatatcaatctatagcaatatattaagtaaagttcagtagtcaatattgatagcacagccaatttgacctagacttgatatgatgctattaggtgatctgtctatatagatggtgaatatacatgaaacagataaagaaacatgcatattagataggatcggctgaaataccgatactacccctattatcagtcaaaaacaggctagagctcatgattctatgcacgacttagcagatctaatgtactgatgcagcactaagtatgtgtcgtgggggcgattccatggtcagtggggagtggagaccccttcccgtgagaatggagattcggccaaggggtttgtcggcgcccggacggtggtcgtgccaaggcggcatggagtgtgtcgcgaggggtggcagaggacaagggcgcgagtgtgcgcagggctcgagctagccccgtggcgggaggcgaggagatttatataggttcaggccacccggaggtataataacctactcctgtgttttggctttctgtcacgccccgaaccagttccggccggaactagcccgtgacgctccaaattaacctgttaatcgataccagtcccaggaaacagtgctggtatcacagggagacagaatatcatagcaacagaggtctctttaatatagagtaggagtacagtcatgttgggctgcggacagaacccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatctgcttcatcttcttcagcaactgggggggatatttatatagagcaagggtgagtacgggagtactcagcaagccaggggaaaataagtgtttaatgcaggcttcaaggaatggctgttgtttttgcaattgattttatttgaactcttttctaaaagcaactaagtgagtgcttctcaaacgacacggatgaggcagtgtgtctcgtccggtcggagtatgtgcaatgtatcagtctttagatttgaacaagattggcacccggccaaaggccttttaaacggccacccgggccaacacctttcaaacggccacccgggccaacaacttttcaaacggccacccgggccaacaactttttaaacggccacccgggcctagctgatcccgtcagctgcggattcttttcaaacatcgaacccgatttcataacagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgatgcaggtttgccatatgccgacgagaggggtcccagaccaacaacaggttaggtcccagaccatactgtgctaggaaacccaggggtcctccccgacaccaccccggcgaatccacatgtctctcggcatcaaggctcccctgataagctagttactcagccaggggtgtcccattccacccatgtggtcgtactggtcttatgttgggatgaaattccaagggatcggtccttacgtgcaagagcgggaaaccgtacacccgatacgtttcccggtccgcagttttggaaattcatttagttcgcaagcaccgacccaggcgtcgggttttccaagtcttttgtaaagctccagttttacccaagttgtactcagattttaagtttgaaggctaccgtcgatactcgtacagagtgcacgaatatcgcggtacaactgggtggttacaagggacatggtataacaattaacagagggaggatcaaatgcaatcaattaggtaggtccaccaatctgccttgcagatggggcaaaagattaagtgtgatcctatcaatgcataatattttgcaagcaacataattaaatttcaaatataggctcaagttgttcaaaggtggcttgccttgctcgagatctggagcttgatcctcgaaatcctcgcactgcgggtcttcgggctccgaaactacacgcgaaacgggacaactcaacaaacggcgagaataaagccctattaatgacccctaagcatgccattagatagatctcgagatttgggaaattttggaagttgaacggagtcaaacggagttttggttggaaagatattgaatttctaagattattggatttttggtctaaaggaaaaaggatttaattaaatcctttttggaaaaaggaaaaggaaatgatgaagggagggaatctagactttcctcgggcggctagggcgcggcccaaaggtattcggctcggtccggccgagctaaacgggccggacggcccaaagcggcccatttacgcgcgcgcgcgggagaggagagagagagccggtggaccgggctcacctcgcgcggccccgggtgggacccgcttgtcagcggctcggcccaccgtgcggagggagcacgcggcgcacgcgcgcgggcgaaagggggaaagcggtgcacgcgcggtttacggaggactcgggtgcggcgggcccacgcgcagcctcacggcttgcggtgggatgcgcgcacggggagggatcggccggggtcggcccgtcccgagctcagccgagctggcgccgacgtggcgcctacgtggcggccacgtgggctggcaggaggtagacgacgaccggccgcaaatgaacggcgggcgacggcggcgagcggtagagcgggccacggcgataccggcgaaggcgagcacgccgggcagtagtacgggacgagaggagacgagccaacggctcggattcgccggaggttgcttggcggcggcggattgcggcggccgcaaccggcggcgggagaagagggaaacggcgacgaggccacgagaggtcgatttccggcggtgagagcatctacaaggccacgggaactcgatgctagggttggattggacggagctatgccgagctgggctggcgacgtgcggctacttcggagctcgggcggcgacggcgacgagcacatggcgagcaacggcatcggtcggggcggcgccggccaactacgggaggtctactcgagctaaatccgaagtctaagggggggagacggagcgaggagggagaacgaagcgaaacatcaccgcgggaaggagaggcgctgtgacgagaggccgacggcgcgggagtgatctctccggcctcgggccggggaagaggaagaagaggcgcggccggagtcctcttcggcgtcctcgctcgtgccggctcctccgacacgcgcggcgacgattggagacggcgaaaatagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaagcggtggcagacgggatgacgccggcgggagaggaaaaaggaggaaggggaaaaggaggaggagaaaggaattctctcctttgccgattcgggaaaaggagggtgggcgcggggcgacgacgcggcagagggaggtgaggcgcggcctccgggccttggcggctagcgcgcggagtggcgggggccggcgatgacgacggcgggcggtttggagcggagcggcgacagcggcgactggcgcgggcagagctgacggcggcggcgaccgggcggtcggccactcggcttgcgcgggcgcgaggcaacgggcgacggcgcgcggggggg

SEQ ID NO: 32350 - DNA, 2840 bp, Oryza sativa
  unsure (1)..(2840): unsure at all n locations
gggccggggggggagagatgggccgggggggcaaggtagactttgcggaggaattgattcggaagatctggattcggaatttgaactcgacgatagatcggggattgagatcttgagatggcacggacactagacaacaatcaaaggaacaaaatttcgcaattagggtttttgagagataattttcccgctaggcgccacgacggaacgggcgctacactttcactaactaccctaggccgacgaccgtagggaaggccggccgacggagtataaggtgaattggctagcctaagggaagaattagaagcaatgtatggcaatgtccccggccttccaaaaagaccgaccccttaaatagttgctagtcccccccttatagtgtaaggtggggctcacaatattacctaactacccttgaaaccttcacgtcaattgtcttatctctgccgtctgactttttggctgtgatcctcaagaaacccttcaagtcttgcagttcacacagccccgagctccaaagtcctgtcagaggtagttgggcttccaccagctcgcacaccacgtggtgcgaggtgggcctagtagggcctaggctaccttcggcgggacacggctcttccctaccggctaggccgagggaaggcgtccgtgggcatgtgtgacacgtgtcgggggtgccatcgaccctaacgatttgccacccaagtcttgtcgaagtctctccgttgtcagcgggagaaatcttctataagcttggtttcatgatgagagggggtgcattgccttacaactggcccttagacttcacacctcccgtcaggacttaaggtcacacccctgacatcctttaaagcggtagttaggatatttctagtgtaccttacagaggaaggtacaaccggacagatatctccgtgttacttccctagtaaacttccatgctcttccttcagggagaaggaggagcgattcctactgggatcgaaggcagcccgggccccgggcgtgccgacaccgcggctgccttcaccacgtaacttggcgagaagacgttcttgttatggaggcagaagacggaaaccgagacacacacacacacacacagagccgctggcttgcctggacagactcagcgatggtcataatacaagaactaatacatctaaaacgacataatagccccgatagcacgagccatcgagacgggttacctctgtggagataactcgccgaaaacaagtaaaagaaaagggtggcgatgcgccaaagttgtattggatttgctttaatacaattgcctttattgagcttcggcgcgccgaagttatattagatacaattgcctttattgagcttcatctttagtccaatctagacccataccgagcccaagctatgccatatcagctgtatcggccatcagtcccctcagcttgatcaatcttcagcccttgtttcctaccgatacggtctccagccgatacacagtccgattctgagttcaactaaatccaacaccaaatccgcttcgatctattccttcttactcgaatctgatgccaaattccattattaacaattatcatcagccgattgcctttatttacattaagtatcagattctacatcaaacatatggctgattgctcaaaaccttatcgacatcagttggtatcgctctatcggcttatcagccgattggctcattgatctgctatttgtatatcttgtcggttgcaagatcaaactgactggcacgtccgcatctcgtcaacctttggacctgcactggagctaagcagatctcctaggccattgtgttcgtcgacttagttcacgccaacacagttccggctcgaccgagcacggatttctcgtcaacacccgagtacaaacttagtctattatggacatgactcaaacatttctaaagataagatacaaacaagaccataacggcgctctcttgccaaaactaacacaaaccgacataactaacttaattaatagatacatttgtcttaattgagctctatctctaattggcaatgacggtttgttgatgtgaaaaacacacgctggcctgagagatctgcttaactctagtgcaggaccttgctcttgggtttaagggcatgccagttggtttgatcctgcaaccaacaagaaacaaacaaagaaacatagttaaatccataaacgatagtcgatcggccacatgccgatgacgtatcgtttgtaagctagccgatgtaacgtgaattagatcggcaatgatatataaagcaaaaagaaagttaaatctagtcgatcgactgtagatattaacagtatataatctataaatcgaaatatgtttaaaccaagtgattcggatagatcggaccagcttgccgagacagtataaatcacttatgtctaaaagtactttaatataaagattatatatgttcatagcatagccgatgttgtagatttaacgcgtatcggctactactccgatactactttatactaagatatcaatatagactgaatatattaaataggaattaatcaagtgttaaagtaaattaacatattactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32351 - DNA, 9619 bp, Oryza sativa
acaaaatggttggagctcagggcttggccacccctaaacctcatcattagtgcatggtacaacatgctttcctcgccatgaaactgccagtgttatatcctttgttttttccccggttctccatgatatatccatccgggtgggagatatacttcatactagtagtacggagtatgtacacgtattcgtcgtacagttcttttgcttttcttgtgcacagcatcgcatcgtgattcgcttgcgagctgctcatgtgaatttctttccgctttgttcgaggagaggacggacgaaatgtgtaatcgtgaaagaaaatcttctttccgcaaaagtaacattttcatatgtagtaggagtagtccagtgcagactgcagagcaattgtgagcacatttcttcttgtttttttggttgtgagctcgcacgatagagtgcaatgtattggaggagtagcagcaaagcaaaagcgagtggcagaagggagggatatatactcctacactgcgtgcactgatgctgctactgttgcacgcgtaggctatagcttagctgaggtcgtaggccgcaatttgaggcagtttgagcaaagtgtatcgtggcatgcagaaaccgaccgatccatggctttggcttttgacgaagggggtgtacggatggaacacgggaaggaaaaggctttggctcaccatcaaacacgcacgcgccgcgccgccactgtacccagcattcactccacagaaacgcatgctatgaacagtaccagactgtgtgactgtacgcctgtacgtatcaacatggagcaccataccccccacgttatacgttccgcatttgcagcttgagaggtgagaggacaactcgcattgtgtgcttctaaaaatccgctcggtacatccggcaacatactagtaggagcactgtattttggagcggtgtattactgtgctctcggaacttcttttttttaaggtaaggttggggatagcctgtgttgtttggtactagtactagtagctattttgctcgaatatcagaaaaaagggagagaaatactctgggttttatcttggtgtcactggtcaagaccagggtttacgattctgacgaaatccggtcggatttcgcgaaatttcgacattccgacgagggtcgaaagtagaaactgtctgagattttgaggagtttcatccaaattcaaatttgaattgataaaaaagaaaaaaaaaataaaatctttaaatactatgatattcatagaatctattgggatataaatattcggaaaaaaataatgtattgtgtgtatttactaaaacttacacaggaaagaaaagaataaaaaattaaaaaaggaaaacacctatagggccagttaatagttgatccaaattacagattactgatcaaaatttcgatgattttgattggaatttcaccaaaaccgaccagttttcgagaacttgtcagcaaacttagataatttgtattcaaattttggtttatgaaatttattcggaatttaccggttttccaccgaatttcatgaaattccgaattctgccgttacccgaaacgaaagggtctgtcaaaatcataaaccctggtcaagacacaagcaaaacattttgttgattatcgatcggttggattggtttgaaccggcacagcacagtacatttctgccgatgtgagaggcagaagtgttgtggttgggtggtgtggcacgcagcggcaattcgcatgcgaatagcgaggcgtggtggtgaaaaggcctgcgcggttgtaccatgattacaagggggagctcgtacctctcgtagctgctgcttttgattccctctgacggtgacgtcatgtgacacgtcctgtctcccgagtggcgtggcgtgggccccgcccaccgcaacattcccgggattctgtctcccgctgctcccgccaacccggccccaccctctcatcacacacagttgcagtcaccgttctcttcgtcgtcgtcgtctcgcaggctgagacacggcacgacagtctcatgcccgaccgaaaatcctcgcatcccgacggcgacggcgagccgttggatccaccatccgacggccacaaacgactgcagccgaaacagtgcccggccgtacgcacatcggagtactacagtatacagagaaaagtacgtgtactgtacacttggactggtacgaaaaaaagtttcacgcctgcactgcatagctggacctgttcgcctgtggttgtgtgtggttgccgatgcatgcaaaaatacaacgcccaaatgcattcggtgcagtcgttgtggcgtgtggtcaagcttgcttggaaaacctgtctctctgtactgctcggtcaagcaggctccgtacgtacgtacatgctccagccagtacatgaggctgtactcctacatggaaggcgtcttcttttggcacatctatcgttgatcgatcggtcgaatccgtcgttcgacgccatggtgatgcacaagacgacgacgcgtgtgtgtgtttttgtgttgttatgtgatgtgatgggcctcgctgagactgagtgcgtctgtgtagtactacgtgtgtgcatgtgtggagcgagagctcgagcttcctgcccgagacgacgagatatggatcggaatcggattccatgcgccgcgcggcgagcgatccatccatcgacgcgacccaagaccgaagcgtgtgtgcgggtgtgtagccgcgtcctggttttttcggctacgtcttgtatgacatctgctctgctcagcctcagctgaatcagtactagctcagcacaagattcctgctgcctttgtcacaccctaaaaatcctaaatatataaattgttgtttaattgaaattattagaatttattttaaaagcctagaagagaagatctaattttaattaataaattccaatataaaatagggccagataaaatttcattaaatactttgcttaactctataattcctagatttttctgggatttatttgagctaaggaagtatttttaataaatagaattacatttaatgaataatttaaattgaaaaagatttttaaaatcctcttttggcttcggcccaaaaccttctctctccctctccccggcccaagccggcccagtccgcccgcagccgcccgcccgcgcgcgctcggccgctgacaggtgggtcccacctgtcggactcgtcgtcctcatcgcgccgtcgcccggccggaaccctagccgcgccgccgccgctattccaaatccagccgtccctttccgtttccggtgaaatcaattgaggggaaaggatccccatgatccactctacgttttcccttttggaaacatcgtctaaatcgctttggaaattcgcggattcgatctcgaatcggattcgtctctctctcccgaaccctaatctttccatcgcgtcgccggtcgccgtgggccttcgccgccgcgccctagtccctatttaagcacccccaggtcctccgctactcgtcgccaccctcgccttcgtctctcgtcaccggtagaaccctagcaccgtgtagcctcgcgccgccgtcgtcgccgccgctccagccgtgtgtcgccgtcgctccagtcgtcgccgtagctcggggaggtcaccgtcgtggtcgccgtctcgtcgccgtcctcgtccgccccttcgccgtcgttgtcaaccgccggagcaccgtcgccgccgtcgacctgatcgtctccgccgccttttcctcatcgccggcgccgtccgttgcccctccgccgctactttggtcaccggtgagttcgccgtgccgtccgctaccagtaggtgccctccgttcgcgatgtcgtgccgtcgttcgccggcgagcatgcacgcccgagccgccgccggtggtgacgtcaccaccgacgtcatcgtcgtcgttccccgtggcccggtcgtggaccgatggatcttggccgtccgttgtggataggatcgatctcggccgttcgtttccgtgagctgccgccgtgcacccgattcaccgcgaaccctagccgctgacgcaataattcccttttccttttcaaaaataattcattattgcgtcataattcaattaaaatctaaataaatgatttaatccgatttaatctttgaaaattcataactaattcatcttagctcggatttagttggttcaagtctctaattttttctaaaatagagatctacatgttaaaaatatccacattactgttcatgcttgtttatgtacttttttggtgtttttgctcttttctgtttagatcccgacgtttccggagagtttgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattgacctattgtttgttatagcccttttgttcttgattactttattccttgataccttgggttattataacttgactagttgggctatatatattggttcagctagatattagatatgattgcttagccatgcttagaaacattagcacactattgggttgacttatgactcactattatttaacaatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcctacgggggtcgctggggagtccatgccttgtttataagggggtgattatgatctaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcggttatgggcgggtctaacaatgtctttcgtgattagtttcacacttctcaccataataaaagatgctataactggtaataatttgtttagctcttggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgacccctatattatgccattctttggtatccttgtgcacttgcatatttgctgcgtggcttgctgagtatgtcatatactcaccttgcaatcattcatcagagaaagagttctacagcgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttattattgtgtgcctcggctgattcctggacgagggttcacacacatgtaagcgtttggaattttggatagaaattccgggcgtgacaagttagtatcagagccccttgaccctaggttatgccaaatggttacccatagaagccctctaaaaatattggaaaagtagaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggccgacactgagtatcgctaccatcctcgccaaccccagggaagtgaccgtggcggctaccttgagactgaggagattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttggaaaaggaactagccgcgttgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaaaaattgaagcgcacccattcaaaggtcgagtggggagctactcaagatgatggagacgagccgaacgagccttcaatcaactccgatgcccggaagacctagagtgccttgtcaagccgttgtcttagattgttgtgttagtttgtttgtttaagtttggttgtgtgtgtctcgcatgtgatttacatcagtggtgggatgtaagtgcatgcgtttgtttgcttttgagtgttaggaagttggtgagtttggtggtgtgagagtctttagttttgtagtaatgaaactcagttaagatcaataaaagttaagttagtagaaaaattaattctctgtcctaagtagttttccccggtttctcttcttgtgatcctacccatgccagatggtgctcactcgcagcaacgggaatggccccaacatcaacaataacaacaacaacaacaatggagagaatcccacacttgcccaagtcctggctcaacaggcacagctgatgaacatgatgatgcagcaactccagaaccagcagaaccagggaaataaccatgcacctccccagaacaagttagcagaatttcttcgtgtgaggccgcccactttctctagcaccactaatcctgttgaagctggtgattggctgcatgccatagagaagaagttggatttgcttcagtgcattgatcaggagaaggtctcatttgcatcacaccagctgcatggccctgcctctgagtggtgggatcacttccgccttaacagaactactgctgaacctatcacttggcttgaattcaccgctgcgttccggaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagcatcagttcttcaacaacaatgctggcaacaacatccgcaatcaagctccacgccctgttgcagctccaacacagcaacagcctgccaagagggagcaaggcagcaagcccggggtgtgcttcaactgtggagacccaggacattactctgacaagtgtccgaagccccgacgcgtgaaggttgtccctgcccagaacaactctaccgcaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatctatgagttttgcgggaaatcatgggatggaagtagaagatcttagacgtcctttgatggttagtaccccaagtaataattgtactctattatcaatttgttattgtgtgcctcggctgattcctggacgagggttcacacacatgtaagcgtttggaattttggatagaaattccgggcgtgacatgcctcgtaagcgttaccattgaatcgagattgttttcagccaccaggaggagcaactctaagagtaaggccattcatagtggacttatatgacattcagcctccaataaaaaatgaatattccttgccacatccttaaactgtgtagctttattaggttcgcgtagccaactttagctactcgttcctcgtctcaaggcgggacccacactagggcttgaggagagagaggggagaggggcgaggtagccgacggctcggaagaggaggggagagcgggggaggagaagaggaggctagtgccgccgtcatagtcatcactcgcgctcgacggggcggcgtcagcggcctgcagggagagacaaagattgggagaaaggaggaaggaaccatcgtcgtcgccaccgttcgaggatggatctagcgagctcaatgccgccctagtctaaagaggtggatatggcgagctcggcagtgccactatcgtcatccaccagagaggagagaaagacccagcaccgtctcctccaccgtagcgaccgaggtcaattcgtcctcgctcccgtgctgagtccacgccgtggacctcattgacccccgccgccagattcgcgccaccaacctcgcgcttccccggctcctgtgccgattccctccgtcgctcttgccgcgccgtcctctcgactgctgctgaagcatctagacccccggtgttaattttggtaattaatgacaagcactaattgtggactaaccgttgtctttgagctatacattttaagttaggtccacgtcatatgtgcgcatggatgattatcgatggattaaaattgacagcgcaaaggcaagggaaagaagacggtaaaactagcgctttaattaagaattgatcga

SEQ ID NO: 32352 - DNA, 58014 bp, Oryza sativa
  unsure (1)..(58014): unsure at all n locations
agagtcaagtgcatttgcttccattgtagagtgagtggggcacttggatcatctccaccccgggtcattttttgttaccttggaggttgccgcctcctagacggcttgtggaggagttgcccggtgacctctccgaaaagattatggaggaggcccgcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttccgaacctcggtgaaaaatctcttgtctcattgtctcatttgattgtcacatttacatttgtgcaatttacatttctagaaacacacttgagatcatatcaccctaggattgcaaaacattgacatatgagcgtgatttactttcctagagatataattgagccactatcaccctaggtttgcaaaacattacttagttgcttagttagagttcatcctcaccaagcctagcaacttaggttagatttgattaggtgttatttagttttaaatcgcttattctcccccctctagtcgatatctcgatcctacaagtggtatcagagcttggtctctcttgattgggcttcaccgcctagagagaagatgtcgaacgagttgaaccatgtagggaaggctcccatgtttaatggcacaaactactccacttggaaaattaaaatgtctactcacctcaaagctatgagcttccaggagtattgtggatgtaggctttgccatcaccgacacacccttgacgtagattgatcaccacaacctccaactcaatgcccaagccatgaatgccttgttcaactctttgagccaagaggagttcgatagagtgagcaacctggagaccgcatatgagatttggaacaagttggcggagattcatgagggtacaagtgagtacaaggatgccaagcttcatttcctcaagatccaatatgagacattctccatgttgcctcatgagagtgtgaatgatatgtatgggaggctcaatgtcattgtgaatgatctcaaggggcttggggcaaactacactgatcttgaggttgcccaaaagatgcttagagccctaccgaagaagtatgagacccttgttaccatgctcatcaactccgacatgtcaagaatgacacccgcaagcctcttgggaagatcaacaccaatgacatgtacaagttgaagaagaaggagatggaggaagcctcaccctccaagaagtgcattgctctctaagccgaagttgaagacaagagcaagagcaaggtgaatgaagtcaatgaggacttggaggaagagatggtctttcttactagaaggttcaatgatcttttgggaaggagaaaggagagaggaaggggctccaactccaataggagaagaaatagaagacctaacaagactctctccaacttgaggtgttttgagtgtggtgagaatggacactttgcttgcaagtgcccttccaaggatgatgatggagacaagtcatccaagaagaagagtggaggctacaagctcatgaagaagcttaagaaggaagggaagaagattgaggctttcaacggggactgggactcaaatgaggagatctccgcctcatccgggtccgaggaagaaggtggtgatgatgcaagctccaagaagaagaagatggccgttgttgccatcaagaaggctccatcactgttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggctctaaagaaggatcatgcttctttggaggtcttgtatgaggagctaaagacctctaatgagagactcactatttttcatgagaagcttaaggaagctcatgacaacctcctttccactactcaacatggagctcacatagatgttggcatatcttgtgatttgcttgatgatagtgctacttgccatattgctcatgttgcatcatctagcatttatacctcttgtgatgatcttatggatatgcctagcccttgctctagttctagctcttgtgtttctatttgtgatgcctcacttgttgttgagaacaatgagcttaagtagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgagtgcttgatagtggatgcactcaacacatgaccggtgatagggctatgttcaccacattttaagtaggagggaatgaacaagagaaagtgacatttggagacaatagcaaaggaaaggtaattgggttaggtaaaattgctatctccaatgatttgtcaattgaaaatgtctctcttattaaatctctaaatttcaatttgctttcggttgctcaaatttgtgatcttggcttgttatgtgccttcttcccacaagaagttattgtttctaaccttcttgacaagtcttgtgtgttcaaaggttttagatatggaaatctttatttggttgattttaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatgtgacgtttgagaaagataagctttgtagtgcttgtcaagctggcaaacaagttgcatgttctcatcctactaagagtatcatgtccacatctagaccattagagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaattagttgcactcttgtgaaaattagaagtgacaatggttccgaatttaagaataccaatatcgaggactattgtgatgatcttggcatcaaacacgaactttccgctacctactcacctcaacaaaatgctgtagtggaaaggaaaaatcgtacattgattgagatggcaaggactatgctagatgaatatagtgtttccgattccttttgggcggaagccataaacaccgcttggcatgcaaccaataggctttatttgcatcgtctcttgaaaaagacttcctatgagctaattgttgggaggaagccaaatgtcgcccattttcgagtttttggttgcaaatgttatatttaccgaaagagtgttagactaaccaaatttgaaagtcggtgtgatgaagggttttttctaggttatgcctcaaatagcaaggcataccaggtctataacaagaacaaaggtattgtggaagaaaccgccgatgttcaatttgatgagactaatggctcctaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgccaagtcaagctcaagttgaagtggaggaggagaaggcacaagatccacctatgcctctaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttggactttggtgaaacttttgcccccatagtaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaattctaaccatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtttgtcaaatttatgttgatgacatcatattcggttctactaatgaggtattttgcaaggaatttgatgatatgatgtttagggaatttgagatgtccatgattgaagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttgatgagggaggtaaactggtagatttaaagctttatcgttccatgattggtagcttgctttactttaccgtatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccctactcctatgtgacaatgatagtgccataaaaatagccaataacccggtccaacattctagaaccaagcatatcgacattcgccatcacttcctaagagaccatgttgccaagtgtgacatagtcattagccacataagaaccgaggaccaactagctgacatctttaccaagcctcttgatgaaacccgcttttgcaagttgaggaatgagttaaatgtcatagatttctctaatgtggtttgagattgtgcactatggttgcttcttttgcattttatatatttgctcctatttgctcttatgctttggacttattgccatttggttcttcattgcgaaaatggagcatgtcacattaagggggagttttggactcttgcatgtgctttacttccttttatatgtgagcaaatcaaccaaaagtgctagtagtgtttttcaaaatgcccaagtcaacataagtcaaaacttttgcaaaatcaatgatatttgaaaactaactctttggaaaatgtttcaaaagggtccctatatgttttccaagcctcacattgctagaaaaatgatttttgaatgaaaaataccattttggctctcttttgaagaatctagattcttgtttttggtcaaaataagattaaaccccaaaatgagtttgagaaggaatctgagaaaagattcaaaacaaagttggtagtgaggaggatttgaaatgtttttggtattcaaatcatattcaaaaaccaaatatttcaaaagttgtttgaaaatcaaattcgtccaaaaacccctatagaccataaaaggccacatcctagcactcaagtgagttttgttgcaaatcttcataaatttcaaatattatgaatggttggcaatatttcaactcacacatttcaaaattgctccaaaaatcaaaattttattgatttttattgagtgggggcagccaactgtgcaagggctgtgcacagtcggctggggggccaggcggtctgactggcgctatatgcgcggtctgactggcctggtagtagcggtctgaccggccactagggcacggtctgaccggcggcaacccggcggtctgaccgaccacgtaaagccggtctgaccagctggggatggtgggcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcttcgatttgcaccaatagagggtggtttcttggtgtgattcaactccttcaaccggtaaatcactctcactcttgtgcttttctctcaaatcggtctatttcaattctagggttaagggtagtttccccctttgcttcaatctctatgaaatagacctacactttgatgttcatgttccaatcttgtgcaactttgtcctaacaatatttttttagaatcatttgtgtggattgtggaaggattcggttgtgctactgtcagtggcggtctgaccggccgagagcctgcggtctgaccggccgaggaccgtcggtctgaccagccgtaagccgccggtctgaccggcctatggccgtcggtctgaccgacttggggcttgcggtctgaccggccttggctctcggtctgaccgcccctgacagacagcactcccccttctcccacttcactatgtggcttctaaaactgttgtttatccatcctttgctccatgtttttcagctatgcctccccgcactcgccatggtcgtcgtgagcccacgcccgatcccgtcagtgagaatgaggattcaagcggagatgagtatgttcaaagtgatgatgacaatatggaaaatgttgagggtgatgagatggaagtaagtgatgatggtgatgacaatgagagtggaaatggtgaagatgatgaggcaagtgatgataggagtcctctcgattccaccatccaatttgtgcttaatttgaggaatgctcaacaatacactatcctccgtcatcataatcaattccgaaggcctaacgattgtaatgatccaagatttcatacacggttccaaaagtccgtgtatgcacaagtgtatgccaacaaagccttcgccgaacacaagtggatttcttggaagcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcgaggaccctccgatgctctatcaaccgccgtgaatccaaggagctcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaaccgcatagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctccaactctcctcccctagagctcctcgtgtgcgccaaccaacattcgatcaaggtgcaagctcaagtgcagcccccccttctcctcaagggtatgatccaagtgcttttttccatctacaatatgcctactttggaatgcaacccaatgacttcttcaacccggtccttggggctattcataccctaagtgaaagcattcaacgcttatccaccgggcatgaagcattgcatgaggatgttcgtggcttgtgcaccgatgttggcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggtctagtagtagtgaggttagtcacctcatatttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgttctatgatggatggttggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaaaacaatatatgtccatgtgctctatgtttgattatatatatttgtggtgtttgtcatcaattaccaaaaagggggagattgaagcatctaggcccctagtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaacagatgattttaattgccacattaggtcattgcattttcatttgtgctctctttttcattacacacacattcacttgcaaattcactgggttctgcctgaccaggggcggtcagaccggccacatagtggcggtctgaccggcgtgccctggccggtcagaccggctacatagtggcggtctgaccggcggcactttcccggttagaccggccccctagaggccgagatggtgctgctcgggatggccgatacagagccaacggagccgtattcggtcagaccgagccgatggcggtctgaccgagccgaggccggtctgaccggccatcccatgccggtctgaccggccaggccgatggggccctctaacagggctacaacggctagttttctagccgttgcagagtagcacggtctgaccggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttagagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcttttgattgtcgcatttaaatttgtgcaatttacatttctagagacactttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaagttagatttgattaggtgttatttagttttaaatcgcctattcatcccccctctagtcgacatctcgatcctacagctgcacgcgcccggtgccgcgcagctcgtgcggaaggagctcgggccgccgcttgattgccccgccgcccgatgccgtcctagatcaactgggggagtcgggccgccgccaagctcctcctccacttccgcgcgccggcgctcatcttttttcgccgcggggggggggggggggaggggggaggaggaggctggtgcgccggcgagagccaagccccgtcgcccctccggtcggtgccgtcgccgcttggctgctcagtgcggtgaatgcggtggggaaagaagacaggagagaggggagagaaaaaagtggtaaaagctgatactggtgggacccacaagtagtaacttgcactgtggcacatgtagctaaacattgttcctgatctaggtggtgtgcgaggcttcgcaaatactagtggcgcattatgaatgtcctaaggtatacacgctgcacaattgcacagtacactatactgatggagtatgcaactgtgcacgatgtgagttctgtcccaaaaaaactgcttttggatacaatgcaaaggttagtggattttcagctcacaatatgaaagtcgtcgcatgacttctttttgtaatcgtactaatcgcgcgctttttgtgacggcatggcatagacgcatgtaaacgcatgccttttcgcaaatttgtaaaacgaaacgaaccttttgtcccaactggtgcaaaagcgtgaggaaaacgaaatgattcgtggtgagctacaacacacttcactcgatcgatcgtagtagcaggctactagccgcagcagcagtaggtcatcggacgccacagcgatgatttgcatgattcctcatgttgatccctggcggtggtaagaagagggggaaaaagtgactttttatcgtcaacagcgaaaagcaaaccgctcgcgggaatctcattattggcgtaccatttgttttttaacctttcgaggccaaatacgccatgccttccatccgtcgatctaccggttggagtagtagctgttatattgtgctcacgtttttgctagtgttgtagacgtggccgcgtgcgtgagaaaacgagaccgagaaaatgtggcgtgcgtcgcatggtggagggagggacagagatgtggcacggctcggcgcgtcgcgtttggctggacacgaggacagtacgtacgcctgcgctgacaagtgggggatcaccatgggaaagagaagcgagcaaatggggatagtgtcgtgcattgagagagagagagagagaggcgatcgactgacgacgacgacgcaaggaaaagctacagcgggtagcgagggacgacacgcagcgagcgagcctgcgcaaatgaggaatcatggcttcccccctcgaaaggtcggcatctttcgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcaccgctttgcctttgctggcgttgcgcgttttgccacactcgctgcttcttttttatacttcgggtttgggcgggtgccactggagacattcgtggggtgccattgcggcgtcttctcctctctcaggaggtgagtgggctctgtgctcttggcttgtctctcagctacttgcttcttcttagcattacccattttaagtttttggttgttctaatccggtgatcttgggtgttccctccggcattgccgatgttcttgagactacgatcacacattcatatgcatgggtgagtgatggtcttcgcttcttgtgaaaatgcctcacctgggggaaggagggctggtactagtgctactagaggggtggcgttcctgttcccttgttcgtaggcattcgcctggagttgtgtttgcatttacaagctgcacggcagaggatgattgccaagtggcatttcgtcgagcacgtagctgatatattcgtggtgacatttactagtactagtgctactactctccgcgtagctttctactgctactaatcctagagacatgagctgtgtggcgtaaaaacacaaaagccgcctgctttcttgggaaagggaggtggttttggccgccatggggacccaacacccaagctatagctagccaatgcattttgaacctcccttctccacgaattcctattttattttggctctccactttgactgctgctcacactgcacaccgtatgaaatgatatcctctgcctctgttgcaatggtatgcaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgagtgtttcagactttcagtcagattctgctgcttgttgatgcataattgcgcacaaatttgttgcaatttttggcatgatgcgagtagcgtccgttccttcttcaggtgccaagaaggtgatcaactcggagctctggcacgcttgtgccgggccgcttgtgtgcttgccgcagcgggggagcctcgtgtactacttccctcaggggcacagtgaacaggtcaatcttactgtcttttttcacaaattgcagctaatctcgttttgaaatgctgcaaccatagacaacaatttggtcagattgatgctcaataatactttgggattgctattggaatgatcaatgttgaagggatgatgcccttgcaggttgcagcgacaactagaaagattccaaattcccgcattccgaactacccaaacctgccatctcagttgctgtgtcaagttcacaacatcaccttgcatgtgagttcaagcaaattcaattccaaacatatttgtggccaaatgtgttttgcctgtgcttgattgtttgttttgcacaggccgacaaggacactgatgaagtttatgcacagatgacccttcagccagtaaactctgtaagtatgatgtttctctgttacattgtgtactgagttctgtactactttatttggttctattaaaatgtaaacaccaattgttattgaaatgcataaaatgtgattacagaaacaaaaattcagtgtgcaaggaataaaagatggattctaaattaatatttatttgtgccgtctattgtaggaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggtatagcctttatctacattttgtttgccgcatagtttttctgtaaaaaaatgcttcagctcatgggtttaagttttgtaccgacaggattactcaatgcaacctcctaaccaggagcttattgttcgagatttgcatgataacatgtggacattccgtcacatttatcgtggtagggtcaaacaatattcggattttatttgtcttgttcattgatacataaatatatgcttcttgggccactgtctcctaaaagtttcttcttttcttgtcccttgcaggacagccaaaacgacatcttctaacaactggatggagtctctttgttggggcaaagcgtctaaaagcaggggactctgtcttatttataaggtgaaataagttctataaatacatgcaaagtctgtttgttacttaacctgtgtgtgctatcagaaaattgaatctgagattgttaagccttttgatactaaaccctatgcaacaattcatgcattgaaataccacaagaactgcttatgttatttgctctttcgaaagaatgtccattaccagtattagattttcctacagcggctatctacttaaccttaaccaatatatacatattcaactttctagaatattaaaatctcaacaacaataacttttctatttcttgtcagttctaatgtgaatatgactgttataggacaccgcactttttactcgctcggactgacaacagcttgtatgtaatagtataatattttcttcacaaatatgtgaggatgaaatgccatttttgacagaagttcctgattgcagggatgagaagtcacaacttcttttgggtgttaggcgagccacgcgacaacaaacaatgttgtcatcttctgttctatctactgatagcatgcacattggcgttcttgctgctgcagctcatgccgcatcaagtggtagttcatttactatctactacaatcctaggtacagaaatttacttacccttttacatatgcttttttttttcctggtgagcatttggtcattcatggaatctccataggacaagtccttcgccatttgtaattcctgtagcaaggtacaacaaggcaacatatatgcaaccatcagttggaatgagatttgcgatgatgtttgagacagaggagtcaagcaagcgcaggtttgtccactttttgttctcattttacatagcttttgttttctgtttcagattttatctttatgctatttatttatgtccacaaactagaccttggtgtacaaccgtgtaatggattatgctgctttaaaagtataaataattcaactgtgaattttcatgattcacattggaaaaataatgactacatcaaatgtcgttgcatgggcatacttgcgttctatgttgagtttagcgttttgttgattaagtacagctagaaaacatattccatattgtaaacaaaattgtcttgttttacagatacacaggtacagttgtgggaataagtgactacgaccccatgagatggcccaattctaaatggcgcaacttacaggtgcctttttcatgcaaaagcttaaggaaaactcagaattctgcctatcatggtgtatttgatatttatatacttcttgctactaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggaggtatgtctctgacatatgctatacaaatatttatggtcgtgcaatatgctgaaacatgccttacccttttgcagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccaccaaaggtagaatcatcaaaatcacctgatggaggaaagtctgtcaattcgtttccaaaccaagggtgtttttcgcagttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggtttatactacttgactgtttatatgttaccatttgtcaaatgctcttgatagtaaatataacttaacaactatctattatgtttttttttgtaatacataggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcagtttgatctctctccatgatgcaatacgaggggaggtagtacagtatacaaacatgagttagattgtagaaccaaaaacaatgattttcaaatttttcaatgtagtattatagaacgacatatatgatctggagaagggtgaggctacaagcaaggtcgcaaggtccgtaggagtaagagcttgtctcacaaaaccatttcagaaaaatctgacatttctactttgagcgaacaatcattgtttgcaacaccccgagtacctaagaccctcatgctacatgtgagcatcaaaggatgatagaacaatagccaaaaaaccagtgcaatcacaaaggagtagtatctactagcgacgatccaaaagaaaccgcttcctggtagaaatcctctcctgcaaacgttccaatcaatccagttgatttcgccacccgcatcttgataagtactcgtagaagacttcaccagacataagttcgtctgcattcaaaatatgtgacccaacgtaaaatttactcattattttgattgctaataagctatatgaataagcatataagtataattgaaacaatgagtccctcactttatgctatatttttccatgcctccagaaaccatacctttagaggccggccacatcaatatcaacactggccttgcaataaaactggatagctgcagcacccatgatttcaagaaaataagcaacagcatgcgcaaccacctttgagtgattttttcagatttttgtgtgacccagcaagagaaacaccacaagtgtggaagcatggaggcacagatggatgaactcggtctttctagtgggctcaaaatcataggcagtgtcaacaagatacttcccagcttggagagctataaagagaccaaaccaaaagagagcaatatacacatcaagctctgactcatctgtaatgtgtttcagcagcttccaggtaattagcacaagtgagccatggaacgcaagaagcaatagtgccagtatacctagccgcatccaacgcttgcgttctttttccctactttcatcactctcagtatggccattgttgatcccattgctgcctctctccctactcctatcgctgttcatgttgttgctcctcctgctgctgctactgctgctgcagctgctgctgccaccgctgttgctgcccctcctcctcctcctcctcctcctgctgctgctgctgctgtctctctcccttgtcctctgtctgaattgcccagcaggtccaagcagcctttccgtgccattttcagtgtcttgagctgtatcccactcccgagccaaattgttcaagccattttccatcctccattcatggcctgatccagtgttgttgctctggccagccagattttgtaattccactatatcaagagttacatcagctctctgcctgtctgtcaccacatttgtgcttgggcctgccaaaaaattggagctgagctcaatggtgctccttgacatttcctggtgaggcacttggcctggtggattgaaaggcgggagaggtggagcacggaaagatggcagggatccatcccttgagactgctgctgaaggaggcggcgctgctgcacttgccgtagtggacgaggtctgtgtagaaagccgaaccgtgggcggtgatggaaccattggcggcggcagagcgcgcgagctggcggacgctggtggggagaaggtcggtgaaggcggtgatggaaccattggcggtggcagagcgcgcgagctggcggacgctggtggggagaaggtcggtgaaggagaaaatcctggcaacgacgaactggaacagctcttccataccgtcgacgagctggtcggtgagagctccagaagcggtggtggtgttggtggcgacgaggtggatggagccgagaccttcgtcgagggcggtgacaaggagggcgagcgggccgcccctcgccgccgccgtgtaggagcggacgtggcgtcgcgggtatgcggcggggccgacgaggagcgcgtaccccttccccgccgtgccgaggtagctgctgctggtgaaatcatcgtcggcgacgtgcttgtgatcggcgtggagtggaggaagacgaaggttggcgacgaggagccgtcgcgtggcctcgcaatgttgcggcggcgccgacaaggagagtgtacgccctccccgccgcgccgcggcgggtggggttggtttgctcgcgttcttcgtcggaagggacgaacagtaccccgcagatttgggaggaattggatttgattttggtaagacggtagaaataatggtgagaggtttatgaatttttgggggacacgccggtggcacgggaagtgtgtgcacgcagcaattcctttgcctcgttcccgcttcccgctggctgacagacagctctgtttattgctgtgtgtacgctgtagaagttacaccgttcttgcaacaaatcgaaaaacaaaagatgcatttatgagcagggagtagggaataaacccactaccaccggtatttgttacggaaactactagtacgactagtcctgttcttctgttctgggaggagctaaggcaaaccatggttttctctgtgttctaggagtagttcgcaatagattctctaactagttttgttttgtccattttagattgatgccaaaatatgttctacaattttttttatgatttgaatggtaattgtgatgttttgatttgaaactaaatggttggcattgcccatccctaataatagatagaaatccgtcctctacatccatatacacaaccagacatgagataatcataaacgtttgatataattagtgagcatattttaattttttggacgacccttatctctctcttcttcctcctcctcttcctcctttcaccccttcactggccaactcctctcattcctcttctccacatcgccccccttggcagcttgttgtgtgggaggtactttcacctcctcaccttggtgacgttgctggcgagggatggtagtggtggaggccacccccatcttctccacctttggcttgacgatgctcgactgccatcttcattcccaattcgggcacaaagaagaagagggaggaagtggcggtcaagaaagcgcgttgagctttggtcgaagtgggaggaggaaggaagaggcagcttcctccatgaccgccatcgccggacgacaccaacgtggcaaggctggttagtgtcgtggcagccaccatcgtgatcattccgtcgaacggtgggggaatgacgctccttgtcgatgggtgtcgttgcaccaacaccgaccgccatccctactcgagcccgtgtggcactatgaggaagggagaggggaggggaaacatctaaggaagaaaggtacatagattttaatagttagggattaaaatatctggtattatagttgaaggacgaatcagattggatgtagtagatttgaggagttaagtggactaaggccctacttggttcatgggactaatccattagtccctccattttagtcccttttaatccctaagaattcagacataggtaactaaaagtgtacactctgggactaaaatttattagtccctcttgaaggtacttataggcatagtagaaaaaaccggaacggtagatgactcgatcaccatgctggttcaccagttcgatagtccaaccgtaaaccggctggtagaaccgcggtttactaagtacatataatatatatgtaatatatatattttcagactgtcacatacattcggctggtagtatggctacaggggttggcttaacttatcttacaggggtcgactccccatcggcgcacatttcctttgatttttgctaaaaaaaaacaagcctgcggacatatatggcccaaaacacactaacatcgcattccagagcatgacaaagagctgcaccatgctcagaagcgaagcccgacaacccattgcgcttgcagacagtcttgaagaaccggcggcacaaccaccatggcgaccgtttgtgacagcactggtgcgttggcgtcggccgtaccatggggcctatcagcctatgcccacaacctacccaggccgtgtttagttgagccgatgtcgctgtcgtcgtgaaactctacgtaatcgcggacaatgagaacgaatcactcctccatggctggcgccctctcctccagggctacattcattcttggcattggcggcgcttctacgtagatcaaaccaatcatggttaactgaataactggtggtgaagatttcaatgcacgctcctcattgacggctcatgcatgaatcaaggccacagctcagagatacggtgtgtcccaagagtgtcccgcgtccgacgttgtgagcgatgtggtggtttaatcacattaggaatcgatgtatatatgtctgaaaacacaaaaattaaagctacgtgactggtgggccggggcgtatatcggagatgaagaaagaaaacacaaaatgcggacatcgcacgtggcgaacacgactacggacgaaagcgtgtacgtaacgattgagaaaatccaaatctactttaagtaggttagattagaatagataaatccgaacaaatggcgtttttcatagtttttcatattttatacttacactattacgcatgtgcatcatataatccatcactccgccctcttccactacactattttcgatgcaattgaattttattgtcttcatattgatgaatgaaaatggcgtgcatgtttgtttacaactagatgaaatctcgtgcgttgtatgaaagttttgtataatattagtgaaaataacatgtaaaatagctacatattatagtaatttttttatcgttgatcgactattgaaaaaaaaagctatatatataaaccatttgatgatgtggtctataactatttaaatcatatatgtattgatcgtttaaaaggaaaactaagatgatatgacccaataacagaaggaaaagagaaaataatataaattaatcatcaaagataaaactaaggtgatatgattttataagaaaagaaagaaaaaatgagataatttgggcataaaaccattccataactagaaacaattaagttgatgtgacgtaatgaaagaaagaagtacgtagtagtactgaagatgaactttctaaatttctataggattagagaggcaaacaggaattaaatcagcatatctccatgagtgtaagtcgttatctcggtatatagatcacttttatctcctcgtcgtcaagtcgtgtgcgcatgcatgcatgatcctaatgatcctttctcatggataatgtttcacgaggatttgttcgtttaatccctcccaaaaaaataagagagatttagaaggattaatttcacatctacgtggaattattttttcttaatcccctctataccttttttttttgagattatacgaacaaagacccagatttgagggatgatcgatttttgagatcgatatatagccgtcactcagcaacggtcgtgccccacgggcggcagttgatgctcttcgttgctgaagtcggagatcttggggatggacaagccatactctctgagatggccgacgacgaggtatagccagaataggcactcaaacacaccacaggtgacgaagaaccggcgccacgacacggacatgtggtggtcgagggtcccgatgagcaacaaaaccacccaaaatacgaggaagacagcggtgccgatgactgtcagcttgaattccctgagcttgtgtttgtacctggcgacttggcgacgcacctccgcgtccacgatctcacgcgccgtctcatcctccgccgtatgctcgctccccgggtcctccgaaaccgctctgtttgggccgctgccgccgtttccaaggcagagtaccggaataatctgcgtcttctcggccgccatctccaaactctctgtacttccggacccgccgctcattacgccgacgacgacgagaaacgcgccggagactcgattcgatacagctcgacgacgaacgcgcggcgtagggcgcgaatcgacgaggaggaagaaaaggaccagcgtggtctgggcaaattaagaccgagtcggtgtcggttttggagttctggacgacgtatggttgggctcggctcacattgcaaaggcccattgatctgtgagactgtgacgatcagcagcccttttttttgggaaaagctagataccggtatcccgtccctagcatccacgacggtatcttctttttccttgttcccagagcacgagcacacacatgcagctgcggagcagcgctagcatcgggcatgcgacaacggaggaagaagggagctcactggagaagctccccgctgcctcgcgagcacatcaacagagaagatatgcagtgccgcgggcgacgcgttccggcgtgacggcggagcacgtggccgctggtgacgagttccggcatggggcgttgacgatggaggtgttaacagtgaaatttggtaagccctgagtagtcatcggcttagagtcagcatcggctttgaagtcctgagattagccgatgagagttgtcaagtcgtcagttgtcggattcttactatattcggttaagaaaattgatctactaaaggaagcttatccagaagagaccgagttcaaagagaatgcggcatggcaagttatctattaattaggaatagtttgttagttttcttttatcttgaggaaaatgtgtttagtgtcctataaagactttatcttttccttttatctttagaaaagtttctttcttgtccgacaatgacttgtatcaacccatgggtataaatatgtacaccaggggtctatgtaatctatcgctacaatcaatacaattcggcgcatcgccaccttttaccttttctactttattttatcgtccggcgggacttggcacctgacgcggggctgcatcggtgttcgatctccggctaaggggtaagtccaatgttccgtcggcccaggcaattatatcatttacgtcggcgtcgttcaaggctacatcagtacattcaacctcttgaattgctctggtttggatgatatatttgcctacctatttatcatatgtctctgttaatctagtctttgcatatcaatttagctctatcggctgcttctcgttttagggtttctgccggtatcagctaaatcgcgttgctagattagattagcttagacatctaccaccctgaaaactcagtcaacggcttgattgtctagatattgtgttttttttcatacttagtgttgcatcagttaagtttgatctactaagtcgtgtttagaactataatctctagtctgcttcttgattgccaataagggtttcatcggggtttcagctgatgagttatctagacgttacattggcttgtaaggattgcatatacatacatattggatttagccgatcgtaacaaaggtttcactgtttaatctaatcttgtggatttaatgacatcggacctccagccgatgtatgctttaaccttcggatcagtgcttattctatcatatcattgttagccgattggtttctaccggattatattactatattatattatcatcaaccgattgcctttatatcattatctacattggacatatagccgattgcttaaaccttatcgctattggctggtatcggcatcggctggaatcactccatcggtttgtcagccgatcggctgttttatctgctgtttacatatcttgtcagttgcaagatcaaactgactggcacgcccgcatctcatcaatctttggacctgcacagaagttaagcagatttcccaggccggtgtgttcgattttttcgtcaacaggaggacgcagccaccagtgtggggcgtggcagcggaggcatggccgctggcgacgagctccggtgtggggcgttgacgacggaagacgcgaccgccggcaacttgctccgacgtgggacgtgacggcggaggacgcggccgtcggcgatggcgatgagcccggtgtggggcgtggatgacggaggagcggtcgcaggtgacaagctccattgtggcatggacagtggaggatgtggtcgccgacgacgagctccaacgtgggatgtggacgatgggaccaccagcgatgacactttggtgcccggctcccgatatctcgtaagtatcacctaatacatggtaggaatcgtctgatatctgacaggtatatcacctgatacgtggtaggaatcgctgttaacgaccatatttggaaatgccacgtcatggattcaaagctagagtcaaagccgatttggagaaattccgttcgagaaagcagaatacgcatcggttacaagcagcatcggctaccgcatgaatcggctataggcggtatcagctgccacatatcggctaagtgtcggatccgatggagttaagccgatgcaaccagtctcaggaaagatggtcccacgtccgtcattggaattggtcgaagcacttcatagccattgccacgcaaggattggagtcctaaaaatacaattgtagctattaattaggacatttttcagtttccttagagatatgtttggtaagagtccacctaaaagacttattcgtattttaggttgtgttagagataagaggtgtctagtaaggacacattatgtacttgggtataaatatgacccgacaccatgtaatcaagggatgacagttcaataatacttcagcgcatcgccaccctttttattttcgttgtttcgataagtttttactttcgagttgggctgcatcgggttcgatctccgacgaagaggtaaagctttttatggcggcttgcgttctcgagattagtgcttacatcttcatgacactctaatcctgtctatatgtaaaccaccgagttatcaaatataccgcataatctagattgatctcgtcatctaaacttcatcagctagcctctattatcgaaaacagccagcaggtttaggtttcgatatcaagctagactatgcagtgtatctaccatcttgaatgagttttcatcgatttgattagatattatgtgtcttttcacgcttaatgctgcatcggttaggttcgatctgttaagtactgtcttgaaatattttatctagctctttctttgattgttaatagagatagcatcggagtttcagccgatcttacctgatttagtcatcttgtttccttatttggttctagatcatctaaatctgccccttatatcaagatctcatacgtttaaagtatattaagcttcctatcaatctgctagttcactctgcttgttagattggtttcagttttgtatatttcatctgtgctgatatcttggtataaggtggtatcggaatactagccgatacaagttaggtttgcccaaacctatcggctatgctgtgaacgtacatatccttactttggggctcgtctagatattgagtgatttatactgtctcaatgcagcgaccaatcttatcccaatcacttagtctaaacgtgttccattggacagattatgtatcgttaacatctacagccgatcgagtagacccaacaatctccaagttttatctgcctttgccaatctgacgcaagttacatcggcatggcttcggacgatatgtcatcggcaatccagccgatcggcaatcgttgatggatttaactttgtctttttttatatcttattggttgcaggatcaaaccagctggcatgctcagaacccgaagaaaatctctttgaacctgcactagagttaagtagatctctcgggccagtacgtgtttttcgtgtcaacaatcgcctgataccttataggtatcatctgatacctcgcaagtatcgtctgataccggctaggtattaggacatgatacctcatagttatcaggacctgatacctaaacagtatcatcccgtcccaacaggattccgttgtatagcagcccttctttttttcatgaaggttgttgtcacaccccgaaccggcaccgccgtacaacttatgacagagacaagagataacagaaacttgacataatagtatgatagaattggacctacatatatagaagtatagaacgatctggattttggagtgaccccctcttgtgagggataatcgatctatagccgtcagtcagcaaaggtcgtggcccacggggcggcagctgatgctcttggttgctgaagtcggacatcttggggacggacaagccataatctctgagatggcagatgaccatgaatagccagggtccggacgcaaccatgccagagctgacgtaggtctggcgccacgactcggacatgtggtggtcgagggtcccgacgagcaatagggccacccaaaatgcgaggacgagaacgatgacgatggctgacagcttgaattcccagagcgtctgcttgtacctggcgacttggcgacgctcctccgccgccgccgtatcctcattccccgtgtcctccgaaaccgctctgtttgggccgccgccgccgcttccaaggcagagtgccatatggtcgcccggcgtcttctcggccgccatctcaactcgctgtacttccggacccgccgcttctcaggccttccaaaatcgacgacaacgagaatgccgcgccggggactcgattcgatacacctcgacgacgaatgcgcggcgtagggcgcgaatcgacgaggacgaagaaaaggaccagcgtgtagatggatcggtctgggaccgagtcggttttggagttctggacgacgtatggttgggctcggcccacattgcagaggcccattgatacgtgagactgtgacgatcagcagcgcttttttttttcatgaaggttggttacttgtgaatttgtgtttgacagtataaatccgacacgggtattcttcagttttctgatggttttgaaatttttgaattgtcggcctttctattagagatgggattgtctagtagtgtttgaaaataccaccatgatataatgaggtgatacccacgtttgctttgaaatacatgttaaatctctactattataaaaattgaagatgtttttaccgtattttggtatgtcatccatatttgagtcgggttttaagttcgtttgttttgaaatacagatccatgtctgagttagattttaagcttgttcctgtcggaagtataaacggagtcatataagaaatcttttaaaaaaaactcgtatgctaacttgagatgaaatacgtactcctaataaatatcctaactaaaccataaaacaataataaaattaaaatagcatttatctgttacaatgcacgggtattttttagtattataatataaaagataataatattatattctaaatgatgtcatgtttgaatgaaatttaagatactcttgagtagttattggtacaattcaattttttttgagcgattcgatccgccatgctcgtagtttttgacgaatctaaattgtttggttagactccagctataggaaaggtggattcgagagatggagttctgctaaacagggccttacatgatctttattttctaataattgctagtagatgttaattatatgtaaggtaggagtatatatttattgccatgaacaccaatataaccattggggacgctatatagctaggaagtgactatgattataccggtcatcgataactgagtggtagtaattatggatatccataaaatgtgctgggaaacaatactcgttgatatatttttcactctgctaccaataaccatggttcattttaaaacatagattatgaaaacacgggaataaagaaaacacataaatgaagttatagccccataggtctataggaatatttaatttattatgtttttatttcagtcctattcttttgttgtaacttgtaaagtctactagaatttatttttaaataaataatgaaattccttgatgcaaagaatccgtaagcgaagccacctgatccaaagcggacgctgctatatagcaaaaaccggctcattctctcgagtccgagcagcaaaccaaaaaccaaggctctctcccactcgaccgaaccccctctctctgcttcctctgctcctcggagagccgcagccaaggacgccaagatagggaccgaaacccccgccgccgatggcgacgccgcccgcaagcggcccagcgccggcgacgcgcccgccccagcccccctcgccgacaagcgccaccgccccaaccccccgtcctccggctcccgcgaccgcgaccgccaccaccgccacggccacagccacagccacggccacgcccggccgtccaccgcgggcggcggggagaagaagctgcgggcctcgcacatcctgatcaagcacgagggctcccgccgcaaggcctcgtggcgcgaccccgagggcgtcgccatctccgccaccacccgcgacgacgccgccgacctcgcgcgggccctccgcgagaagatcgtcgccggggagcgcaagttcgaggacgtcgccaccgaggagtccgactgcaactccgccaagcgtgggggtgacctaggtcagtacgccacacgccgctacccatccacccccatgtcaatctgttggtgtgtttctatacagaactatgagatttgctttctgatgagcgtctgattagatgtgcggatggaacttgttatttcgaatcgatctgaattttagattagtactaatgttatacaggcacagaaatttgatttatcaagtacacttcgtgagatctatgtgaaggaggtggtgccgtgttagtttgtattaggacggtcaattttgatgaagctatccccgttttaattatgtgcagtaattgaattttacatgtgacaattgtgctataattcgtgaagacagtcatgttagctcttaatatgagacaattactatcagtgtaccatcgcttcagcgtgataaagtatgaacatcactgccagattctcagttttgattggtgacctagtccacttaataagagtcttaagaatcatgcgctgatgcagttttgtttgcgccacccttatctagtatccgttgtgttttccatatcgaactgtcctttttgatggaattggggctctagtaactgctattatggcggggatcattaatttcttttcttgttatgaacatgtcatgtccttatggtccgcctttgggtatgggccgagagggccaaggcccaacaggaacggatacgtagctcatttggngttggttagagagtctagggttagaagttcccctctatctatatataaagggttaggaagttcccctctatataaaggggatggttccccaggttagggtaggaattagattgaattatctcttcgtgcccaccgaccctgtctcctcggcgctgtatatcttattctttaggaaaaaggaaaaatgttactccgcaggcggaaaccatggtcatggtgaccaacttggaatgtgtgacagcagtcaattccttcatttttcttctttctatgaataccttgtaaaataatcacctgtattttactctgccatttgttgataagatggacagttttgcggaacatggcataatttgctatatgtagttatgtacatgaggcaaacacattcggggcatgagacacagcacaatacactattacagatatagcggtgtgctattgctttttttttttctcaaaaggattttctcagcatgtgatggctggctatattgatcttttgtggatatttgcattcagaccatttccatccctgggactattaagcactattatgagcatgcacatgagggactaagatcacaaaaacaacgcacgatacactagtaatgaattttcttgcaggtctattgttccctgtgcgggaaattattacctgcccaaatcggaataaccacttgtgacatcacaattaagttggaatatcttgggctgggtggtctcccctattatgtcgctgccataatgaaatgatgcttttggagacggttattctggcagatgcgttagcatttggcacagtatctgacagggaacatatgagttgtaattgaggtctcatggtttgctagtgtgattactatgaagtagtgagaaggagacggcaataggtgtaagctgacagaaaattttgatattgtccctttttttcagatgtctcctatttatctgttctttctattccacatatatgattaatatgtttgcaaattatttggtactgtttatcttggtgttagtaattttttggtgcgaaaaaggagaagaaattgcaggggagcaaagtgccacatgctattgtggcaactaacttggttcttctcacaaggaattcatgtccatgattctatttctactgatgattcttgatttcacacttctcttactagccgagacctcataattaagagtgatcttactttcgcagtttatggctgcaggtccatttgaaagaggcaagatgcagaaggcttttgagaaggcagttcttgctctgaaagttggggagataagtgatgtggttgatacagacagtggggtgcatatcatactgaggactgcctgattacggcggcagtacgggccttctcaatctctcattctctatacactccgtcgctgtctgcaactctgcatatcatattgaggctgtttgggggcagaagtatgggccttgtcaatctgtatacactggggaaattggatgttggttattgcttcgttacaaacctgtgcatgtactctcgatctgcgaaaagtttatgttttactcttacattttgctggagacatttgctctggaatgatgctcaagacaacctatgaatattgattgttacaacatgtttggaattagctgaactgagcaggaagttatcgatgcattcctgcttacattcttgtttttgggtcgaaatgcgagctcagtcagatgatgaattttaaaaaatttctacacaaatccagctgtttggtagagtttgccactttcgaatgaaattcgaacgaaatcgtgaatctgacaggcgtacgagtgctccagcgtacaggaggcagctgccgattggatcccgcaaacctcgcgccttttccgcgattcagccacgtacacgcaccgtccccttcctgggctcctcttcgtcttgctgctgcagctttccttcttctccaccccctcggatctccaggagtcgatcgattctcttctccttctcccccaactctccaccttccacacccttcggcgacacgccgacgcagacagccaccgcacgcggcggcgacgacagcaacaccggccaccatgggcgcgtccacctccaccagcaacccgtcactggaggcgcaggagcaggagaccctcgcgtcggcctccctcgccctcccgcttctccgcgccgccttctcccgctcgaacggttcgctggcggaggcgctgtccccgccgcccgccgccttccgatccgactcgccgccggtgcccccgcgcttccacgacctcgtcgcccgcctcggccccgccatcgcctctctcttcttctccgacgtcggccccgcgggggacgcggccggctggctcgggttcctcaggggattcaaccgctgctgcgcgcgcgttccggcgtcgcagtcgctggcgctgctcctccgcgtgtacgccgcggcctgcgccgacgcgggtgctccctgcggccttcagttccacccggacgaggacggcgccggtggcgaggggaaggtcgtgggggagctggcgccgggggagatcgccgtgttgctctggatgtgctgggtcatggcgtggagcggttcggctcccggggtttcgggtggtcaggagggaggcggcaagggggaacccgtgttgctcccggacgtgacgcacctggtgctgtcggcgctcgtgtcggcgggcgccgtcgcggatgacgctggtgtttggggatgggaggtttcccgtggtgggaagggggtgaaggtccaggagttcacgtcttgggtgctgtccacggctgctgggcttggcaactgcctctcgcggtatgtgcaggaaaggttccggtcgtgcgcagctgatccagtagaggtaagcaagctgcattgcagagtcagtaatttactgtgaaaggttagctgcattgcctttgttttgcatagaacatggattttgagaaccagacatattgcatacttcagataagtgcaaaatggtgggggatcttcaattgatgtgattttgccatgttttcattagttatgctgtactccctctatttactttttcaatttaacgtcctcattaaaaaatgatggaagggatattaatcttaggtgttctttagtagattcatatttgatgacacattgtcagttgtgggagaactaaattatgtagtcagattctgtttattcccagtatgcaaattataagaaaaattctgggatgcttagattcaaaatgagtaaatgactggtaagaagacaaggatgcttagagtcaaaatgaataaatgactgctaagaaaacatgccatttcttctttatatctgatagttcagggtgactaaagaatcctactgaggatgtccaggcataatggtgtttggttagtaaattgctctggtgtttctgatgtggctgggtctttactgtaacaaaaagataaataagtcacaaaaacttttggtttgcacttggttttagtagtttggagctcctttctgtgatgatcattgttttgctacaatgatgaagctttatttattttacccattttattggaggaaccaattagatggcatattaatgatcattaagcttcaaccaaatgtttgatcttagacgttgattcttacacgcaggaacgttctgtttcaactggtaacacgtcatcttgtaaccctgacgtatatttgttaacacgtgggagggcatgggcaatctctctcagcctcagaaacacattgagtgaaaagtttttatcagcatctgtcattggaatggatacagaagaccttctttataggttactccttgttctaaacatctggtgacattttactcgttcttatgtttttttaatgtttctattgaaggccgtaaacttctaaactgtaatcaataccagatcaattcctattatggtttttcattacattttggtaacttttagcctttactgaatacatctctgcaggtcgtcagttcatggaaaagggctgagccggttttggtcttgtgttgagggatataaaggaccagtgctaattttactctcagctttctctcgtagtggtggtgacaatgttgatactgatcaaagatggggcattggtatattaaccgaggagggtttacagaacaaagacaccttctatggtagctctgcttccctgtgctccacatatccaatattccgcatgctcccaccatctggtatgacttgtgctggtcatttcctttttaccacagctgatagtagcttacggccttactgtgcctctgacctagcaggtaaggagaagaatttcatatattgccacctacatcctcagataagggtgtacgaggcaaagccaaagcctgttggtttaggatttggtggaacgattggaaatgagagaatctttttagatgaggacttctctaaacttacagttcgccatcatgctgttgataagacttaccaacatggctccctcattcccaaccaggtgaatttttgcatgtactagtcattacaaattataacctgattgtgctgtgaagttttttaggtaggaaatctgaatctgttttgttcctgaaatacagtttgtcaattagttggtagcagaagcagaatgggttttcaaaatgtcgttgtagtgccaagggaagtaataagattgaggcaatggatgatttttcagttgagtagtactgacactaagctaaaaagaattcacaaattagaaactgcatcctgtttataatttacataaattacgaacaacactggtagccatgtaaactgccttttaggtttcattttaatagggcacaagaacactttgccactttccttcccttgtaaggtctggaatgaattgtagtagcagtatgtgttgtgaaacaaagaattcatgaactgatatcatctgacctcgcttcagacaaatcctggccttcgattaaatgctagcaaaacatattactctacactctgtttcttttcatgtagggttatttacctgttgaggcttcagtacttgatgttgaagtatggggccttggtggagaagcaacgagacggcaacaggatatgtacaagaagagggaggatattttctcagagcagcgaagaaaagtactaatcaaagcacctaaatcttttaactactaactatgctagtactgttaaacgtgtgacagaaattttaatgactgtcccctatttttgttttcaggttgatctcaaaacatttggcaattgggaggactctccagagaaaatgatgatggacatgatttctgatccaaatgcagttcgacgggaggaccgttgaatacaattttggactatatgtttattatagctcattatctaaaaaatgtttattatagctgccttagtgccagtacatatctggacatgggaaatggacgatcttgaggtttcatctttcttgtaccttggagatatatagaggagtaggtgcacatatttgctccatttgatgtttgggccatttgactgggcaacacgtcatgtaagtattgaattgaaaagagtcttgtatacagaatatcggtctacaacggcatagagcttcctttctcatgctccccttgttttatgggaatcgatagcaaacaaatttgtatctgtattgtaaattgtagattattcccgtgtccagactatcacacagacatggtaatttccgattatctcacatcggtttgcaaacggcctggtttctcgttaatgtctgacggttcccttggccgattcatcccggctcctgcagtatcataggctcacgttatcagtatctgttaaaccaaactacattttctcgagttctgtacatatgctgaaaggtgctccctccgtggcttcatccaatttttttttatttctagctacaaaactggacaaacattgagttcatagttagaattgaatttttggaccaagaatgtagctggtaataatataaaaaagctgagtttgccgcttataacttctaatttattttctaaattttgtaggtgcttgttttcaaaaactaggtaaaaatttaaatcgtttatgactcaaacagtgcataggtttggcccgtgtctgttccaagagagaacaaggatacctttgcagccatgattgggtagaaagaacacacacacagttacacatagtacgatggacgtgacgagacagtacgagataaacacacacagagcgggagctagcggtagaccatatgcctgctactagtagcaaaagtacgtgcaggctgctgctgctgcccttccccgggttgtgctgttcatttcacaaactctggtgcaaccactggcctgatcgatgatcgatcgatcggatagtacaaaaaatgtactaggcatgcatgttcagtttcaccgaccaattgcccatcaactaccgcggcggcaacaaattctctgcccgaccatgatttgcccggagactcaccaccccacgccatgttggtggctgctactccctcctgtggtcctgcctgtcggctccttaatctcgagagcacacattccattttccaccttgggcagacatgtcccttcaacttcaacttgtccgtgctcgcttccactgtagtgcattcattttgcacaccaaaagttcctagtgagcaaccaattcagatcctatatggtggagtattacaatttacacatgtagcatttctcaccgacatgtgagcccgaggatctatgcacccacgtgttagtgagcagtactacagcagaggaccctcacttagaagaaccacattttttctagtgtacctagatatgtttttcaaatattatctttatcctaaaataattattgtttaaaaataattatcattttatactaatttggtataaagattaaggttttaaaaatataaccataggatatactatattgaataatgtactccatcactatttactcctactaaacaacatattaatctttatattttgcaatagtgggagtatttttatcatgatcatggatcgtacagtttggatccaaaaactttttttttaagtacgtgtctctcgcctcgccttctctcttatatcctcggtaaaaaaatattaaattctatctataaatctggataatcatttatctaaatttattgctagaatctttttttaacgaaaagagtatccaactagacattaatatgagatgtggagatcactatctcctattgacaggtttattgtatctgcccctcgtttctccaccactccgacgttgccctaccctggctagctctgatcaccatgccgccattccattcatgctactcgtactcccagctgctgccgatggcaaccaagggtggcgccttctccgacctccatgctactgtagctagcaattggcaatgtagcatgctgcaagcttctgctggctgctgctgcgtgtgtgagataagtactagcttctgctgcctgtgtgagataagtactagctagcagtagtgatctctatagagagagcagctgaatctttttcagattacactgaaaggtagacgtacgagctgtggtatagagagcagctgaatctttttcagattacactgaaaggtagacgtacgagctgtgaatagacgtacaatgtacagtactctcctactactactactacgatggctaccaccagcttatcctactacttctacactgtaaaagcagaaaagaaatgatacgacacgaagtaaataaagatggatctatgggtcgatggacaggcggcggcagcagcgcaacgcagtggactgaaaaccggctgctagtagcccccttccaacgctacagtagcttttcttcagtgatagctagcctcgggaacgtatgcttgcatgaatacgatcgccatacgccttggacaagagcatgcatgattggctcactgaatataaacacaaactccgatcgatcctgtacaaactcgcgacactgttttgtttacggttgattcgataggtgcttttctctgcctgtcttctggtcgagttattccactcccctttctgcaatcctcacaaagtttgatttgttttccccagctgatctcttccttttcttttttaatatactacctccatcctgaaataaattaatttttcacccatacatatcaatatacgaaggaaaaaactgaaatatccttcactttatcaaatatttgctactaagtttttaggaacaaataaattgaagaaagaagtaattttggtatgaagaaaatagttactactcagtaatgtacaccaaatacggttggaatttcatatagacaagccaatgcagcaagtagccatgaatgtgtgtttggatacatgcaatatgacggtattgtattttgttttcgttgcatatttcatttatttcttcgagtaaattggaaccatgccattataattttcccttcttcattaggagtatagctgatagcaagagtagcaagcagaagattcttgtagccatgtgtttatgcagccgaacggctacgctgtacagcacagcttaaaacgctgtaacaaaggtctaccgaacaggtcccatgattacatgagtatattagtttctttgattaaattaagtggagttattttgagacggagttagcataacatttctttgaacacacccgaaacttgttaccctctactccctgtgtatcagtttggatagttcctatgagtataaccacgggatccccgtgaaacttcagttaaccgtagcttcagccctggtactgatagcaggagcagctagccggagtagctagagctttcatactgcctttcttcagtcaccgtttgcctgtcttccagtttccatgtggtgccacagagatgttgtccactcctctccctatcatgcaaaacaagaagcacttgatggctgaactgaagttatacacaagctctcttgcagttgcagctcacaacacattcaattcgcacacctctctcaatctctctctctctctctctcatgtagagagagagagaaggctgcaggagggcatgcagaacagagcaggcccttaataggaagaacctaagttccttagggacagataggtacaggggaggaaagggggaagagagagacaagtttctatagggcaatcatgctcctctttctgatcactgcaagaagagaagaggagaggagatcaccgagaagatatcacaaggtgtccatccgggcacagccatggatgcatgtgttgttctgtgtccttctgttggaaagcaagaaccagcgtgccctttgtctctctagctgcttgctgcttgaattgccatggacacaaaattgcaccattgatatggagtgaaaagggctatgagatgagatgggatcagggagtaggttcttctcttgactgactcggcgtttcccattctgtagagattcgtcatactcctccatggtgaaccaaccggttgatcgatctctcatctctcctcatgtgatctgctgcactgcacaacaggggccggggttcagttcaagtcaagagttatggcgaggtagctggctggaattgctgctagctagtatactagggttcatgcatgcattcttgtgaactgtggcggtcactatgtgaactgtagcggtcactgtgccggggcggcgcgtgccgtggacatgcttgtatgaggctgtgttgagatacagacattggatccaaacttcggttcttttccatcacatcaacctttcatacatacataacttttcagtcacatcatttctaattttaaccaaaatctaaactttgcgctgaactaaacacagcctgagtataggcacgaataaattgtaggaggttccaataatcaaataaaaccgtgaatgcaaattaaaagaatggatacattttcccctttatgctcccgtcaattgatcacttgccacacgttcacagagtgagtataatatgtaaactgttaccccactcaattgaattgatattgaattagaagagagagaagagatcacaaagccggatgcagcacaaggtacaacagacgttacaagataaagagatatgccgtactaaaggttgttgtggaatgagcggaaccctagggttttctattcctcgctctcgccggtgttagtggttctcaaatccatcctgcaggaaggccggctctggtcatcggcgggtaccgctttgtttgggggcctactaggagcttagtggggttccctccaccacaatctccctctatatgggagcagcttctctcttgtagtttaatctcagtagtcttttagtttttcacttatttttcatgtcccccggcgatgacctttttggttgttgcgttgtgtacttgaaactctgcttttttctaatatattgatgtgcaatctatttgtaataggatgtgtcacatccacctaaaatcccttatattatgggacggagggagtatttagcatggttgcattcccaacacacactttcataagagagtttttttagttaaaatatttgtaatattcaatatggaagcttgagttcacaattgaaaagtttcatgtgatctaaggcattgtttagttcccttcaaacttctaaaaattacgtcacatcaaatatttggacacatgcatagagtattaaatgtggacgaaaaaaaatcaattacacagtttgcatgtaaattgcgagatgaatcttttgagcataattacgccatgatttgacaatgtgatgctacagtaaacattgctaatgacaaattaattaggcttaataaattcgtcttgcagtttataggcggagtatgtaatttgttttgttattagtctatgtttaatacttcaaaatatgtgtccgtatacttaaaaaaaaatttggcacacgaactaacacagcctaacttgaaagctttggttgaaacttgaaagtgctaaagtgtgtgctggcaattcgtctgcacgtactaaattgcaattctcttgttatagctaggagtatggttataccagcaaacataatttagccttttgatgaggagcacctatatatagtaccacattccgagtacctttaggataatctatattgaaaatatcctaatactagtattatcagtactagtaaaaaatcttaattgttgatttatgagttttacaaataaaagataaaatattttacagcaattaagtggtaatagtataaatagatactacaatccataatacgatcaattaaaattaattatactactaatcataaagatcattgtaaaacatctccagttcggctgtatttaaatccaaagtttggatcaaacttcagtctttttccatcacatcaatctgtcatacacacaacttacatcatctctaattttaactaaaatccaaactttgcgctgaactaaacacagccttcatatacatcgaccacactgaagttcatcaaaaccgtacgttcgtcaaatttaagaaacataaaacagaggatatatgcaccactgcatgtaaggcaattgcacagaaaaccttgtgctagctggatcgtatgctacagtagactgcgtaggatgcattggtactgaaaaaaagttttgttcagaatgcatgcaaccgcgcgcctaccagcagtctattgtgtccatgaaccaatcatgacagaatatcctcgcgttcccgagggagaaaaatcgaactgaatgaagctagagtttacacgaaattcgaataaaataatccaaatgaactaggagtatatgtgcattcatatgtgtatttggtttccttctaatatactccatccgttttataatagtcataataaaaaaaaattagatgtatatgacacatccatccaaaatctcttatattatgagatagagggagtaacaccacgtaaatccatcttatgtcgttacaaacacccttttattcttataagtagttaaaataaaacccgtattttaaaagttttagagggtgtctcgtaaagacctgtttttgcgtgtggttgtgatgtcgcgcgcgcctaaaaattgtttcaactgtttacagatatttggggatagacggttgctacatccatatatgaaaaatacattttagctgtttgcaaagactttctgtagtaatgtgagagttcaaaaaagaatatgggtatttggtacatggagtatagaagtcagctaaacctctatctttctttcccctgcgtaccaggctaccagtagcttacatttcttctttgtaatttctctcatcaaaatgcaaggttgaaaaggctatatacctactagctaatagtatctctcaagatcaaaacattgtcgaatcacggatcaaaataacgtcagatttcaccattcaaacgcagtactgaggctatgtttagatgctaccctaaaatttttcatcatattatatcaaacgtttgaacacctgtatgaagtattaaatacatgctaaaaaataactaattgcacatattgcgactaatttgcgagacgaatcttttaagcttaatgacggattaattaggcttaataaattcatctcacggtttactgatggattccgtaattttttttgttattagactatgtttaatactttaaatgtgtattcgtatatccgattttcgatgtgacacggtaacaaattttacccttggatctaaacacagctataaagcaccggacgaactggattattttccctgtcaatctgatcgacacacacctctcataacgtaacattattcacagagaactgaaaacacaggcaagtttgaagaagcaacatggtaccaactctcacatcacaaccacaaaccatgccaccaccatggttgcctccaaatacagctcaatgaaagcatcaacatgcatgctctctctctctctctctctgggtatgatgagagagaaggcttgcagcttaactaaaggatcggagaggagaggagaagaggaaaaaagcgattgccataaggaggcgcctgcatggtagtacgcccccttgcgtagtccccacatgcctctcttccttctcctacctcgtgtgtcaacttcacttgtccatctccaaaagatatccatgattctccctcagagcgccccaacctatatcaccccccctaccttccatagctccccttccctagctaccttcactccatccttctctcctccttataaaccctcatgtccctcctccacccagtccaaggccacaagccctttcttcctcttcatcttgatcttgatcctcttcttgatcttctacttcttcttcttggtttcacttggcatccgtttccatggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggtacgttgctgcgtcatggctaattccgatcgctgcttccctgctaagctgtaatgcgcgagccggcgccgagccgccgatcgatgcttctgcgtgtgcaggcgcgacggctccctctttcccgggcttctacgtcggcaatggcggcgccgtgcagacggatcaggccaacgtcgtcaactgggactgcaccgccatggcagccgagaaaaccttcctgcaggtatgatcacacgtactactacctcctccaggtgtgtgtgaattcaccatgcaagagcaagctaatgtgcaatgctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtgatagagctgttttgccttcatgccatgatgccaactgcttgatgagaagaacagtgtgagtgtttctgattgagagagcaatggtgtccatgtcctagctactagagagcttagctagaaggaagcatatatagaagcatgtctgaaagatactatatttatatagctagggagtatgcagcattataacatgcatgctgcctgtagaatgcagtggtcctcaactggtagtgcactgcatgctaagttgctactactaactacactagtggctggctggttgtgatgtgtttgggcacagttgtgtcaaacttgtctctccctttgatggcttccagctgaaggaaaaaagttatctatatctctctgtctgtctgctgtttactactgcctggttgctcatgctcatcacctgttgagatttttctcattccttttttcagcaggagtataattttcgctttttgtactgccagtttcttgtttcagaattccatgtatagtagcaagcctgggaccactttggttgaacttgaattgttggctagtgttaggaaatggtcagcctttccagtgtgatcatcacatttacttctgcagtgttggaaatgctctcgcctgctcacgtacacacattctcgctttatgcctttttcatatctgatgatcagacaaagcatatcgtcgcaatagctgttagcacagtgaagaaatgcaagtttttcttcgatagagatattaagagaaaacttatatatatattttttgttcgatagagatattgtactatatactatgaccctatgagctgcgattataaaaaatgaaaatgatcctgaacatttcagagctttctgaaacaaacaaacaaaaagtatagtaggagttcactcatagattaattacttacaaagcctaagaagcattcacaacctaattacttgaactgagagcatcatttttaagatcaaacatagctgaggaattggttccataatattaccccctcaaaagatagtacaagtgaaagatgtattaccacgcctaagtcctaactactgaaaacttacatgactgaaagtagctacaatataagaacatatgaaacgcttgcacgatctgctcttggttctaaaaaaaaaagatattacagctcttttccagctgagattatcgaagaatttcagaacaatggtttcatgctacatgcttccctcatgtcaatagaactgaaggttggccacctctttgtctctgatgtgaccatgctgctccccaacaccagctcaaataaacaagatgggatcacattttcctatgaagaccatggaaaaagcggtgttttcttcttcttgagtgctttcgatataccctggacataacgtgcggcgagaaataaacctagattgacagaacatagagatgaagtcaaacagatgtgtgcagtatcctcaactgtgcacactttgtaagtaatataataagtattactagtaagtaatatcctcaaacagatgtgtgccatgtaggttaaactgtgtcatatcatcaaataagacaggcgctcaaattttgtactagaatgcaaaaagaaaagagaaacagaaaataaaggatataactcccaacaagcatatgtgattaaaaacatttaacagaaaattgacgaacattatggttaattaaagcggatatactctggtattcttcaataaaagaactaccttggagttattacaaatgccattagacgaaagcacggaattgtcatctatcaacttctcattttgatgtgtcagacagtagttatcccaaatatgcttcctggaacaaagagaactaatattacagagggcatacataacaataaaaatgcataaatcagatttcagatgttcacaatatccttaacggtgggagatatcgacaaacaacatgtccgtgcatttcagttactatgtgtagggaacagatggaaacatggagtttgcggaacggattcagatgaattatgaaacaaagagatcgatgaacatctagctcacatataacgtattctgtgggctgtggctcaaacctgaagcaaacaaagagtcagcctattcaggataacgtataactcttatatcagctattctgtgggctgtggctcaaacctgaagctaagtttctggctaaggctgtgttagcatcagggagacagaatctcaaactagttctatggctacaatttcaacacaacatgttatttcgttgcttcctttaaaataaaacgcattattttgttgtcactagtcatctggtaatgcaaatgctctggttgtacagaagtaacaaaagttactccttccataatttatagtttagcttaacaaacagccatacttgattccagggattgaacttacccccagcatgtcaggcaccatatatgcaaatttagtggtagtagtgttgggatctctttccagtgatcactacttgctaggtaaaagaaatgcacaagcataatcagcagagaagtgtgatccttgacagggtaggacaacaggactgaagcttcctaaaattaaggaaatatgattatacctgtgaagggatctgatagttcttgaaaaaaagccataaagaaaaatagaaacctagaaggatcagcacgatcatgattataatttacttagtttcaactgacaagtaataagatatggaggacctgtctataacctcaactaaatgggcttcactcattatgcatacagattcaggcctacaaaagttgagctcaccaatttgctgtaagatcaactcaaaatcaaaacaaatttcagcttgggttcatatggggtttgagctaagctgcaaccctacaaggctgcaactcaaatcaatctcatatatcctgtgactctcactctttcagcatatataccccatgacatccttatgcacaatacctctggattgatcaatacgttgctctagtctcccttgtaggagatgctagacagcgaaattacattgcaaatgtttcaaagatcatttagtgatcaggacaaataaggttaccatgagtgaaagtaaatggtattcatcgcaggatatcatccaccgtagaaaggagaaacaatttgcaatcatcacattgtttaaagagatgtgggctttaccatgagatatgacgatggcccatcttttcctgttcaatctcatccgtcttcttcctgatagccatcttcaaatccttgacagtggctgtgttcaacattgcaacatctttcacacacacaaagaagacattaaaacgtcatacgatttatgcaatctactagtagatgcaaattaaccaaacaggcagtgaaatgtggcattcgaagggaccagtaccgaaggaggtgccatccagcttgacgacggttagccgcatggcgctgccgagctcgaggttgatcagcgtgtcgacgtcggcgagggagggcttcctgggcacgtcggcgagtatggggtcgtcgaggagggcggcgagcatggactgtagcttcgcctgcttggcctcgctgctctggtaagccgcaacctcctccggcttcgtagagaccgaatccgtcgcctcctcctccgccgcagagaacgatttcccggggtccattgcgtttccgccgccgccgccgccgccgtggaggacgaactctcgccggccagtgctagttgggccacgagcgtgtggcccattgtaattaattgggccgtagcgttattcctgcggctgcgcgttccagccgttggattggattcttgagcaatctggacggagatcctctcgtttgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggtatagcaagcaagctctcaacgcctctttttttgggttccctaatctcaatctgctgcttggattgctgaattagtgaataatgctgggcttcgatggtggattttctgtcggttgtcggctacggggctgatccagccccgttgccatccccggggagggacgcgccgagtagagcagcttgcgaagtggttgcggccttgcggggagggacaccgagcagagcgttcttgcttgctggttgggctgccaatctctggctatccgtgatctttgatccatgagattctgttgctattccttcacatggaggtttgtgttgtactttgggcgaattcggatggatgttggattaggcagggttttagagagcttgggttaagaatcctgcttactgatgcacaatagaattaaggtggggattagaatttgctaagctgaaggtttgagatcagggggccagcactgctccttggttagcttgttaatttgatgatgaactactagtgatcctgtagcatgcatctctgttttgctctgtatactcttgttagtgtgattgcaaggtggttttcttttgctactgggcagtgtactgttgattcaaaccaactcatgttcaggccacctttagctgctaccccgttgtttaagtcatcccctcctcatgtccaggttgctcccagtccgcagccacctcttcctcctcactgcattgtgttccctaggtgaccttaggccttccttgctgctacctccacctgtctctgatcccgagtcctgaccacccccttcctccttgcattgccatgacactcttttgagatcattggctgcatgtacatttctgtctttggctttggtgcagcttatcagtaaattcgcatgccaaacttggtggttgcatattgcagcactagagtcgatggaatgacctggtgacagtatggttaactatattttaaggtctaacaaaacggagtggtcctatatctagcagtttctttcagttagtaacccatttgttcaaccatgagtatttattgttttagaaattgttctgttgatgtgcctgttaagttcttcactggaaagtctgtaatcagcattgcttctcttacacatactatgcccaaagatcatagagttgttcgaccaacagctgaatagtatacaaatggatttttttttctgcttgttttttctgttagtgatggaccagcattgcttgtttctgatatatatttgcattctgctatggttccacaggttagcattcgacagccatggcaaagcatcatcctgatctcatcatgtgcaggaagcagcctggcattgctattggtcgtttgtgcgagaaatgtgatggcaagtgtgtcatctgtgactcgtatgtgcgcccatgtacgcttgtccgagtctgtgatgagtgcaactatggttccttccaggggaggtgtgtcatctgtgggggggtcggcatctcagatgcctactactgcaaggagtgcactcagcaggaaaaggaccgagatggatgtcccaagattgtcaatcttggaagcgccaagaccgatctcttctatgaacgaaagaagtatggttttaagaagagatgatcaggaagttggatttgtctggtccatttcctcgctgtgttttcagtcgcactgatatggttgttaaggacttaaggcggacatctttgtattctatggaatatggtctagattcttaaggctgcatgtgcagtacgtacctgatgttaatgaccatgattgttgacatgagatgtgaaccgagatacttttaagtcttataattatgtaagccactgattgtagggaataagtgaatgctttagctgttcgaacgacctgatatggttatcaactgggaagcaatgatacttatctaggagctgagatgcagctgaggttaggatacaggttgttgaagtcaggataaatgttgttgaagtcaggatacaggttgctaggaataccaacctaactcaaaatatatccttcagtcattatcctcgttggatggatgacagagttcttatctgaaacgtctcctgaaacactgatctaatccattttaaaacaacacgacgagacggtcaccagagtccatgattgagttcaagaacgaaaccgtcaggcacatgacctgcctccgtcacggacaagggtaacatggtaaacacgcaaagcgttgcctagaagatccggagaagtttttttttaaaagaataaaccgctaaactaagcagcccaaaatagcgcggaaagagagcagaaattacaaaaaaaaaaaagagagagagaaaagaaaagcaaatcgacgcgaagaaataagggcaaagccgccgacgcgagagccagcccatccgcctcaccacctcccgtccctcttccgctccaaatccaaccctcccctcggccgctccgcttgcgccgccgccgccgccaccggagcgacggcgagggagggagtggggagaagcaggaggaaaccccaaaccgtcccgatctcggggtcgggaacccgccgccggcttttccgctcgttcgtccgtccgtcgatcgcccgccccaccctatctagggtttcccgcgctgtagatcggatcggttcggattggttgcttgggtttggagagtaatgatggggtcgaggcgatccaggcgcgtttcatgggcctccggaggcaatctctgcaaggtactgtgataaaaacttgccaccgccacggcgaggagacggattcgcttatcctgtatctcccagttttgttgcggagatttgcatcgtctccgtgcagtgcattcgttggagattgttttgctctgctagctcgctttctacccttgatttgctttttgatttagtcgccttttgttcaaactccgcgaaaaatacgatcaaatacgatctctcaattttttttcagtggtaaatgtgtgaatgcttacaaaaaaaacgaacatgctattctcagtttgcaaatccatgagcagaagaatcgactgagatggatttcattctgccaatgatgcagaatttctatgctgaatttgcagcgaaaaaaagatgggggaacccccagcaaatatcagtaccgaaccacaattaatacgcagataatgaaacaaaaaggacgataacaacatgatacctggtgcatgtaaactatcattcttttggggaatatgtcccattggtgtatcattcttttggggacaaaatatgtcccatcggtgaagcaagatttagccatttgatcttcatctagaaaattatgtaccaaagaatcttttttttttcatattcttgagtggaaggactgcatgctttaagattctattcaaattgtatagccagataattttaaatggcatttgttcacaattttcgtcttaggttttttataatttttattccataggtctataccaacttctgttagtgttcacatgtaatgctgaattttatgccctagcaggcagcaagcactgccctaaatatgaatgaatttggggcttagattttcaatagacaccgaatgagtttggggcttagattttcaatagacaccgaatgagattggggcttagattttcaatagacacctgatgcaaagcaggtcatgtctctgacacatcagtatgcatgataggacgtgtatttgagaaatgtctcattatttaccctctataactcgaataccatgaattgtttagcttgcaaaaaatgctggattttttttacttttttttttacctttaattgactaggcattacatatatttcagaattgtcatatattgggatgaaacacaagcaatgttaatttgaagcatgtgactgttgtctaggttcaaattgttaacttttatatattaaaacctaatctaaaggatgttctaatgtgttaataggatacaaacaaaaataattcaaaagtatggctgtttatggtataatatattggattgtgcttcattttgggctcaagaattgaactgtagcactacactcaatagtaatgtaaacatttaatcaggattgtgcttcattttgggatcaagaattgaactgtagcactacacttaaaagtaatgtaaacatttaatcaggctatctcgcttcgtctcattttgaccatttcctgccattaatgactctaataaactttgatgattcaattcaaagtgtcctatagaacttaatgaccaatatatcatttttaacatattaagctatgtggagcttatatcacttgttaacacatgactttaaaggatgaaagtaagacatgaaacaaatattctatgagttatatgattcatctcaacctttttttgctttgaagtacaaagagtgatctctaattgattcagcaattcacaataatctctaatttattcagcaattcacaataagctcatgagatactaaagcatttatttcaccgaaaccaagtaatcagcatatgcagtaagcatccttcaaaggccacgtctatatatatgtaatcacacatgcatgttgcttccatgattgttatatcaccagtattttttttagtgatatcaataccatgctatgttgtgataagtccagagtccagagttggctccttgttccactcatccttatgctatgttgtgataagtccagagttgactccttgttccactcatatcctttttgtacgtatggacggataactgacaaccgtatgaaagtgcatccatatcaccaatacaacactccttttccccttgcacgtgcacctttctttcttcgtgctataatggtattcattgttgttttttaaatggatcaacaatgtgaacaaaatattcctactgccaatccagctaatgaacagctaaattggtattcatatcttaagtatcctgtttgtgagatgacatgttagttgcagatttacataggactgaatgaagtactttcctcgaatcttgattgctggtgcctggtagctgatatgttatggactgtgaaatctaagaagttaatatggatttgcatatacaacgtgtcaaatcatgtatatattatctgaaagttgattttagcacttcacattggccttgagtgtttaaattgtacagattgcgggaataaaatttggctgatggtttagtagtactttgaataaatgatcaatagtaagatggtattaattgtaagagatttttattggtgttctagaattttgaaggatggtcatagtcttctgttaagaaacatcttaaaactagtcagcaattgtgttttgtggattcatacaagctgcaatctgccggctgttagaatgtatgttaggaaaattaaaagaataaatagttgaactgctgaagtagccctgaaatggcattgaagaggaagggtttagttcttgtttcttttcatcttgtcttggataggcatataagatatataaaagtggcatgaaggtattaaacaatccttttattttactggataataaagaatggttttaactatcctggaggcaggtaggtgctaagcaagtgattgaacattggatggagttctttcaaaaaagaaaaaagaacattggatagaaactagctccttgctttgtttgaggttaatgtctgtcacaaactgttatcatgccttaacattgtgaaccctcctaaaaaaattattcttttttgagacttcattgaactatacattttggtagtcagcagaagattaaatttaatctgagctgaagtttttatcacccagcattatagcccttttgatgatacgatgaccaagttcttcaaatttgttatttggctcacagaatgcttcatgatagtgaatcatcttattgcccatgttcttcggacttgattgtctcgtttaatgtttcttgtgtcactaaagcattgtaataaattataaatactgaacaaccttgtatcatgtgtttgtgtcaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatgtaaggctcacagttactgttgtgttggacaatagcaagacaagttcaaagattactgaaattcccaacactctcttgattgcagatagtattggagcaggattggcatattgttgctggagaagaaagtagggagattgaaattcaaaatgagagaataaatggagcgcttgaggcaatttacccacgtccatcgaacattccgccaaagtaagcaagctccttttttttcattacaagttcttcagatgtcacataccattttttataatgatttttttgtgtgccaatccagcccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaa

SEQ ID NO: 32353 - DNA, 19971 bp, Oryza sativa
  unsure (1)..(19971): unsure at all n locations
cactctgcaaatactagtgcacggatgaagcgtagtcgtcttggcattcattgtgccagtctattcttaggtgattcggtgatttttcgtgtattgctgcatgaattactaagtaatttttaatatatttttttacaaccaagatagaagtaaaaaagaaaaaataataaaatataaggtgtatcagtacttatcatgaaacaaacaaatgataacctaatatgaaacatattgataaatatatgttaaacattataaaaatgatagatagatttgttaaaatattatgcaaatgatgtgacgggtgatgattggatatgtttgtatgttaatttgttgaattaaataaattgtagatgatgttgtatgcttgcatgaggttaaatatgtaattattgttagtgggtgatgatgtagcatggttacatgttgagttttagacttagtgggttataattttatagatagtatagatacatactctttttccatatttcgctaacttgtagtaaatttatgataaaactatatcaacatctatataaaatgtgtgttgataatgtattttagttgtcgttataggtgttcataggtttttctataaatttagctaaaattagagagatttgacgtaggataaatcatatactcattccgtcccaaaacataagaaacttggactggaggagaggagatatttcctagttatacgaatcttgacatactgtagattcatactattatgaaatgtcttatccgatacttagttatattttgggacggatagagtatgacacaacattgcctgatcgaccaccattggcgcgccacctagtcaatcgtttgagctctctcatcgttgtcttcttaatttttcattggatcctcctcctttaataagaacgtgttttcgttggagggaattgttaattcgagggtaggggttcttaattacgttgtttggatggcgaagtttaagagtaaactctcactttttcaatacctaggtaggacatataactatgagggaatttcgtcgtaagtacgttaaagataaatctgagccggacatcatcataaaatttaattctcactcgaactttccgtgattctcatctctactaccaaataaaggatgatgagaaaaattgaaactttcatgaccaatctttccaccaactcttaacatgttgagcatactaaaaactcaagaattttggatagtttttttttttttgaaacagtagacggtaggagttctaccggataatttagaagagaattgaccctatttataaggaaaactagtcccaaaaaccatacaactgtacagtttgctaaagggaaaccgacaaaaccttacattgaaaacatgaaaaacctgtgacaaaactacaaaccacagtacacaccgagggaagagcaggaccttcaagacgaagcctccaaggaggtaaacaacgacagaatccgctgtcgacacccacccaactgagctgggttttcacccaaaaggagagagagtccacaaggcaacacctccaaggagaaaacggcgcccgcaggtgtcgatgtcgccgatcttaggagaccagactaggctttcgtctaagacttcctcaaaaggtgtagagcctctagaaaatcagagctggagtgttgaatgttatnnnnnnnnnnnnnnnnnnnnnaattcaatgcaacagctccgactccatcgaaacataaagactctagcatcgtagaggacaagaattttggatagtcaatggaggataacacgggctttgaagagaggggctaatacgcatgtgtccatgcacattaggcccgtgaacatgtcgtggcccaatccaagttcgaaagcccatgtgcattcagcctacaaccacacgagcattcgacttggttgaattttattttaaaatataaacttttagtatagaaattatatatataaaaactttatgtgtagaaacttcggtatagaaattttatacatagaacttagatgcaaaaactttgtacataaaagaatatttggtatagaagctttatacatgtatttatggatcaacccgagaaaggaaataggaatgaactaaacccacacgctaaggaaggaaatgagcgcaagttgcgcaaccacctgacctaaggctatgatctataaatctttcccaactttcaacggtgtaatttttaaaaagaatttaaaaaaatatttatagaaaagtttttaaaaaattatattaatttttaatttttaagctaagaatatttaattaattatgcgttaatccgtcacattgtttcgcatggggaggaatggatttgaacccgcgtttgcatgccgagcaccgtgtggtggtgttggcatttcgtgcattaggaattgggactgtctgtataactttgtgggccacatttggatcgttgatgtcagaaatttaaatggactttcctcgcaaaaaatgcttcagttcgtaactccatttgattttgttggccagacatgattgtgcgtctctttggactgggcctagcgggttcattggtttgtttttttttctttccctgcgcactgacacacgggagtagaagacaaaagatagagcaagtcaatttcttgtcgacagaacctcatacagcggtcaggcatttctcactccacaccaacatgaacatcaatattggcaaatataacagaccgctgttgcattacaagtcaagatatattacacacacaaatcattcattcattcattaccagtcaaataacaacaaaccaagaaccaacaaatgtacattataggaaagctgttgctgttcttctcccaagttccaaccataccgagtattccaacaaagaataaaaaaactgacgaattagatggtggtgtgcggtgggaaaacaagcacaanttctgagttcatcttcatccaaaggctttttatggcccttcgttaaaaactcttgctaggggccattcataaaaaatgccatttccaatttgcaaaccagaagttcttgtttaaatatatgtgcatcatggatggaaatacagtctatcgtattattctatactgttcaatagatggtaacacaancatagcaccagcactggtagatgatcatantgagcaagcacaaaaccacactgaagagagtaaaaatataagtacatgataatattcagggattagtgcattaccatttatcagtaatatagccagtaataaactgaaaacaatgaacattacatataaaggacgaaaatgttttgaggcgacactaaaagcaccactgaagagatcacaggtcgctgggaatgttcagggaaggcggattaccggtaatgcccaaacactacatttctatgttcatcttaattttaatgttatgcagttccctgaaatagcttgtgtatgcaagtgggtgcttcacaaaagtggacctcacaaattagagtagagtttaatgacctaaactgcatatcgaggctacaagatatttgttgctacagtgatccagagaaaaacaggtaatcattacaaatcatcttcgtaaactaagctttcaagtgcaaactgatcatactaagatcataggatgatagtagcaactagcaaagaatagacttgtgcgcacttagtcacttaccagatgaattgggaggaacaggaacagcaccattgcttttcacattctgctgagcttgggatgatgatcgttgcatgcgaggagatgaatcttgcttaccgttagtcatgggcaaagagtgccttttccttggattgttgtcttgcacatccgggcttaactttggtgatacactagcagatgcctttgcccttgcagattctgtaaactgcatataacttggcaatggagtgctgttgcttatgcgaggttcttgatcaacatgatcagatttaaccttgcctgagctctctcgcctcccaagtctgtaatcctttgacagattatccatgctgctccgtcccacagaatcgctgcttggactagttagtgatctcttgcttacatgagacttgggccttttgctcttgctttttttggtgttaacagagacctcacttgatggtgtcccatgagattcagcaaaggtagttcggctcaagggagtaccttcaggtgtcttcacataagatcctacagatttttccagttcatcatgtaaatcaggcttttcctgtcccagatgtggttgttcaacaggcacaggatcaattgcattggcagcgatagcagtgtcatcagtttgtacttccttttctggctcgatagctcctccagaagtgttcacttcagaatgcaaaacactgttatccttttcagcattatcaccaacatggttcctatcttccagggatccaatctccagtacaatctcgccaccatcagcttctgatctatccggtgagtcaagtgtagaggagattgatatctcagttccacattctgaagcagcaactacgattttaggatcatgccccactgagctctctggtatgcttgtgtcattactttgcttgggtgagacattgtcttgtgaacgaggagtatgtacctttggtttgtttgccccatccagactgttggacctactgaccgtcaaattggaagtcaactcttcaaattttaactgtgcagcagcaaatgcaggattgcatgactttctagccataaactttttaccttccatctccgaagtctgctcagttttatatgcatccatagtatcatcaaaggaagattcaggtttttcaggaagaggaatgggttcccttgatgtatcagtttgagtagattgttcaactgagacctccaaaggttgttccgcaacattctcagtctccggttcagtcaatttttcaacatcttccttgaacttttcaatcaaatctggttcaggaacatcttcaatttccattccagaagttctatctggaatgcatgcagaaacctccaggggatgagaatcagatggccttagtgtctcttccgcatcatcaggcaccaacttcaggaaagagatgtcagaatccaaaggaagggtattttcctcatgttgagcatctccttttattttctcatccaccgactcgttattctctctatcctctagcaagtgtcccccagtgtttggtggaatcatggatgtccatctctccatccatttccatgcaacatcaggttcagaaggatcacattttatgtgaatggattttgaagtcgacatgctgtccatgagctgacagaaggtaacaaacatgagaaaatccaaccaagaactaacgtatgataatcttagttaataagggttctttcatctaaccttcagagcaaatccattattgagtaatttctcacttgaagaacagatcaaagagtcctgcaaaaagaaatgtaaaatcatgaacaaacaagcaaaatgttcaagcaaggctactattcagtattgtcacacagaaacaagaattatatacgtgttaagtgcagcagataaggttttgatccaaaattaatgattgtgcgtgcatggaattcaacatcgagatgcgagatatccaatcaatgtagcaactaaagtggattgcctccgcacatactaaaccttaagatcaattgccaacaagaggttgacagctttcaggttactagaagaaggaacttggcgaaggaaggataagaagatcatagacttcacatagcatattaaacttatattgaataatattaaaccaagcttaactgactggcagcaaaagagtttatactgtctagatacaatgataccatacgtgtctaaatgagagtgccttgaatacctgaaactttcctccatattgctgtgcttgatgaacccggacaagtccttgcattttaacaatagcaagcaagcattgtaatgattctgcagcctgcctcctaacaagatgcccacgtatcacagcttgcagtttcacaaggtccttatcatttggtagttcttgctcttcctatagtcatgtaaatgacaataatgtaataacactaacagaaaaataattaataaatataaatagtgggaaatactgcaacatacagtgtgcactctgatgccagactgaatgacagcagcagcagtctccgcacaatcttcctgatggtcttcactgcttccatcaaagagagagacggtttcctcctgcttcacctcagttgatgaaacaaaaatactttcatccgtcttatcagtgtgttcctcaacatcattatcatttggctttactattggagtttcagttaccctttcagttggttcttggattggcacttcagttactctttcagctggctgctcaattgacctttcagttatctggtcagctgacttttcaattggttcatcagctggcttttcaattgattcatcacctggctgatcaattggcttctctatcagtttttcatcaggcatctcttcattcaaaggcccctcatctggtttatcttgctgcaaaattttctcgtccggtttctcttgctgcagaattttctcagctggttcgtcttgctgcagaattttctcatctgatttctcttgctgcagaattttctcatctggtttctcttgctgtagaggtttttctgaggcataggagtaagttgaagaatagatgttgcttggagcaatttcagcttttgctttgctcgaactaagagtttcaggttcagatatatcagaattcttcaaaacacgatgccttgtagacctcctacgaaagctccacctacttttatctgatatggccttgttctgtaaaagccaacatttaacagccattagcatgattcatctacttgatataaggaagagaagacagatattctgtggtagctttttcacccgagacgaactagaagagatgttacaagcaaaatgcaggtaatgagggctagtttcgtgtatctgaaatgtaggcaaccaacatacttctcatttaatgaagcaaaatgtcgttgaccaggaagggaaacaacacaaaaagaaaggaagtggcagataaactctattagttttgaaattaatgtaccagttcctaataaatctccccaaagttttcctcgcaaaaaaagacccaaagtttgttaatgccttactggcgtgatatatccatcaataatcaatttatttccaaaaataccagttcagtaaataaactataaaaggaggtaagctaacatgattcaggtaataccttggtgaaattatgcactacttaatcaggagtatttttaatttgccaacttctaataattgcaggtggaggcatagaatcctagcaaaaatacatttggtttgctgtcagctatcaccactgatccagcaagaaaaaatttgtccttttgcaattatatcaatgaaagagagctaactactctctcttttccctgaacatcaaaaagagctaactactctcagtcactcactatagttggtacagatcctctaggctgtcccgtgaaaattccagatcccatttcaccaacactatggtgcggctgtctcctacgattagaggatttttctcgattcaacatagagattttatacgatgagcgtccagccaattagtgaaaaatgagctgctccagagtccagtgaactcctccccacactgagattcttggtagggaaaaacagtaatcaacagcgcaacattacaaccaaagtgtcaaatcatgggggacaaggctagcaacactcagctccgaggaagagaatgacagatgccaatcatgcaacaagacgagagacaccatacacagtgagtagcactttgagcagcagataaacaccagatcccttcctgacatcttgcatggactcagggcggcaagagtagcagccataatattccagctgctgcagctagagccatgcagcaacagaagagaaggggtaaaaaaaaggaaggaaattgaaatcaaaattgagcctttgaatgaactcataggacgtgcgggaacagcacgggatcaccagccaaaaaaaaaaaaaagctctcattttgctggctgcgtcttgctcgccgccacgaatcaaccccagatctaactaaaacaacacgcgcccgcacctcgaccccacgcatcccactgagatctgctgaaaacaaacgcaccagctcgagagaacccccccaaaagaacaaaaaaaaacggcttcggcgagcaaggccggcgcggcggcgcattcaagcggaggtgcggcgcgcgagtacctcgtcgacgtggtcatccgcgtcgccgtcggagccggcggacgggtcggatccgccgccggcgcaggcgaggatcttgaggcagccgttcttgggcttcgtcatcggggtcgctttcgccgccgccgctgccgccgccgccgccgcgtcggcctcagtcagtgcagcgcgtgcgtgcgtgcgtctggagcggaacaggatagggagctgcgttcctctgacttgtttcttctctggctttgcgttggttttgctttgcgtttagctgcggctctgcttgtttgcttgcagtttttatattccggaggattcgggccctccgctatctctaccttgccgctgttcctttctcctccctttttttttccccttctccaatgcagctttatatgctttgtttatttcttttccttttattaattaaggttaattaattaatacgtaattgaggttttaaaaaagttttgcgagtgattttatatttgtttcttttacctttgcatttcatccgggagaagatacacacggaagacggtatacgcgcaagacggcgagacacatagttttcgtgattgtacatacgcaagagtactagacacatgatatacgtgggtataggatttataagcctctagtatattaagtcagtaaatgggttatcatatgagtgcttagatgttctatagcccaaccatattggatctttaaggccgtgttctagctttcgaaggggtcagaaacatcttccccgtgcacataaaacggagtgatatattaactcatgattaaataagtattagctataaaaaaacttaaaaatagattaatatgatttttttaagtaactttcctatagaattttttttataaaacgcgtaccgtttaatagtttgtaaagcgtgcgcgtggaaaataaagaagataagttgggaagaaaagtactcgtactaaataggccactcaggttttacattttctttttttcccatcgagaaggatgtgtatgggggttgggatcatttcctccctaagggcaagtataatgggaggttctaagtcggctaaatgctcaagtggaggagagatatgagaagcaggctgtaaacttacatctggcttggacacaagaaccaaaaaattttgtgagagaggcaagtgggccatatatattaattataaatagctaactattgtatgtgtagactaagagaaggctgtaaagaaccttatatgcaacaattcggctatattattagccttgctctaattgatctgcaccttgatttgagggttggcaagagaggagaagggaatcggtgagaaggtaattcatagatttaaaagatagcgagataaattcgacttgtttcttaaaaataacgctagcacgtgtgacacaccacatgacaatctaatttaattgtgacaaaattagtccctctaattccgtgggacagtgtctcgtcgctgcatagctcgatctattggaatataccgcaatatatgtggggagttagcatctctcattcgatcgttgtcttgtaccacatcactcgtaccgtccttggaccgaccattaacaagcctaggcctaggggtgcaaacaaatgttgttcttcttcatggcgctggtaccgtcccgtccggccacgatccggtcagttgtgattgcaagtccacggcgcctttaagttcgcaataacaaggccattaatgcaagcaacaatctaactccgacgagcctagccatggcaagagcgtactttggtggggcttccgtttctccggccgcggccagcctattgttaccaagtacagtacacaggtcagcacttgttcttcccatagtcgtttttactcctaaattctcagtactgatgctactattaattaattgtaaagccgatcctgaccctgtcactgttggtaaagagcgagaggccagccagctgcatgcatgcggcgaaggcgatacccctgcaattaagcggctggtaagtacagcgaccttcgtaaccaacaaacgatcgagatgacacggtaccggcactaaatcgcggcaaaaaacggtacgggcgtcgacgtgacggcccggcggaatgctcgcgcgcgcgcggccgcgcggggcgggggcgagcacgagaaagtgcgtggccgcatgcggccgcggttgctgcttgcattgggcggcgttgggttgttggtggtggcggtgtggcggtggtggcgcggtgatcgcgcgagctttgctcgctggccgcgcgccgcccaagcgcgggatggggcccgtggttcggttggttggttggcgtttcacgtgagacacagtgatcgcgttcgagaaaaacgggagagcggagcggagaattcatcgcctccacggcctttttcactgtgttaactctcacgagctgcaccggccagaccagtcactgacactactgagtttctggcacggtcgtttcggtccacacgcggtcaagcgctcgacagctagaccgtcaaatggggttagtaatttatggtggttaagtggtcaccacgcgagcggttttgcacgcaacaacggtgtggcaattaagctcgttacgagtgtttattaacggtggtgagtgagtgcatgtgaaaacaaagtggggccacgtgcgcaacgaggggtgtccgagccactacgagcagctgcgagtggggccaccccgagaccaccgggcacgtgccagcctttcgcacatggacacgtagcgcgctgctcgccacgttacagccacgtgcgatgccaccgtaaacgttatctcctacagctcctgcctttgttctactctctccccctctctctctctctcaggaccagaaagaaacaggcagaaagaattcaaaggaagcatcatctaatcacctagttaacaacggtgtcgtggcacagtaattaacggcctaagcaagcgtcagatgcataaaaccataataagagatactactatatccaaacaacaaggtgctttttggcagcgtgcaatgatgcttacactaaaggcatcctacgcgaaaagaacgaccggtagtgtggattagattagggcagagcatgagcatatatggagggatggaccaggatccaaaagcagccatgattcttcatgtagtggtggtgctaccttttgttttcattcttaatatcaattgttgtttccttcctactaccttgatcttaggttcttagcaggccaacatttgttctgaccatgagttgatgatcagtggtagagtcaccacctagctagatagtactatattctagcataatgccaatagcattgaggaagaattaatgctgaatttgatatgtgccatgaactatatgtagcagaataatttggtaggagtaagtagaggtgaaaaatacagttccagtgactgtgatcatagagaccaaatgtctagagctgtgatagtttctgaaattgtgatatgggatcagctaatgtgaggattaaactaagaaagaacgaaaggtcattgctctcttatttcctccccacttgttgaacttaacacaaagatgtgagaaactaaagcaagaaagcagcaagcacatcttatcccatggtccctggatagcccaaaagtcgtgcatgcccaacacaaagggggcacacacactacctttcttttttctctgctcactcactgaaacatatatatgggttgcatgtttcagaagtagacaagagtgattggaggcacacaaattggcctgcattgcaccagctcacatgtattaggtcagggtttgttgtgacagttcgtttattcttgttaatttgggaggtgattaattaggggccacatgaaaggtcactgtcagagagttgggaggcagtgacaggctactccatgttgcttgtggaggaaaaagagcaagtttgagggcacaggccatctgagaggactggagactactgccatctatctatctgaagatgaagacgagatccaacggggttctctgctttttattattgtctccaccagtttggacagtacatacacagattcagtatcaatcataaccttctttcatttctctctttattataactccggctaatgttttgtactatatatgaagctttcatatatatgtaataataagaaattaaataaaaacaatgaagatcgaattaataggtaaaataataaatgcggttatgacaaagaacaggtacaccatttccgtattgacatgatctactgtggttaaggttatgtgttaatgatgctcactcttgaaaggctgtattattattggttttggggggcctaaacggctaaaccccatcctaatcaaacgagctgtacgtggtacgtgcactaatctggatcctttttggtaatgatggattgatgggatagcgatgctatccaatatgtattcctatgcagcggcgttcgcgaaaaaaaaaatattcctatgcagtggaactgatgtggttgccatatcatttcttagaagactttacagatgcacaactgggattttttctactattctagccttctcgcaattggaacagaggaaattgggtccagttaattggctaattgcgttgttataaaataaaatgaagtgattggaataaattgtcagcaatgttgaaatcttaacggataaaggataaaatagttaaggaaaggtcaggcttcgatatcaaatgagatttgcctgtttatcaggaaattaagccaagctgtacctgtctgaagtctagacaagcttttggtggtatgttctatctaccggtagaggaaaattcaaagaaatttaattaatgtttgcccatatgctggctgtaccaggaatattcttatgtacataatagaataattaattagtccatggatttagaaaatttctagatagaagagaaaattgttcacagaatttttctgcttatacaagtcatatacatttgttggaattaaattctgtgcagtgatggatgacagcactatatatttaggtttcaggagatacacatcaatgggacagtttcatgcatgcaattctaagctacatactcaaccaacactagtctttgatgcattatatggcagattagtgaatcaatcgcaggctacgccgaggatgaagcaacaatgacaagataacccagctgatattgaaaccttgaagagagggggaaactgaaaatgacaaggagagttagctgatgagtagctctataacccaactttgtcctcataaactagctagcactcaggacaaggaagcttcacctaactggttgtggtggtattgaggcgatttccattcacgtttcttcttcgtcgtcgccttcttcttctttctgttgtagtagataggagagcgccatcgtctatctttccatgtttcctgtctgtgctacctactcctttgacaacgcctaaacacgctgcactgcagtcagatacaatctagaacgctgttagcaacggatgaatgtacatttcgttgccgtgacatgaccaatttgatgagtcctgtccaccagagactagaagatatatcaaattaaccgtgtgtatatctgcctcagttggtgtagagatcggaagttaattagctatgttttgtttttgagaaattaaatgaaatgtaagagtacgtgatcaagaaaattattcacattttgatttagttagaagaaattatcgaaaataatcagtgcttaaaagtatctttcacttgttaccatgcatagatgaaaatttccagtttccaataaccaccaaaacatcagcgcaggtgaagtttccttttgtctgtttcgaagacagagtatgaagaagaatttttacggccacctactacagtagatatatactatcgtcagtaaccaacaagtgacaagtattcagtaggcagcagcagcaccagtagataatgctccaaaattccaatcagcaccgaagaatctccctgtgaaatccggccaaattacgcaggtgacgtcgtcgtggacagcttcgttgcagccgcgcgcgactgatggaagctgtgaacctgcacactgtagctgctgctgctgctggtggatgctcgtggtcaatcatgtactcgaccggatcggacgcccacatgctgctgccaatggatcacggagaggaggaggacaacgccgcatgatgcatgttacccctactatactcgtatagattattgtctctccagccgctatactcgaattataatcaatctagcaccgttatactattcattagcgcgagctgtttgatgattttacagttaactgcagatcagcagatcggatgtcttgagagccggaagtgaagtcagcgtgctgccacctgcaaatgatctgtacaagtgtatacttagagccagtttaatagtatagcctactattaactttaattcatttatagccgatctaatagccaattcatacaatagttgcttactatactattaatatattgtcatacctattatacacacattgcgtcttagagtccgtgttgtaggtagctacaaatttatagcccgctgcttttctctctcatcttttatctcatgaaaatatatttatagctggctaatagtgcaactgctcttatctcagtagctcagatcagtatcacacagctcattgcctcactggtagctcgtggagtgagtgccgcatttttcttgcgagtattactaccacttcattcacatgcccgtagatccgtatatagccacggtacagttcaaatttatcctatccagtagtaagtaactagtaactacaaataaatatacctgtcactcactatagtagagataggattagatctagtcgaatctctcccgttctgaggttcacctcattctttatgtggcttaaaagagtggtcggttttcgactcttcttgttttagcatgacaaacatggctgtcctcgtcggcgttcttcttgatgtctcctttctgtcctttggatggtgggttcaccttcaaacccttcagttgtaagttgaaaggacttgattgctttttctatatctttttatgtctttcttcgcatatgctatgctcgaagtgtaatttgcccaaccattgcttttatgtaaaacaagctgttctctcagctttgcctccctggtacacaactcatgtgttttgtcctgaatcaataaaacacatgagtgcaaaaaaatactcacctgtcaacatacagcatctatatgcaaactctgacaaacattatcttagcaaagaatttcaaaatgtttaagaatacgacatgtaatcgttgcatgttaaacagaaccatacaattttcgttcactaaaatataatatagtttttagttatttgctatattattttagttaatgttgacaagtactacattggaagtgagggagtataataaatacgaaatgaatgacatcagagagtactgtactgtacagggagtttaaattagggcctgtatttgtagcctgattatagacaataaagttggcgacgttccacgtccataggcccatttaggcccatattactcctgctgggaccatcacggtccatgggctccggctccctctcctcgccgccgctctagctccagagcaggagccgctccccctggctggctgcctgccacgtactccagctccggacaaaatcgaatccggagccgcgagctcgcttctgccattctgcttccccttctccaaccaccctgctctctcctctcccccttcacagttcacacctgcgaccacgaggcggtggcggaggagacgaggcgcgccggggagatccgaggcactcgttgaccctgcgctccggcggccgattcgctgccggggacgccgtcttctccgtcaactccggcgaacggctgccgcgctccgatctgcacgtcgccgacgtcggtgagtccacttcctcgtcggctaatcctcctccaaaccccctctaccgaccccgtgttccgaccggtcccgcccctctccggccaccgcacgccccgtcgtcgtcgccggtgaccatgcgcggcgcctctgggtcacgtgaggcccgcgtgagggagcggagcgatcccgtgcggggcgtgatggtacagcatctggtaggaatattccgaaaaaaaaaaggaaaaaaatcctcatcctcatcctgtggcttggtagccatattatcgcttaaactagactagacacgggtccgactccgagggcaatatcccccaccacccatctcatccagagacgagctcctcgaatttgagggagtccggggagaaacctacggggtgatcttctggtccgcatcgggtcccctcccattgcatgatgccttctgttccttttcgttatctgcctggtgattgttcggtgggtcatcctgtccatgtttgtttaattcgatgctggtacgagtacgatgctagtggagatggaaccgcgcgctcgcgtgtaatgtgcaaacacggtgaaattggtctgcacattttgagagcgtagtgtgtgttgatcgggttttttatgtgcgagttttagtgggataggattctaggagaaaggaatgaagaagtgactttatatggcatctgccattgttcgctgataacattgatgccacctgttagttcctgatgccaccttgtccacccgcttgctgaagtctaaaattcttgtgtttatacactcttgctgatcttggcctcttggccccttagcccccaactaactactactgatgcaaccaagtttgtttcctgagcctccatgaccaacctgataatgccagtaatttaacagaaaatacgttgaagtgttgttcatagtttctctaaggacagctagtgttgggtataattttttgttatagttagtttttcctttatttcttgccatgttgagtttctatgtattaatgtctaatctttggcattctatgcagctgagcttttgatctcgccttctcgagacacatctgatatcgctgttctttttatgagttcacaagacactcaacatgaagtttttagaatacacccccttcgacaggtaatagttctatcctttgtttcttcttattgatgtactcttggtagcatgcaaattttacacaaacttattaactctactgtttgattcgttttgtttcagtataaatctgttccttgataatcttgaccttggtgattgtacgataagaggaaaccttgaagccttctcatgtaggaatattccctgccaagtctcttattgagtatatgactttaatgacaatgaagaccaaccttctaatattgatttgtaggcaagcacactggtaatgaccgtcgactttcaataagtctagaacatgaggtaaatatttaacatttttccctccatgcattatcaccattgagaccgctttaggataaattaccatgtcttatttagaaaattgtatgtctgttcatgcaaatcatatgaaaaccgaagcaaagtgaatactatcaaatatgtttgtgattataccgatttcttaaaaaagattgtcgtgtcctcagattcttgattgcctcagtaagtcttctgatagtgatcattcatcaccagtggagcatttgtcatgtcggtcaaggtaatcacgtttagattacttatgttgcggaatttctattatacaatactaactgccttttgtgtttgctgctcattccagtcggaaaacattgatctatctagttctcacccttagccacatgtatccagattatgatttcaggtaaatttctttcattttacaggaaggtagtttttgtcttcttaactagtgtgttctaaaaccatctgggaggaaggatattgggtaatgtcatagtcagcctattttggcgatttggcaacccgcttttgtccttcctgccagcctaagggggtgttgtcaaatggtatgacagacggattgatatccgttgctctttgagctgagagttcaattctctccattacccttgccctttgtgtatttgactgagctgtaactttcttaaaggtcttcttgctgttatgtgacacatgcatgacaggatgacctttagataacatccttttgtcaacattttttcacttaccagtgctgttcgggcacacctgttcttcaaagaagaggagtgggaaagctttaaggagatgacagacacctacttatctgaggcttcaaaggtaacaacttgaactctcttttttatgcatctactcttaatccaaagataggtgtgtttgtaaacatgcatgctatcagaatttagaaataggtacggtatgactgcaaaagcaaaaatgtatatattaacacatagctaattttttccatcatgattgtcctacttatttattttcattttcactggtgtgatttgcttaacctaaaattggactatctttcagcaatgggcagcaacaaatgagggcacttctcttctagacagtatgactaatgtcattgatgaggtttgcacttacatgatgcttaattcagagaacttggatattcatatattttatactgtcaaacattactttgtaggttatcaaaatcggagagtctgacatctacagctataatccagaccaagatggagatccatttcttgaaaagggggtcatgtaagttaagctgtgataaccatgcttttaacttagcaatcaaatgaatgttacatgaatatggtatactgttttcttttagatggtcgatcaactttttcttctacaatcggaagctaaagcgagttgtgagctttcgttgcagttgtataaggtagacacttgctatgcagttctgcattcttttgcaggaaacacgatgcgcgatgttttgaatcactcacaagtttctgttatattacagcaaaatatcaggagatgacttccttaccagtgcaccatccgatggtgaagaggaagatgcactgatagacatggacatataattgacacctttctggcaggaaaatgaccaaccagtgtggcatccagttgtgtagtaccagtatatatcatgtatggcagtttggcagttgccagtaggaactacaaccagaattttcttagcagacttcacctgtaccgaggcctgcataatattatgatttgacagcaggaaattctgcgtttctagcctgagacttgaattggcattttacttggtgacctaagctagtgtttgttgagatcgaaattctcgttctatgcagttgaataatgtatatttaacaatgttatgttatgcttgtaacttgatttgcaaatttgctatgctgttgtttgaacgaggcagtgccgactcctgaatgagttaagcattacgcgagtttgatatggagaatttgtctgccgttggctatcaaggttcgccgcactctgtttgcgacgattctgtaagctcattacacgcatgcacaaaattgatgccaacggcaaccagcaataattttcatcgagttcacaagggaattttacggccgagctccacgcccccaacttcctaagcttgtcagacaagaatttacacaacttcctaagcaaaagcttctaatggctatagaagctgcggtgtggataaaatcttttgagccctgggctctacgagagcta

SEQ ID NO: 32354 - DNA, 12960 bp, Oryza sativa
  unsure (1)..(12960): unsure at all n locations
aaggtttgcggccacgtctacccttaccaccttttatttcaccattttcatcgtcgtcgctatcatcttcctcatcatcatcctcttctgattcggaaacatccttggttttcttgcgcttgttagatcgtgcattggtgctagcagatgccttcttggcaacctggacctccactctgtcttctactgcagtgaagagttccaatcatgcatgagtcgatgcaaaataataaaatggtaaatgatatgagaagcatttcagcagcctgcatgattacaataccagtccattcaaatttcagacaatacgctcacagcaaaatgtaaagtaacagcaggatatagaaatggcatgtaaagccaaaagttgctcacatacttgactacttgagttacaccaacaatcacactggcactattaagcgattttccctccacaagcggagcagcctccccgcacaagggcataaccacattagctcatagaactaagcacataaaaactattgactgtaaacaaaaggaaccatggtggtaggggactatccaattatatacaattggagacaataatttattctgcacatatcaaaccaaactaaggatgatattcatacaacgttaaatttcttgaagcttgcatacataatttaacaatgtgattgtaaaacaaaataaagaggacatgcaaaatacaaaccttcagtggaggtatcaccgtcataaatatccagctgagaaaaaaaaacatttattataagataaccaataataatccaaaaacctagggtaacgagagaatgcaagaaattagcatacatctgtacagtttgtactgcgactactaaaagagatgctagatgataaaacaaaattattagtctaagcaatataagagacgaaataagataagtgaataaggtagctcattaaagaacaccttggtaacagataaactatcttgatcaaagctgtgcttttaaaagactgtaaggacaaatgtagccatttttaacattagtgtagctccatttcaagggtagatagcctaatgcaagtctttaaacctaaaagttatagcataacatccgttggtaaatctaatgtgccttattcgagatagagactatgataccgcataacacctaacatagctgctaactcgagcaactcattttctttgttgaacatctcaagtaaatgttgcaacatattgtaatctcttggtagcatcaagcagatggcctgtgaattggagcacattcagttacctgattaagccggtcactagcaattgatctgtctacaacaatcgcagacaacccatatccacaaccaacactgcagaatgtgtcagcaatttagttgattatacaggagctgcaactatataaacattttgatttagtgtagttaccttataacatgcattccttcaaggatgtcaacctttttaggattagcagatgacctgcattacaagttcaatgactgtaagaggaattctatggttttaacaattgctagcctagtattaaaatgatattaacagtattcaataggcgtacttttgcccattagggccatagccaagctctccattttgggctgttccccagcttatgcaagaatcatctgcaccaacaacgtggtgcatgttaccagaagccatgcaacgaatgttccaaccactgaacaataaaatcaccagttaaacagataactttggataacatcatttgaacaggcagctaatcacgatttatcaacagaaagaatagccaaggacggaactattcatcactatatggtatctacagttaagtttgtccgcaagtaaccttaaatccaataatggctttggatacatccagtcgtcgcctgtattctttaactttccccacatgtacaactgtcctccacctaataaacaaagcaaatacccaaaaattaataataatgtggtgttcattcttatctttttatgcaacactatcaacatcattttggttagcagaatccaagtctccaaggttcaagtatgatattcttaacaggacataaataatactacacaacatgaatctccatctaactagcaggaaacacatagagtgggaaaaaaataaacctgatgcatgctcatatcggcctatcagaaggccagaaaaaaatgagcaggcttacgctataagatgcttagtgtacatgctaaagcatttaaaaacactcaactggctcctcgactacataggatcccctttgcctatagcacctcgctactcaatcatcaaagcaaagaggttgtaacagcaaattagagcaaagccaatagtatcaacatttcagcagacacaaaaccctgatgacaattgttcacataataacacatgggaggatcaataaaacggcaataagttgataataacttgacagatttgttggcagagataatgcacaggaattccataagacaataaaataatgtcttcccgattttgaaaaagttagcatgcgacatgctgaatttcatgtctcatttattagtccatgccatttaactgaatacatgaataacagtacaatcatcgaatttcagaaatacaaccaaaatgctctataatattataattacaaacaaaacaaaatataaacttacatcacaaatagcttattttccatgtatgatactcagctaattgcctaatttacaggcccaaagtggtttttattaagtatttctttatgattgagccaaataataacagaactactctatcgatgtccaaatatcagaaaaggaaacataccggcagtgcatgcagaacttgccgcaccagctgatataatagcattgggtggcagaacattatgcttctggaagacttcaacaaggcgaggctgccactcatccttttgttctctatggcccaacctatgcaaataacaagtggatggggatcagaccaacgatgctatcctgattatagtgggatattgggttatatgacatcagtgtctcaccttccatatccaccaaagccccatctgccagggccaaaagaaaagagaaacgatattagaaaccataaacagggaactgaagaaaacatgtattattagatattgcagataggaaacggcttgatagctgatacaggacagatggatactatcatactagcaagtcaaaataatttaaagttggtaattgcataaaaaattgatgaataaataacatacgtgtaaacatagccacttgaatcaactgcaactgcagcacacaagtaaatgaacagtgtgagattggtgttaatcctgaaaggttagaataaccaaaatatatatctgtaaatataacagaaacctgtatgatttgttccacatgcagctttgacgatagttttcccagataatgaagctattgccctgggacggggctggggatcatatgccagctttacagatgagtctttaatattgtactgcaacagcacaaatcaattatcagtgcattgatatgaaataaatgaacaggttatctgtgttaatagagtagcaaacaacctcattgtcggttccatgaccaagctgaccgtactggggaagacctgctgtactgaatagcacagaagaataaaatactgcctcaaaaaagttcacgaacaacactcactaacaagagcacaagcagatataattaaaagggttgaaaatatattagtgtcgtattataagcaagacatacagtatagtagagccctccactgatgacagccagacagtaaaatcagcaccacaaacagcattagttgcttcagtaacaagacagggcattggtgatgtctcaatttctgcagcaatttttgaaccaaaggaacaagaatcaaataatgtaataaataaaggggaaataagctgcccaaaacaagtaaaataagtttatcagttatcacacattgtgtcgcagagctaggaagaatttacgaaatgtccaacatttgttagcatatattataagaatatgaaaaactccccgtgaaacactgcattgcagcatcaatgtctaaacagacagatcacacatggaagcattaccaaaaaagaatcaaccatccgcgaagcagatatatccagacttttccaaagacagaatgatttgtctgcaggacatgtatttggtgtactactgatgtcagtgagttaaaaatgaaccaaaggtacataccattccttagggagcctgtacccaactgtccgtgtttattgtgaccaaatgagaatgacttcccgtcatcggttacaaccactgtgtgatttcttccaacacttgctttaatgactttgtacctgaaaacatttagcacccataaataattcatctcaaccagtgcacctggtcaattcatgaatttagcataccaagagctattgttaacaattgaagtacaaacaaatagttagttcctactttgatagttcagaaacaacagtcggcaggttacgctgaagagtatccccatgccccaactgccccttctgctagaaagtaacagtgttaaaaaatatagtgaagaaaggtggcgtcaagtaaatttcgtacctcatttcgaccccatgtatagcaacgtccttcagcatccaaggcaacacaatggcaagccgctggataaatgatgttatagagttattacaggagtactgaggatcaccagaagatcgaatttgcttgtggattacaggaaataaattaggaaacttaatcaaccaagcctaaatgcttatgacagaatgccctaaagttgaactcttaccactcctagagttaaactccgtccgatcacccaaaaccaaaattaggaaaacgacaacctcgtattaagtccgtcttaaaagcacacatactcgctggatggttgcatcagcagtctatctagaccattaagtccactgcattgtatgtttctcacacgtgtctgaatcgctaaaatccaatcaaccagcacccccgcgttagaactttccatatgtactatctgtctcgatgctatcaatctaataggtcatgacagcattttgcaacattaagcagtaagcacacgtgtctaaatcgctaaaatccaatcaaccagcgccttcgcgttagaattttccatatgtgttatctgtcgcaatacggtcaatttaataggtcaggaaaacattttccagcattaacttgatagtactaaacagagtggcgccgtttcggcattagctcatccagccactggaagagcccgcgaactttaaacctgaccaattccacctgacctggtttcacgcatccaacgaataaatataaactaaaccagcggcagttctcatccctccgtgacttgactctaggagaccatctgaaactgacagaaggacgaggggactcactgcacccggaggcaacgaatcgtatgtcgacgcccatgagcgaccgcatccgcgtcggcgacactaggttaccctgcgccccgcccaccaccttccgccccatggtctcgaagttggtcgcgccgcagtacagcagctctcccccggagcccgcggcatccttcgcgccgtccgccttctcctctccctcggcggcggcggggaccttctcgggctcgccgctggccgacattatcgccggtagtaacgccggcggcggtggaggattccgatccgaaaccctagatttgttcgggggtagcggagaggagaagcaacgaatgggggagatttgaaattagagattgcagatagaaactctttttatgtgcgggttagttatttatgagccagtgcggattcatagtacgcagtgggttcggctagtgggtcgactaatcaaagcggaccaggagatatttcctatcacgtcaaatgtggcactgaccagtgggaccgggaaaagtggggcccatttgtcagtgatgatcagttcgtggtccaagtggcactgggtttagttaaggccgtggttttaacttcagccttttcccgggcttcgttcctatggacaggccaagaggcccaagacgacgtcgatgggtcgtactttgcgaggtgatgagttactgacttgtggtccatcgtcatcgtagggtccacttgtcggtagatttgagcatggagtaataaaactgtaagtacgagcaaatgttgtggtcataactaatttttgctggctggccaggcgagggcaaggatgtcagaagtcatggattgagggcaactccagtgtatgttcgattactatatgtgttagttcgtgaatggcgaatgcaactttggtttggtggctgcagtgtgcacatctatttatgtgacccgtttacaataagaaaagttgagagaaattgtaaattatttgatttggcttggatgtgttcaaccccgtcagcaacaattaaggccctatttagatcccctagtaaaattatacaccctatcacatcgaatgttttgacatatgcatagaatattaaatatatatgaaaaaataactaattacacagattgtgtgtaaattacgagacgagtcttttaaacctaatagcgctatgatttaataatgtggtgctacggtaaacatttgctagtgatggattaattaggcttaataaattcgtctcgcgatttacaaaagcggattctgtaatttgttttgttattagactacgttaaatactttaaacgtgtgtccgtatatctgatgggacacgtcaaaactatacacccttggatctaaacacggcctaatactttaattgtctaacatcgactcaagtttggaggtcgattctgctatctcacacaacgatcgactctctcagcgtgatgtgttcgatacttttggctcacgattcgatttctccacacactggagctgctctaagaggatagatttccttgtgaggctaggtcatgaagtaatatggcgagtggtttcgggccttcaccttgctaagcctcaaccttagctaagagagtggcttcattgagcatagatgtctagcggaggatataggagtatggaaagggaaggtggatgtggagcgggatatgaaattataggaggaaagtgataaagaggatgtcatttgaagaacaaatattgagctgagcaccacgacgagccatgtgtgcgaagaagaaagctagccacatgatgatggccttgacaactctagcaataaggagaccaaatgagtatagctatatcgcagtggctcatgaaggaatcaaaggtcagtagacacgggctgcacatcatctgccctcgtcggtcggtcgtgtcatatactttacgaacaacctaacaatcgactcattgggtggataacaaaaactagcgctgtcagctagaggggtgcgaggaatgatgatgactggagaggagagggggcaaggacaactgaacagcagatgaatggtagtaactagagtgagggatttggaggcttcgacgtcaagatgataaaaaaggcggagaagagattggagataggatgacatctggggctatatgaaataccatctctcttaaaaccgcaccacgagaacgcctgcattgtaaatttatgaagcgtataaatttattgtatgtgactattatatgtatgagtttattttgtgagatattatttaacaaaagtaatattttagtttcgcctcgcgaagggaaaacaaaaataatttttatctatgacaaccctttggtatcaataaaaatataaatttatgaagtatattgatggagtgtataaatttattgtatacgactatcatatttatgagtttattttgtgagatattatttaacaaaaataatttttatctcgcatagcaagatttatcttataaaaatttccgtacaactataacaaaatatgcagtttttaatggtaaaaaaaaactacgttttgttttatctaaaataaattttgccatagataaaaattattttgttttcccttcgcaaggcgtaaaatattacttttgttaaaaatatctcacaaaataaactcataaatatgacagtcacacacaataaatttatacactccatcaatatacttcataaatttatattttcttgataccaaagggtaaaatggactttatgatatgaatttaacggtcaactgacaaaaggggtatataagagatccaaattgaaatttaggggtatggaagtgaatgcgcaaatctcagggatataaaaaggattggatgaactttcaggggtacacagggaattttctctaaatgtttctagtgatagcgttttcaaagtaaatttggccatatattgctttaggaaacaagtgtgacaaggaagcataaatatgtgctaataggttccttgtggtggaatatgttcactcgagtttaacctaacatggatgctcccatatgatgttatttcagtggtaggcgatatatatgtcaataacggaacgttgtggtgacttcattaattttatgatacaccggtccaatttttttagatacacatgaggatcgagtgtgtgtatgtatttatagaggtgagctcatgttgttagaatccgcatttatacgtactccatccgtccaaaaaaaaagacaaaccctaggttttcgtgtccagcgttcgattgtccgtcttatataaattttttttataattagtattttcattgttgttagatgataaaacatgattaatactttatgcgtgacttgtctttttaattttttaataattttttttaaataagacggacggtcaaacgttggacacggaaactcagggtttatctttttttaaggacggaggaagtatctcttaaagagattcaattccaaaaaaattatccggtataaaagcagagataaacggaagaatatacccacctatcatttttattatcttttctactaggagaatcatttttattctctcgttgaaatgcggggatggatatagcttgcagccacgggcaaccacaaaaaatgtcaaatttcaacgaaagcccgaccctcccactgaccctgttaccgcacgtttgagtaacccgaccgcaacgaaacacacgccccaattttcttggttcgtgatgactctcccataggttgatccgatccgtaggttctcgatccaacggtcaccgtgacgcgcagctccctgcagccgacctggccacccacaccttcgtggtcgtggcttaccagcaccacccacctaccgctcgtaaagcaaccgccccccacctcaccaaacaccgcatccggtgcacgagacggcgaccggtcgaccacccccgcctcaccgcgagtcgtgagactggagccgcactttttttctttccggcttgtgggccccacaaatcctcaaacccccatcgtaacgcgtgccactggagagcggggcccaccgccccactttatataagccttttggaattcggcccggtccaaaaattccgggacgcgctgaggcctgtgaaaggaaaggaaaggaaaggagaggagtggaggcgaggcggcggcggcggcgagatccacacatgacacatctcgaggcgcgcggtgggcatcaattctcctccactccaccgcgtttttttattatttatctatttttgcgcggccgcaagctcgcgcaccttgtgctatctctcgccgccgcctaataatagctcgagtgaccaggcaccaccaccgccatgggagcgctcgaggaggcccacctcgccgccgccatctccgcgtgcgagtgcgagtgctacgaggaggaggaggaggatgacctcgtcgagggggacggcgaggcggcggccgccgacgccatggagccggcggtgcgcgcgctgctgctggggctcggcgaggacgcgcgccgggaggggctgcggaggacgcccaagcgcgtcgccaaggccttccgcgacggcacccgaggtacggcccagactccctcctccggcctccggagttcgtggatccgtttttgtgtgtgtgtgtgtgctgtttgtggagtccatggcataattttttgatccgtgatttgcgagctgcgggccgcagctgtctctcttgcttgtctagcaccgaacctggtgaagcagaacaaagccgtggggcatttgaactcgtgtggtgttgtttggatctcaggacgatgggtcgggttgtctgggaattattcctgaatgattgaattctatctcggtagcccatcatagaagtgataacttgatgtaaatggttttgcccatcggtcataatcattgctgttatggtggtgttaggctattacagcgctattatgcttgtagtttcagcaattaactcccctctctttaaaaatttagcaactggccaccaaacagactttgatgcaagcatgaatgaccaaagtatgcagcaggattgtgcaaagagaagttggattcggatggttacaacgaggatccgttgtatgtagttactaggagtcttatgattggattgcatacttgcaataagccattccacagtttcttatggttatgaaaattgtttatttcagtctgcaatactgggaattcctgtagtaatcacaatggctgtcctttatttattagtctacttttgccttatgggctgcagcagcaggataatgctgtgccatgtgcttgggtttgtctttttggattatttaaattatgttaatctattattaccttccaaagttcctgctccgtacagactaattgcaacttcaaccggcagctcttctacttagtacttaaaatgtaatctattttcttttagttctcatcctagccacactttttacacaaactcgcctgctccttgattaaattagaaatatgttctttgtttcattatgaaatgtaacgttggatcgtagttatgtactgttccgctgttttgacttttgatacattactactacgatttcaaagagaaaatttggaaataaaagttactttaattatttcatagctgatgccatgccaacttgccaagcattagtatccttttttgtgaccagctggcagttaccatattcttggagagctttctgtatcaatctgtcttacgcaaccattttttaatttaattgtgtctacttgtccataaaacagtgcttctcatttagtttgagtaccaattcatgggatttggggggcattggaattgattacattgttcttatatttgttttatcaaatggttgtactctggaaactagccacaaaaaatgactgttttttcatcattgcttgtttgataaattactgctgtcaatgagagaccgtagtctacataaagcttaggggcaactgagaagtgagaactaaccaccaaattttatttgtttctcggagcattcttttggccacaatcaacacttaacaatgatactcttacaatatttccaagaagggaaccctttattgctggttggtttacagcataaattataccatgaaaagcctgttcttgtacatttattccatactcgtattactttagaacacaatgccatttttacctgtgatggtaaagaggactgctgatgttctgtggtattactggattactggaccattgtcagcgttggagcgttgtttgagtatgctgtttctcttataatctcttttgaaagaaaactgttattttatatttattttagtggcttaactcacaagaacagaacccttacaacagtagcatggtaatagcaactttgaatactcaaactggtagggctagggagcttgtggttcttgtcttctcccaagttgtgcatgcatagatgacaaaataacaagtcaacttttttggctactttgttgcagctgataatggtcttgtagaacttaatcaagtgctggagttatacagtatagccaatcagcgaacatttgctaactcttaccattgctttggagtcgaataaatataatatttttccgtatcatctataggaccattttacactagactgctagtttacctgaacaggacagttttgagcttgatgtgtgcaacttgcagcatcccaatccaagctacatcatgctgggtctaatcttgaaaggtttgtgtgaagtcatggatagtcagcacatgcgttcatgtgcacaatctgtggtcatgttattcttatgcaaggcaaagaatcctttcagccccatcagcaggcagtggtgccaatatatttactttgttgtatcagcgtctcttctttgttgttacaatgtttgggctgctaacaattatttgtttgtaaaaaaaaaactgtaatgcagttgctttatgagctttatttgacatatagttaaaactaatattacaggttacaagcaaaaagtaaaggacattgtgcagggggctctctttcctgaggttggtgttgacaagaggactggttctgctggaggaactggagggcaagttgttgttcgtgatattgatcttttctcatactgtgagtcatgcttacttccattcagcatacaattccatgttggctatgtgccctctggtggaagggttgttgggttaagcaagctttcgagagtagctgatgtcttcgccaagaggttgcagaatcctcaaagactggctagtgaagtttgtggtgcattgcatgctagcatacaacctgctggtgtggctgttgctctgcaatgttggcacatacctttgccagaaaacttgaaatgcaagactttgcaaggttggattagcacttcacattcatctcgctctggagtttttgagggtgagagcagctctttttggaatgacttctcagcccttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32355 - DNA, 4466 bp, Oryza sativa
  unsure (1)..(4466): unsure at all n locations
gcctcaccacccacatccgcacgctcctcgacgactccaagaagaccctccaagtatctatgattcgattcgattccactgcttctttgatcccacatcaaatcttgctcggccttctcatcttgcttgcttgcaggaagccgactacaaggagtggaagcacgtcgtccaagaaatcgcgaggtttctcagagctgactccccctttatcaacatgagaccactcaggtacagctacgcatttgatcctccccctgatactcttcctaccgtcccacctactgtcaagaagcgaggtctggtcttaaatgatgccatgctatgcagctactatcaaaacgaggtagggtaatgcttcctctgtctcaccttctctttttttctgtttttaacacaacaaaaataatgaggagttgcctcgctatgtttgttccactcagatcaaatttacagacctcaccatagatgttttcagaatgcttcaatgcctcgaatgggaaccatgcggttcttttgcactaaccaatggttacagtacccgcgatgaaagtggacaaaatcatcccaatctcttaaaagatctgagagatgctgcgctgcctccaaacccacttaaaacaattctctatcgtccctcagtgactcatttcctaacagtaagtctcttcttcctcatttgatgcttgacttactgtcttatcctatgatttagtgaatgcatgcaatcttaaaatgtatttcatacaccatagttatctactagtataatcatcagagattgaaaaaaaagggaaatcactatggtagacagttaccatatgaagaagtttttggtgcttgcatgttactactccccttgaaaataatattggcatttgacacatttctgctgcatttagttcaccttaagatgagctagtttaacttgttggatgtttcagtaatgggctagtataacaattgacaacgtaggaaattccatgagaaaaaaactatattactagtattaactaattgatttaattattctgacaagaaagcatgccaatgatcttcttgattcctcccgagttcatgacatgaggttcaaatgcacaatgaatctgcttggtggcatacatctgattgtctaatgtctacaccaataatattggtattaatggaccagtaaacttttgacgacaaaactactcttttggtaaccatttcggagaaccacaccactaactattgttattgcataacaacaaggaaccatgcttcttgtggacatgatgacttggacctacatggtaacaacataatcctgtctgacccatcacatggacattgacttccacacccactggctggcagtaggtatcacttgtatatacttgacttccataccacactggtagcaataggcataccacttgtctatacttggaagggagagggatgagactatntgatttctgctttgtgttgtgcgtgaagtggctaggtgaggagagccaagattcatctgtttcttgcatttggttttcttattcatcacatagatcatgtttgttatcccttttgtttaacattagttacatcgttgcaagccttataagaccaagcaatccacggaataaagcaagctgagattaatctgtaaactctatcctctctctctctctatgacatgacggctctgggcaagcaaggtcctccagttgagcatgggtatgcgttacgcagcttggggccacctccaagccataacatctgttcagtgtattgtttcttgtttggaatttctttcataccatggttctatattagttaacaaaaaaataaaataaaaataaaaaactttctagattgactacatcctgtccacctatatttaatagggattattgaaatttttggactgctttacacaactcccttgtatattataattcctttttatttaacatggataatagagggctatatgtttttgttaatcatatattatcttgtatcgtatgctacctctccattcatgaatagttgttgattttgacttaaatggatatgattttgtgtttatctttaggcaatataaaataaatagctctaattgtagaatattgtagtacttttgattataaatcttcctataccactttgatgcaaaatagttatacaaccaggaaattattgttggtcaaagcatgatcagtcaattgttatatgttatgtttgtaatctaggtccttgccaccaaatgtgaggagctcccgtcaaatggtatgatgttaatatacctttcagctgcaggtaggtgctgtaggcatttaactaaaatgttatttgtaatatatcgtctgttgggagcacattccaatcaacactctcttatctttcaggcgaggtgggatcttctggattttgccctgatacaaatgagatggttgtgagcagcttgaataagtttgataattttaatctaggtccctccaaggtaattaaggccatgggccttgtttatgggtaggctgccgtgaaggtgaaggtatattcacaatgctggcttaattagattatcttcttggttaggtttatggcatccttgaagttgcccttacatggactcaactttcctagaaagaagtatgttatttctgacacatgttcaaaacatctaggttcaaactgtatatacccttgtgatctgattccatttacaagaagaccactctttttggtgatcgacagcaatgccagctattcattcaaggcaggtttgtttaatcttatttttttatcccaagcaaccatcattattcaatactacctccgtcctaaaatataacaacttagtacatgattagacataatctagtacaacgaatatggatagaaatattttgagacggagggagtatttgttatgggtcacttatattaatttattctggctagtgcgggactgaagactgaagaatatttctttagtgggttatccatgagtgatgaacagttttactgaatcctgtaatgctttttgagagaaagcacatgtgcttggatctgcacatagacaggcttatagtttttgtaattttttaggttgaagcttttctcagtttacttctgtgtaaaatcatgcattatacttatccaagtgccattctattggcattcctcattttacttttgactatgcacctcttagattacgatggaatacatcatatttttactgtaggctgctggttggcatcatgccatttattgttagtgctgtcagtacgttgatcccctctaattttttcaaattaagcattgcagtcaattcatgggtttgaaaaaggggagacaacggccatgttactttctccaagttgccgatcttcctcggcaggattcagtggggattctgtacggcagattggcagtcaatttactatgtttctcacagctccattgcaagctttctgccatctgattggcaataatggggtcgacattgatagggtacttgcttttagtttttgttaacaattttctctctcagagcaagagaagttttttttatattgagctttgacataaactttttttaggatacctataacaaagctgaagagttactatcattgtccttaaatgaatgggccactactttggttgcatcatcttcacttcatcctgtttgggttgaagttttaggcgatccactcttgaggcggcttcttctcaggtcaccttccaaccttttgcatgagttctgtatggacatcaactttaacatgattcttatctactaatttctcaataatgagcgtatgttcactttataagctgttcccctcatactgtgttgagctaatattccttatattctgcgtaatgtaagctgttccctgatatgcatacttgatatgccaacgtgtagcattttaaagctcatttcggttgtttttgcaggtttatattctgcagagctgcgcattcgatcttcaaacctacgtaccataaggtggacttcctcccaacttgcacacctcctttgccagagtcggttgatgcagagagcatgctttcccaatgctgcctgttgcgagttgcatctttctttggcgccaccaaccaattctcattttctgaggtaaccacatggcctgaggttgatgttgaggaggctgctgtcgtcaacccctcgatctagcggtaccaactgtgactcttgcgcatcacaatatttagtttctacctatcaaaagatgaagagatccattgtaataccttaatgtggtgtgtgtacagccaaatttgcaataccctatttatcgtcgtgctaaaatttccgttactggccccgcctcctgtagccctcgaggccaagcgtctttgagcaccgaatgatctgacattggacgaacaagattacagacatatggacaaaatatgtggagacattaattcataccataattcacatt

SEQ ID NO: 32356 - DNA, 2362 bp, Oryza sativa
gattccatgcacggaaggcaaagttatcaaagtcttaaattcgcccagaaatctttatcggcagtccacggtgtcgcgccggccagcctaccttaacagcgcggttagtcaacgtgcttgacaccgacgttgtctaagctatccaccctaacatcctatgtgtcgttcctatcctaaccacctcgttgaaaaccagttgtggacgctcagatcttcgacattccaccgaaacaaccgctgcttcgtggcctatggtaagtggtttctagaaaaacctctgggggtccacctctcccaatccagtctccctagggtgaggcccgtgattctttaatcgtcaaaaaaaacctagctcgattccatgcccggaaggcaaagttatcaaggtctttaattcgcccagaaatctccatcggcagtccatggtgtcgcgcccgccagcctaccttaacggtgcagttagtcgacgtgcttgacaccgacgtcgtctaagctatccaccctaacgtcctatgtgccgttcctatcctaaccacctcgttgaaaaccagttgtgggcctatggtaagtggtttctagaaaaatatctgcggtccacctctcccaatctagtctccctagggagaggcccgtgattctgcagccgtaaaaaaaaacctagcacgattccattcccggaaggcaaagttatcaaggtcttaaattcgcccagaaatctccatcggtagtccacggtgtcgctcctgcggtcgacgtgcttgacactgacgacatctaagctatccacctatcatcctatgtgccgttccttccctaaccaccttgttgaaaaccaattgtggaccctcagagcttcgacattccgccgaaacaaccgctgcttcgtggcctattgtaagtggtttttagaaaaatctctggggtccacctttcccaatccagtctctctagggtgaggcctgtgattctgcagccgtaaaaaaaaacctagcttgattccttgcccggaaggcaaagttatcaaggtcttaaattcgccaagaaatctccatcgatagtccacggtgtcgccctgccagcctacgtgtaacattctgaaaattcaagacaatgaaaatcacgaaaatttcgaactttttaaaacttttgcatcatgctggttgttatgattgctattgcttgccaaaccgtaaatgatcaccaagaaagtaaagaaaagaactacatttaagcaatagatatgattttcgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtacatcgattttgcaccaagttcctacttgcatttagggattgaaatttgatatattaaacccctccatataaaatatagataaattgagctaatgtgctattatgttaataacggtctcattagaaaattatagaatctttaataaaccttaaatattggataatattaaattttgggcaaattcacatttgaacacttaatacggtcacctaaatgtttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagggtgaattcattagttaagataacacaaatattgagtaaaatgcatatatgcaaaattaggaattgtggaatcaaatttatatggaaattacgctaaaatcgggttaattagaaaacggcactgttcattgcacctaaggtgttcgacggggtcccctaacccagctcctcctctttccccctctctccgtcgccagccgccgcgcaccgtcgccatcgtcgcctgccgccgtgccgccgtcgccatctcatcaccgcggcagcgccgtcaccgtcgcgttccgcctcgcgccgcgcgccaccgctgccgcgccgtcgccgtcgccatcccgtcgcctcgcgccgcgcgcccgctgccacgtgccgcgccgccttgcgccccgagccgcgccgcaccgtcgtcatctccgcccgcgcgccgcgcgccgtcacgtcgccgccgtcgccgtcaagcccgcgccgcgccgcgccgtcctatcgtcgctatcgcgccgtgccgtcgtgtcgccgcc

SEQ ID NO: 32357 - DNA, 17712 bp, Oryza sativa
  unsure (1)..(17712): unsure at all n locations
ccacgcgccgccgtagtcgcgccgccgcgccgccgttgtcgtgccgccgcgccgccaccttcgaagccgccgcgccgtcgcctcggagccgccgcgccgtgcgtcgccgccttgcgccgccgtcgccgtcgttgccgccaccgccgccgccggtgagccgtcttccccccctccacctcgcgcccacttccgtcgccgcccggggaagcaaagagccgagagagagagagatagaaaggagccgggaggagagaaagaaaagaagagaaaaagagagaaagaaaagaaaaagaaaggaaagaaaaaaaaagggaaagggagaaaaaggaaaaggaaataaaaagtaaattagagggagattagggaagtttagaaaatttaaaataattagaatctaattatagaagttttatggtctcgagtctatgacatgtgggccccacttgtcattagctcttcctatttccctttagaaaataattcggtaggaaaaagaaataaacccgggtcccacttgtcagttggtacaaggctgtggatatgtcttaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaacaaaatatacttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatggatgtataggaaaatactagtacttatttaatattcgatggccatataattaaatccatggcttataggttatttaaatcaagtatagccttatgattatgtaactaaaatctaaacacacatagatgaatctttaacctgtttaggagaatcataacagagctagatgtggaggaatcactaagtaaattaatcgatgcaataccatatagaatagcatatatatgcctaaattgattaccacttattagtaacccaatagaaccaatgcttaaacttgtcgcatcacatatacaatatcactcatagaaactagctaatgtataattaaactacaatatatttaggaatcacttggagcattgggtagtacactttctaaataagctcatgtacagtaggcgaccaaaaccttatatgttgttgcacacatatattgtacatcccattatagttacacaattaatttatctttttcatatattaaactggggagtatatagcaaacatgaatagtagataagtactaattataaatcttgacctcctatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactgtaattgtttgattgatcctaaatccatctaacaaaagaacctctagtatataaccgtcctatttagatagatgaatacatagccataatccttccatagccatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttattgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttgcaaataaaattgcatgcaatgatgaacatcctacttgtgattatgccatgccttgattattgtttacccttaaatctttgtaaccatgtttacgtatgagtccctagtcaactatgacaattgcttaggaatgctattctagaatcatacatactcatatttatcaaatgctatatgcttgggcaattacctttgggaaggtaattgagatgcggcatgtggagacatgagcgccacattgccatgatgttgatgacatgatttgtgaaaggagaaataaaattaaaacaactgttttcgactggggtggacggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatcccagcatagatggttcacccctgagtgaggcaggtgcgctacgatgggacagccgttgaggtagggccgagaagcgtgccctacatcggtgtcgccattggtaggactgccatgagtgtgtaagagagagaacttaacttgaaccataatttaatatgcgtgacttctctttcccgggagcgccagaactcctctcactgctagaaacatggacgcctagagtgcatgaggatttaagttcatggagcgggtactgccaatgcgaggttatcgaaaagctttgccgtgatgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtggggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatactaggttttaggcttgtgaaaagaattgtaaaattagctttatgcaaaagaacctgaagccattccttgaaataccctctatcatatgcattgttgttgtggtggcttcctgagtacggttggtactcacccttgctattcatatatcttttaggagagtgttgaagagaagcccttgtcggtacgcttgcgtatctaacaagatgatcggagtgcggtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgaatgtgtgtaccaactactgatccagggattgatacggataaacacagaagatttccgattcccaaaattgggggtctacactacgttaacggcgcggttagtcaacgtgcttgacaccgacgtcgtctaagctatccaccctaacatcctatgtgccgttcctatcctaaccacctcgttaaaaaccagttgtggaccctcagatcttcgacatttcaccgaaacaaccgctgcttcgtggcctatggtaagtggtttctagaaaaatctttggggttccacctttcccaattcagtctctctagggtgaggcccgtgattctgcagccgtaaaaaaaaacctagctcgattccatgcccggaaggcaaagttatcaaggtcttaaattcgcccagaaatctccatcggcagtccacggtgtcgcgcccgccagcctaccttaacggcgcggttagtcgacgtgcttgacaccgttgttgtctaagatatccaccctaacgtcctatgtgccgttcctatcctaaccacctcgttgaaaaccaattgtgaaccctcagatcttcgacatttcgccgaaacaacagctgcttcgtggcatatggtaagtggtttctagaaaagcctctgggggtccacctctcccaattcagtctccctagggtgaggcccgtgattctgctgccgtcaaaaaaacctagctcgattccatgcccggtaggcaaagttatcaaggtctttaattcgccaagaaatctccatcggcagtccacggtgtcgcgcccgccagcctaccttgacggcgcggttagtcgacgtgcttgacaccgacgtcgtctaagctatccaccctatcatcctatgtgccgttcctatcctaaccacctcgttgaaaaccagttgtggaccctcagatcttcgacattccgccgaaacaaccgctgctttggggcctatggtaagtggtttctagaataatcattgggggtccacctctcccaatccagtctctctagggtgaggcccgtgattctgcagccgtaaaaaaaaacctagctcgattccatgcctggaaggcaaagttatcaagatgttaaattcgcccggaaatctccatcggcagtccaaggtgtcgcgcccgccagcgtatgtaagcggcgcggttagtcaacgttgttgacaccgacgtcatctaagctatccacctatcatcctatgtgccgttccttccctaaccacctcgttgaaaaccagttgtggaccctcagatcttcgacattccgccgaaacaaccgctgcttcgtggcctatggtaagtggtttttagaaaaatctctgggtccacctttcccaatccagtctctctagggtgaggccggtgattctgcagctgtaaaaaaaacctagctcgattccatgcccggaaggcaaagttatcatggtcttaaattcgccaagaaatctctatcggcagtccacagtgtcgcgcccgccagcttaccttaacggcgcggttagtcgacgtgcttgacaccgacgtcgtctaagctatccaccctatcatcctatgtgccgttcctatcctaaccaccttgttgaaaagcagttgtggaccctcagatcttcgacattccgccgaaacaaccgctgcttcgtggcctatggtaagtggtttctagaaaaatttctaggcgtccacctttaccaatccagtctctctagggtgaggcccgtgattctgtagccgtaaaaaaaccctagcacgattccatgcccggaaggcaaagttaccaaggtcttaaattcgcccaaaaatctccatcgacaagccacggtgtcgccccgccagcctaccttaacggtgcggttagtcgacgtgcttgacaccgaggtcgtctaagctatccaccctaacattctatgtgcagttcctatcctaaccacctcgttgaaaaccagttgtggacccttagatcttcgacattccgccggaacaaccgctgcttcgtggctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgaggctnggtgtgctgacgcaccccatgcactcggagaaaaaacccacaaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctgagacctggtgacaggtgggaccgatctccacaattgggcagaaacccaacggtcacaaaccacgcacatcggcaatggtaactcggctgtcaacaatgagcggtctcttcaagactgccacattacttgagtagcatacgaatctggacatggcgattcgtttcgtctgaagatatggtaacgttgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggtagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcctaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctaaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggtcacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttctttcgtttcagcgagatcctgtcgcgtccctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgctcgggaggaggcctcccgggcccgccaggccggggaagccgctcgggaggaggccgcccgggcccgccaggccggggaagccgctcgggaggaggccggatttcgctaggacgaggcgatggcgacttccgaggcagctcgcgatgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtcctggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcttgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagcttgaccgccgcccagggggtgcttgacgctgccgctgcccgagaacagcgggcggcggagaccgaagcggcatcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgccgaagaagagttcacgctccgcctccgcgaggacgcgctcaccgaacgggagcgagctctcgagggggccgaggccgtggcgcaacagctggcggtcaacctgtccctccgcgaggcagcgcaggaggagcaggcgcgccgcaatctggaaggtgcctgcgccgagagggccgtactgaaccaacgggccgctgagctcgaggcgcgggcgaatgagctggacgcgagggcgcgcagcggcggggcggccacgggcgaaagcgacttagccgcctgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacaacgtttaggaaattgaaactgcttttatagaaattcagatataagagaaataagaatatgcatatgttgtagcccccggccaaccctgcacgcccaaggggggtgcggggttggcccgagcccgaaacctaacacccgacccccccctcaggggtagaagcgacgaaggtgttcgatgttccacaggttaggcagctcagtgccgtcgcccgtggccagccgtatggagcccggccgggggacgccgaccactcgatacgaccctcccacattggtgaaagcttgctcaatccagcacgcgtttggacgcggcgtaggacgaggtcgtcgacgcagagtgatcgggcccagacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtatagttcggtttgcccagagcaccgctggcaactcctcgatccatgaatcgccgtgcttcttgagtatgttgaaggtcttggttttaaggcctttgaagatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgagcctgtcgatcgcgacatacagatactcaaacccgcccggggcccgtctaaacggtcccaggatatcgagtccccagacagcaaatggccacgaaagtggtatggtctgtagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcgatctaagggagttgggagcactcccctcgggtcccgaggcctggactccgacaggcctcgggggccggtcaggcgcatctgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccatcaaaatggcgctccatacgccgtacttggcgcacgtagacgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctaccacaaaattggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcagccttcccacagtagcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaaaggcgataggtgcggccttcccacagtggcctcagggccttcctgggggtcgggggctcctagcatcgtctgacaagcgggcagagggccaactccggtcgtcgggggccttgggccaccgttcggctcgggagcctctcctccttgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgctgttcgccttgggaacgaccaccgggttcgccagccactccggatggatgacctcacggatgaatccggcttccagaagtcgcgccacctcctcgcggatgaaggcttgacgtcccggggcctgccgccgcactttctgccggaccggccttgcgcccggccgcacggcgagacggtgctcaatcacctccctggggaccccgggcatatccgccggtctccatgtgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctatgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccaggcaacgcacggtgggtggtcggtttggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccaccggggatttgccctctcggcgctcctgcctcctctcctcctcccacttcctcgtccactcagccaaacttttgactgcacggtagtccgcgaggtcgtgaagggaagtgttgtggacggtgcaccacttgccggttgggcgctccctgttgggagcgctggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactacgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctagagaaactcggcggggttgacgctcccgtcatatttttcggcgatggtgggccggaaccttgggggccaacggacatttcgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgatgaaggagtggcggccgaatggcgaacagcggctgccgctcgccgcgccctccgtcttgacgatgcggagccggtggtagcagcaccagaggccttggtagcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtctcagccagcctctcccttgttctgggtttctaatctggaaa

SEQ ID NO: 32358 - DNA, 21100 bp, Oryza sativa
actagagttgtggagctggatttaggcagctccataactccactccagacctaactcctggagctaaatttaggagttggagctgtactaaacaggcccttggttaattgttttgacggggaaatggggacccccattcccatttcgtcgatagtgtggtccatggtatactcgctggtctcggccacctaggccttcgcgtagctcgtgtgcacgaaataggcctccgccgccactacctctgatgctgattctcctgcctcaactaacaccgtcacgttgcgctgctcatacatgccaaggtgagtgccctgcaaatgcaattccaaatcaatgcatctagccatgtaggtggccatcgaggaatatatgtatatgcatatgtaccttgagggcatcgaggtcgacctggacgcagggtgacactacgcagagctcgccgatgacgagatggtcgtcggaggatgaactccttggaaggatggggaggaggaagggtacaaagtaggtccccacgacaagcaaggctggggcggcggtggaggtggcgctagccaagggggaaccggaggaggtgaggagagggtgattggggaaaccgcgcttcaggctaccgtctcctccccctccattgctgcattaattttagccacactttggctcctcggtcctcacaaatatgctcacaaatatgatgtgacagtaatatgaatatggacacatgtatgtccagattcgtagtactcagtattaggttggtttatatgggacggagagagtacatcgcagagctatatagaaattattgccatgtcaaaaatacatcatcaaatatggcaacaaaataaataagccattaataacaatatgttaactagtaatatgttcgtgctaaatgctacggtgcaattctttttgtctttaataacctttaaattttcatgttaggaaaaaatatttttctatgatacgtgcaattgagttttatttcaattcatatcatacatcaaatatgtttcacgcaaagtacaataatatgatcctgcatgggtatcaccggcacacatacatcaccacacatgcaacaccatactcaccccacggatgtttcacctaacacacgctagaaccagccatacattcctaatctcactaaattcctattgaaaacctaattgcatagacgtaatatttgtggactttttttttctttaatgacttcaaactaggaattttgcaagaaaacgcacaatttaaattgatatgttttttctatgtccatccaagtaggaagctattttccaccctgatttatgtagaaatttatagtgaaaagatatataatacttccttggttttatattataagtttagatttttttttcatagctaaactttttttattttgacccgtttataaagaaaattttagcatctataatgtcaaattagtttcattaaatatgataatgataatgtgtctattttgtattaaaaatattattatatattttttataaatttgaaaaaaaataattaagaaaaagttaaaacgagttactataatatatataagagagagagaggagatcggccggaaccggaagggagaggggagtagacagacggggacagatcagagtcaggcatggccatggctgccgccggcgacgaggcggagatggtcgaggtgacgctgcgcgccgtcggcccgtcccgtcccaccacccttcgcctccctccgtttatctcggtaacaaaccacccgacccacccctaattcagaaatccttcctccttactgctccccggcccctccccgcccctaggttgccgatctgcgccgccacatcgctcacgaccgacatctcccacaagaccgcctccgcctggtcctgcgaggaaggaatctcccgtgccaagacgacgcccatgtcaacctccgccacgggggtatagtatactagtattctttttctttctcttcacatacatcttatgtggaagacaggactattctaggatggatggttaattcgttgtctcttcaagaccctactttttttcttcttcttctgcacttgatacatcttgtggaatacagttaaatacttccttccttctgcaatttctttagatagtcttatagtggccgtggcacctaagccacctgctaatcatctccgtgacggtgatggtgacgatgacgatgatgaagaggaagagctggtatatttctatcatagtatgtcatatagcttttatattttgaggatgtttatgttttcctcataagaattatctctcccatcctgtagaagttcaaaataccagaaacaaccacctggtggaagagaaaattttttatatttcttcgagacaaattgagattacctggtaatttagctttagattatgcacctctattttctgattacatgatagcgttgattaatgtggtgtgcattttgcttctccagatatcttgttgatggtgctattttctctgggtatcaaagcatgggttcttatcgctatgtggttcctttttgcacctattgctcaaatgtacgacgttggacctttatttgtaagtaactttgggaatacaacttctccagcaatgtccatatgaacccactgttctcttgtctccactactcatttttctcatagagatatgtgtgaaaaaaatggtgtggtttaaagaagtatcaaattaataatgtccgatcagcataactactgtctcatcatgttctctcttactctacctaaacgagtccttgacattttgaattcgaatgtaccacacgctgatactcatctagtaacttataccacaacactcatctacttgggtttttctatgacatattctgagactcgtgtatttagaaggaataacagactgttttgcattactacttgcatcatgatagcattattatattgcacatcattttttacctatttgggtgactagggtggtggagagcatcagctcagagcctaagagaactgtattgtactgaggacatgtccttgccctacaaaaggcaatggcctatggccaacttgtccatcctatgaagaaaatgagaggatggagatagtcggtacagagagaagctttggacaggacagagtagaaccatttacactttgcatgcacttctttttttcctgtgattatgtccaatcaaggggaaatgaattgagaaggaaacattgcacacaactcaaaacaaaatgagcagtgtgctcatcatgacactgaggtacatattgaactcaaagcatacacagaaatggtaactgaagaattggacatatcagtttctagctagctacagccaggggaatactttgggcctcgcagggagcccaggaatcagtagtctctagatcactccatgtggttttatcttacatgtataagtcttcaatttatacaaccatacaaatcttgtatccctatcccattcttcatttctttggtctagtttataggtttttctggaattgtgatgctaatgctagtttgtctgtagaaattttgatgaccaaactaattttagctaattgaatttgttgctagattcagtttactgataaacgccactatattatccagatacttggtacaggcttcttggtcattctttgtaatcttggaagacgacagcaaggtgatgtcaggtatgttatctcatctcttcaatctacattgcttgtgttgtctagagtgaaaacttggttttgttccaaacaaacaaacattgttaacattgtgttcttctatgccatagtacaacttatctttattctcttagaaatctactttacgtcatatgaaatggtaagataattaccaactgattgcttgtctttgatttcaatggttggtgaatgtttcccatctagaatatgctccgttctataagatgtatgtcttgattccctgtgtcatacaatacatagtccattgtgtcgtaggatgcttagttttacagcacaagtgctctgagggtgttagaagtgtagtgattgtgtaactgatgtaatagtttcacgtaactctgtatatcataatgttatttgtcaaactttttggcttctaaggggaagaataacaataattcaattattatatatactgggatgtcatgttgattaacaaactggtgtttatctagtaagaacctggagagcaaaattggcatggacacgaagttgctcactttttgcccctgttgacgttaaatttgttatacttacacgcagtgcatactccatatttaatgaagacttccgggagctaccaggaacgcttaacgcggagcgcatcgatagagacattcgggcaggccaattttgagcccgaaatctgatttactgggacgatgggcttaatgggatttgtacagaaggatagtgactcttctttggttctgatcctttgtacctggaaagacttttgaaagaggcccttagcagtgtgaatttacatgtgtacttcacagatggccagcattaaggttgaatggttgagatgcaatatgagtgaggtttgaaaggagggatgcacacatacatttactaatagatcagataaatcaaaccgagtcaatagaagcgcacgtatgtatgtcatgtaggagtataggtgagatttcaatctacatcaggaattcatgaagtaaatgtatattacccatcatgcgttaacataaatatcagatattcagatcccgctgtatgtacatttgccttgcatgataaatctgcagcaatcaaatgtggctcagcactatagcctgaaattcagggaatcgccatataatatctagagtacgtactaccactatcttaagcttcttaagagcaaatagtatttgtgaaattcagaagccgttggagttttctctgattgaacacctcgacttcaacgatgaaggtggagctgacaggtcgatgatctgagaggttcaaacctgagctccaatatgatagttgcttgataccctttcccagccatagtatgcgatcacacctgattcagttaggaggtacgtaccaaatgaggatcttaaaagaaaaagaaagccggagacaaatgacagaattgactatagaagttcagaaacaaagcatatcactgtctgatcagtacaactgacggtatatatttaggtctacaaggaaacatgaatgaacaatttaatgacagaaacatgcacttatgtggttaaaaagagtatgttcagagatttcaccatgctggagatcttttattccccacttcgtcaggtttctccccaacatatttacttgaatttgtttcatacttgtaagtaggcggaaagttgatcaacccctccttccaaccagcaaaagtattcccattggtcaactcctttgttagctaaaatatgtgccaaaaagaatttataattaattttcagaaaacaggaaaagaaacatccccagctttagggtcacataatactccatccgtttcatattataagtcgtttgatctttttcctagttaaactttgttaagtttgatcaaaattatagaaaaatttaacatctaaaatataaaattagtttcattaaatctaacattgaatatattttgattatatgtttgttttgtgttgaaaataatagtacattttttataaatttggtcaaacttaaaaaagtttgactagaaaatagtcaaacgacttataatatgaaacggagggagtagtgtctaatcacgaagcagtagaaatcattatcaaacctgatcagacacgacttataatatgaaacggagggagtagtgtctaatcacgaagcagtaggagggagtagtgtctaatcacgaagcagtagaaatcattgtcaaacctgatcagacttcaagagatcatcccatctcttcatagatactaaatctcgaatttcagcatccggcatgtcaatacgataattaagatctccaaaccaaaatatttgactgctcgaaaattgaaattctgatcaaccatcaaaactgaaagcatatccatcacagtagatgtaaagtgcaatgcaacattgtcaaaccgcctagtgccttgatgggtaacagccttcaacaggaattgggaataaactgtactgtttgcagaacttaaatgtagcattaagaaaagcataataggtgacacactcattttggaagcggtgttgatggtctgcctgaactagttacgcaaaattgcagccatatgctttacaaagattgccctacatgtagttacattttttatgacagaagaaaaagggaaaaacaaaatttagattcctagattctaggagagaaaaaacaaagcatgttatgcctctaagccatcaatatcaaaggaactataattattccttttattgaatcagtgttgtttccatataaatttctttgttggttgggataaccagcactgaagacataaatttagtacaaaggggacaatggattggatgttcaaattttcacccttgcatgcaacatagcaatgcatgctcaatcagtttgctaaaaggtaaatgtaaagagtgaagtgtatatacatactcatgtgaaggaatcttttgtgggtgaccagcagcaaacaaggaaaaaaatcttgttctttgtaaaatctcatccacatcagagttccttttctgttgatccccacatttatggccagacgcaagatgtgagcagacaaagcacatccgagtttggaaaagagacatgctaatggaaatcgatccctgcactaagcaaaattgagatggccaaataaagttaaacatcttgattcaacagttacaccaacatactgtagagatcgacaatcaacagagggaaggatgaccttgtttcccatgtagcccagaagtccaaccccaactgaagctacctccaagttgttaacgtgttgcctcagcttacgggaaacccatacagaaacatatataccaaccatctgtttactaacaacgcgcacgtaatttccaggaggctttaaggattctccttttgcaaaagttgccctttcatcaggaccaacaacagaagttgtgtcatctgatgtccaatcagacatataatcaaccgaactaagaacatctaccttctcttgctgttctgaccatgacatgccaagattcccagagctacgatatgatcgtcttatcccatcttgcaatgctacaccatgtagatcaaatccttgagcgttctccaaatagtcggtgttaaatagccccatgctcattactctcctcaaccctctatttgataccgatatttttgctggaatgtctagtgggcattctggccagtccaatgaactagttccatccaaccagtcacagctgcacttacttatacttgtttgcttatctctacactgttgctgaggagataaattttctgtcattttatcatattcacgttttgtatcatcatgtccatcgtcagaaggaataggtactcgcaatggtgatagtggagcactgtagcttttacaattcgccttgggttgttgagacttattgagagcacggcggataataccctcccatttaggtactgttctactatcttctgctcccaagacattcccaacgcttaatgggaccacttcctggaaactgaaacaagtgaaagactttaaataggatcacagtaattagccatacatgcttgtctagtttggccaaacaagcacaagctccatctcaggattctaacgatatgccaattagatgtcagcagtcaagtatacaagaaaagattgaatgttgtgatcaatttatccaaatcataaagtacgattacatagtttcaaggtacgcaccctaaaatatacatgtcagctggctcttgggaacaaatccactgatctaggtcaagatcttcactaggggctcttccagcaacgttccatgttcctatcatcaccctggtggtaaccactattataaaatcgccagatgcatgacatggaatgcactgaggattaaagatgaactcatataaaccaaacctcatatctttgttacttatgtagttaacacgcaaactttctgatttccttctctgtagtcttcgcagaggcattattttatcccctaacaaaaggggttggcaacttgaaatcaagcagataaaaaagtctcacgaatttcaactgcagaagtatttattcactacacaataaacataaacttgcactgacaatagaaaaatctaccaactgtaccctgaatggtcagtagttgaatacttctggtcctaaaggctaaaccatagttaaaaagaaagttatcaagaaatgtgcataaactaatatatgcacgtgataatagttctattgtttgctatactgtcaagtgtcaattagacaaatagttaaggggatgccatctggggttgccacttgccagtatacaagatgccacacaatactcatgttctattatttagtaatctatatgaaatattcaaaaactatttctatgaccatagtaatggtcaatgtattcaatatcaagatgtggaagcaagtgactaactgcacagtggttgttctctctgtcctgttttcaatatttgcaaccaatttttttaaagagaaagttgaccacaagaaatactatggtgtgtgtgttaaccatatgaaaaataaattgatggatttctgattagaagtcctaccaccatgttataattttctagtataatactatgtcatggtcaagattccgtcgatattgtgagaactcaaaaaaaaataccagccaattattcattccaaattttatttatggaaactctgtgacttgaaaggaaattatcttccacatctaaaaagagtaatagatggttgttctgctatgattaggagcagtgatcatgatttattcaaagtgattagtgagaaaataaaatttgtaatccacaagcactgggtttcaactgatgataatgaatacaactttagcaccaaaatgcatgacttagcatgattatgaaaaagtcaaagaggcgaggatacaatttcacaatacctgatgatctgttaatggtgtggttgttttcatgtatctcaaagaagttgtcgctagcatcctctgcgcagtcactgaaatctgagagaagacttgtaaattttgattccaaacagacatcaggagttcaaacaaagaaatataaaaatcaatgctcctgcaatttaccataccctcatctcctccatctgtatcaaactcatcttcactgaaatcatttaattttggcttaatgtttagccatttcttcatcacaattaaaggccaaaatgactgtattgtacatcagtcagattagataactcatggtataaagaataatggcaaaaagctaacacaatatatacaaaatatgcacatgaggttctgatttctgcaaaccttctccgactgctttcctctttgggatcccatgatctgcaacgctatgaggcaggcaatgaacacagctccaaatatatctccagttcttaacttcatcagaaggcaaacttatatagttatatgttccaactacccaaccaaaggaagagagataaatgaaggaaagatgcaggtagttaaggtggaagtcaaaaacataacaatcaaaattcaaaaaggtcatttccactgcattgcagaaatcagagaaactaacagagggacaaagtttatagtaagttcaccattacctgttgtccatctccatcaaagtacagaataattttgaagcattaaaatccataccagatacttctattgctgatcatgtggtaatggagaatatgaaagtagacatcaatttttattaaaaacaacaagtccttttccagaagaagatgcaaaaaaataactggtggacaagatcaaatgcttgtcctgcacttgcatgaattataaccaagtgcacacggtctaacaagacattacctaagtgataaggaccagcactcgcactggcacactgttggaaagagatggaagtgtgcacatatggatggatcatgctggattagaatgtaaaatacaagccattactcgttattacgggcacttattcatgaaaaggttttatttacgtagagacaaagaatttgtcgatatggcactgtgtgtggtccttgggttcatccactttactttgtgagataaaagatgacaaaatttggttggtaagcaatcaataggagatctcaagtaactgttcagagcagcaagagtagcaaaatggggaaggatgcctgatagatatgtggctgagaaagagctgaaccagattgaaataataattatgcaatggagacgaagatgatggaacacatagaagcaaaaggtttttgaaatgggaagttgtatcttcaacttgccagtaagatgtattattctcaagcatttggaggaaacggacacatcaaaagtggcaagtatacctctaacatttttcttaaaacaattatgttttcacattcctgactgtgacttgcaattactgttttccataaggttgggtagaaaactgtcaaacgtaagcatatgcattcctgaaaacaagatagcacccatagcagacaaaagtatgatgatcaagattaataattttaaaagtagtgaatttatcataaaaatgattgtggttttattttgttattatacatgaaagattaaatatgaagatgaaatgtgaaatggattctgtcatctataatagcacatttcctacatggatgaccaactatcctttagaaaagataacttactatatgcaggggttaagtttctcactgtatcacacaagcaagctgagagaacattatatcaagatatgttctccattacagcactccaagatcagaacgaatcaatttcccaaaaaaaaagatattaaagtgtgcatactgctgtactttctatgaccaacctaaataatttatatatttcaataaatatttatcgcttaaataagtggaaatcaagcacttcatgggaaaattcgtactaaatactaaggacagttgcaaagaagtgtgctggccaaaatacgataggtgaaaactgaaatgtttgcagcagtgggaccagattctaatcccatttcttggtttcttctttgatctgtatcatcatcaatcagttctccctggcacaataccttgtcaatcagctaaaaactgcacatgtgcagctgacacattccatgcatcccactggctaaggatcttataatcaagaataggaaaatgctacttctgtaattccaaccacacttgcatacagctagttgatcttaacataagaaactggggacattgttgtcactgtgctaccagtagtccaggcaagaacaagaaccacttttgaagtggtggaaacggttacgatctctaacaactatcactcgatcatagacctcggaaactaccttcatgacagagtgacaatcctcgcagattctcaagtttttcactattcggataacagcccctctcctcgtgtttatcagtccaaaggcaactgccagcttctcactgtgctgcgagatacaaacttctttgtcctcctcatcaatgtcaaaggtaactagtttagtggcaggcttgtgccctttgaggctcaaggttttgcctatctcatcaagcattgcatatatctgatcagactgaggatgtgaatgatccccagacaagaactcgtaaacaacaccatcaagttcgacaacactcgatcctggaggcttgtgtatcctgtgttgtttcatcgagctcctgacctcttgtacaaggtcccatttcccagcagccgcatatacatttgataagaacacccaggccccggcatgctggggatccaacctgagaatttccatcgcaaccatctgccccatctcaaaattcctgtgacatctacaagccaccaagagagcaccccatagggcaacgtcagccttgaacgggacggccctaataagagccaatgcctcctctagcaggcctgctcggccaagcagatcgacggtgcaaccatagtgctctatggtgggttgcagatgatagtcgagaggcatacggcgcaggatcctcttgccctcgtccaccatgccagcatgcgtacatgcgctgagaacggcggtgagggttacggaatctggctgtatgttgtggtccttcatgtgtgtgaacaaatggagtgcatcggtggagaagccgttgagggcgaggccagcgatcatgacggtccaggtgtggacgtccttgtggcgagtgggagtggagtggaagagggagcatgcggtttggacgtcgccgcacctcatgtacatgttgaggagcgcggtggcaagatttgttgtgatggggaagctgcaggtggttgcgaggtaggcgtgcgcccagcgggcggtgtggagcgccccgaggtgggcgcatgcggataggagggcgagcagggtgacgtggtcggcagtgcgcatcgtgcggaagaggcggagcacctggacgtagtgggcgcgggaaaggtaggcgtgaaggagcgagttccaaagggggaggtccctgtggtataggggggctgaggtcgaacacctggcgtgcagcgggcaagtcccccgcggcggcgtacaaggagaggagggatgccctgatgaacggtcgggagactcgaggccgcggcggaagagggaggcgtggagggcaacccccgcagcagctgcagctgcagctgaggaggaatcggaatcggcaaggcgcgcccagccggcaagaagtggtgggtaggtgtagttgttggggtggaagcgggagtgggagagcatgaagcggtagagcaaaatggcaaggtgggggcggggcccgcgggcgagggcgcgaatggcggagttgtaggaaaaagtggtggggtgggcgcggaggatggagagtgcgtaggggagggaggcgagggaggcggcggcagcgagggggcccgccgcggaggggtcggcgaagagggcgccggaacggaggaggtgggcgtggagggcctttggacacgtggcggtggcgggcatggtaatggtggtcgtcttcctcttcctcttcctcctcgccggcggccggaccggagcgcggctgtcactgtcactctcaggccctgtttggctaattgatatggaaatgatttccacccactaaaagacatctttaaatcttaaccatttattctccctcttttatttaatcctaacccttcattcatttcctaatcttaatcccacccctcatttcccgttatccaacattatccaaacacactctcaggggaagagacgagaagagcggctctctctctctcgtgggcctctcggcccaagatctcaagggacagacggagaaagagggagctgggcaagtgggccccggagggcagtgaccagaccacaggcggcgtggaattcaaaggtgagtcgtctcgtcgtaagccatgcgcgtggtttctttcttcttccttaaacctgaatcaatctttctttctttctttctttcttgtctactagtcttctactggagtaggttctacgagacacaaattagacaggagagatcgagtttgaaggcaggaaggcaggcgatggcgagcatggagggtctgatcggcctgatgaaccgcatccagcgagcctgcaccgccctcggagaccacggaggtggagaaggagccaacctccctaccctctgggagtctctccccaccatcgccgtcgtcggaggccaggtcatttgcttccttccttccttgcttcaattaaatggattttttcttttctctttaaccttattattatttttattattatactcctatgattaatgatgcatggattggatgctgatttctagactttgtaattcatttcattttggcttgtgcacaaacagagttcgggcaagtcctccgtgctagagagcattgttggcagagatttccttccccgtggttctggtaattataataacctcattcaccccagtttccctttcaacactatcttacctcccctcatctatcatctaatctaggaatcgtgacacggaggccattagttcttcagctgcatcagatcgacaaaggggcccacgattatgcagagttcttacacttgcccaaaacaaggttttcagattttggtgcgaacttgaaatcaatccttccccgttaatttctttatacagctttgcaatattgtaatgtaaacctcacatctctgtatcctgctgtttcttgcaaataatgctttagttcaagtgtctgtcctattgcactattctgtttccactgctttatttctgatttaaaatagcactgccaaacttatatatcaacatctttctaaaacaaaaggaaaacttatacttaacagcaccacttatttttctctactgtggtgtagctcttgttcgtcaagaaattgcagatgagacagatagagtgactgggaaaactaaacaaatatcccctgtgccaatacatctcagcatctactcacccaacggtaacctcttcctgttgcaaatgtgcaacctatgttgtaatcccctcccagaaatgtatctccatcttgcaaattgaattgaactattctctggaccacccgagccctgcgattgtgtttcactggtggaactctgttaaccctgtaacataaactttttgaaatgtatgggatcttcacgaagaaagaaagttttaggtgggccagtttgcggcctttcatataatcttcaaaagatactctatgagtatatctggacattaagatgctttgaatgatataccatgcatgcaatagttttgtgattatccaagtttgtagctttctacagtttatccagattctctcatactatataggattttgaatcattgtcaaagactcctcaatttaaactaggatttttaatgtctgcttcacatatttctctcatactatacattgattggctaatagtagtttactcccatatgttgcagtcgtgaacttaacattgattgatcttcctggattgacaaaagtcgctgtaggtatgcactattatgtccttttttaatcaaagatttaattctctctcttttgatactgtgtttagtttatcgtgcatcccccccccccaccttcctctaacttgttcaacttctaattcacagagggacaacctgaaagtgttgttcatgatatagagaatatggttcggtcgtatgttgagaaggtaatcaacaaacgaagtagcattttttttaataccatgtcttcagcattcttgtactagtagcaaattgatgacattaacttggctgctgttttggttgtttaattattcacacccaaataactttaggtgttatattgtttaattaatttctggtgttcaaatttgagaacttatacaaggctaataggttactttgtatgatattttgcagcccaattgtatcattttggctatatctccagcaaaccaggacattgccacttctgatgccattaagctttcgaaggaggttgacccatcaggtactaaaattcagtgcacatagagggcaagagatagtgactcttttacttttattttctgcggagaactcatacaaataaagtaaagtatgttgctgtaaactttgatggtttgttatagctctacagctaagattgttatcttctacagaatgctgcagaatagtttgcttttatcatgatcctatctgactggatttaccatccatttttattttctggatgacaatttttctcttttacaaggtgagaggacattcggtgtgttgacaaagttggacttgatggacaagggaacaaacgctcttgatgtaagattgaacttgcctgccctgacaaacagtagtctgtctgcacattgtcagtttcagaatatctacatgcagcctttttttgttcttaatgttcatatcatacctctgacctgtcatttatctgtaaatttaaccttgttctatctggactacctcgactattttcatttcccccaaaggttcttgagggaagagcctatcgtcttcagtatccgtgggttggaattgtcaaccgctcacaagcagatattaacaggaaagttgatatgattgttgcaagagaaaaggaaagagagtattttgaaaatagtcctgattatgcacacctagccagtaagatgggttctgtgtatctagctaagcttctttctcaggtacctcaaacttgaaatttctcgtttctttgagttggtatatgagcaaggcttaggacttgcataattgctttataacattttcagcatcttgaagccgttattaaagcacgcattcctagcatcacatcattaatcaacaaaactatagatgaacttgaatcggagctggataccattgggaaagaagtggctgctgatccaggggtcagtcattcatatatattttgtactaaaagtagtttttgccgggtctgtactaaaagtagttacaggagtatttgtcttgttcaattttatattcaccgcttccataatgttgtgccaggctcaactgtacactatattggagctctgtcgtgcttttgaccgtgttttcaaggaacatctggacggagggtgggtaattaattatctgtcatcatcttaatggcttcttgtatctctcttctaattatgtaaagcgctttaggttcagttctaggttttcattttagaaatacttatcgttatcataatattttgacttgttgcataaatgttgcttatgaaccataggtagttgcatggcgtatcaacatcactcgtctcaggataatacatgctgaaagtgcacctgtttatgttgagttcccgggacttatattgtatcttccatgtgaacatgaaaagaatttacagaacatgcctatcttttcagaagatggaagtgcatacttcataatgtgtaaacggatttagtcaaaaaaaataatgtgtaaacagaatttataaagtgttcataagttttatacgacaccaatatacctagatttttttttaattagttgtcatttaatatgatgagatcttgtccaattacaatattataacgttcattttactcctttaactgtttgggtgcctaactgttgcaggagatcaggtggtgataaaatttatggcgtgtttgatcataagctccctgccgcttttaggaagctgccttttgatcgttatctatccgtgcaaaatgtgaagaaggtggtatcagaagcagatggctatcagcctcatcttattgctcctgaacaaggttaccgtcgtcttgttgaagccggccttgcgtatttcaagggaccagctgaagctacagtcgatgcggtagctgactttctatatatacatctgtgctgattgatttgttgtccgttagtttctttaatcagtggccaccaggccagtagagtaggcactttgtgctgtacgctttacttcctggagtatatatatgctagtagttatatttgatatgtgccaattaataatactctgatgttggtgttaggtgcgcatttgatgaggtgtcctagcttccaaacctttggaaggaataatgctatatatcccaatgtgtctgatctgccaaatatattatttttttcaggtccatgttgttttaagggacttggtgaggaaatccataggagagacagaggttaggaagaatgaatatatccatatttctttgtgttttggaaaatggtactttatatatgttttctcactaattgcagccactgagaagattccctaccctgcaagctgcgattgcaactgctgctaatgaagctctggaaaggtttcgggaggatggacgtagcactgcacttcggcttgttgacatggaggcatatttgacagtggaattcttccggaaactcccgcaagatccagatagtggcagcaaggttgggaataataccaatgaatccaatggctcaggctcaggctcagtgacagtggaccgctacggcgacgggcactacaggaatatcgcgtccaatgtgtcccagtacataaagatggtgggagaccaactgttacacaagatcccaaaggcggtggtgcactgtcaggtccgagaagccaagaggtctctgcttaaccatttctacgtgcacatcgggaagaaagaggtactaattaactagtagtagtagttaatctccttgtcatctagggtgaatgcatggaatgaaagtaatgagttttgtggttggagcaggcgagccagtttgggcatttactggatgaggacccagcgatgcttgagcgtaggcagcaatgctggaagaggttggagctgtacaaatcggctagggatgaaatcgactctgtcgcatggaccaggtagacacaaacatatacatggtggctagtatcttttgtcgcagctgcgtgtagtttggtttgggcagatctaacttccatttgtcaggcaggcactattttcccttggtatatagtatatactatactatcttacgaattgatggacgttatatatctgtatattttgtcagtagatcatccttcgtacatgtgcaccccgacccgtgccatgctggtttcaacagtttttcttttgttattctttctagtggttggcttctctctgttgtcacggtattacatatgttgtattattccctccgtttcacaatgtaagtcattctagcatttctcacattcatattgatgttaatgaatctagacatatatatatcaatataaatgtaggaaatgctagaataacttacattgtgaaacggtgggagtatatggtaagccataaatgcctcatgttgtgatgcatgccaaacagagtaggggaatgaatttaccgatgcatgctaactgtcctggtaatctatgtactcttaataagttttggatacgtcacgatttaactatattttttattataatatataggaaacaagtaaatatcaaattttaatacagtactttttacgactaatttatacatcatgctctagtgttttcaaactaaatattttaaacttattggtacttaaagtttaaattgcttgacctcaagtttgtccaaaatatcaagaattatagaaatgggggaagtgtctagattactcggcaaaacgatcgagatttttgggtaaatcaaacgcacctatatataagtttactaattagcaagagctggtattataagtcactaagcactttccaaacatgtcatataggctcatatgataagaaagagataagagaagaaagaggacgaggcaccctacatactactcacgtgtaatttactttaatatttacatactactgtatttgagtccttgtaatttttatatttacatttaagtccctataatcttgcaataagatacttgaggttgtttttgttaaaaaaataataaaagggagataacaaaggcagaaaagtgcataaaaagaaaaagaaaatccgcaaaaaaaaagaaagaaaaacaacaacaacaacaacaacaacaaaagtctgtttctcctaagtgacaaaaaaaaaacccgaagatccgaacggaaaaaaatcctattcttataaaaggcaaaaataaaatggtgaaaaaaaccgctagatttgatccctttaaaaaggggggaaaagaaaaaaatgcgattcctttaaaagtgaaaaaaataaaaaaaaacatttaaaaagttcgtccgattcctaagaaagtggtgaaaaaaaggttcgtaaaaaataagaagctggttcgtataaaataaaaaatgcacccgagaaaaaaatggaaagggcgaaacaatgttcgatttctaatcagtatatatctcttctctatctctaatctaatctaatctaactattttaaaatagaaaatgcacgagaaaataaaaactgttcaaaaaacgtgtgagaaaaaagcgcaaaaaacacgctaaaaaggttttccatcttccataaaacaaataaaaaacgcacgagaaaaaatatttccatcatcggtaaaaaaattataaaaaacatgcgaggaaaaaactgtcagaaaaaacacgccatttctaaaagaatggtttgaaaaaacaacgcaagaaaaaacaccgtctattaaaaaacaaatcgctctgaaaaaaatgtcagaaaaaacactaaattgatggacggttgagtcagataggatccattgattttttgtcatctactacatggcttttatttcgtcatatattatactcctgtattggaaaaaaaggcaaaaaagaacatttgaaaaaaacaagcaaaaaaacacgcgagaaaataattgttagaaaaaacaggcaaaaaacacacgagaaaataaaagcaaaaaaaggggagaaaaatatggttttcgtcgtcagtgaaaatagcaaaaaaaacatgctaggaaaaaaactgttagaaagaaatgcggcatttctgacaaatggtttaagaaaaccgcgcaagaaaaaaaaacaccgtttataaaaacaaaccgctcattaaaatacaaaaattgtcattaatatgattatacatgaaaaagtatattatgattagaatattttcacccattataatgcacgggtattttttcagtataatataaatataaaagcaagaagaggaaataataataaagggagcagtgtaggaggtagctagtagcttggtgcggtgccgagcgcgtagctcttgagaaggtcaccgcagatggggagtgggcgggtcttgaggaagccgagaggattggcgcggcggaccatggtggcgaggccggcgtcctgaacgagggtgaccggcgcgcggtcgcgacccacctccgtctcgtggcattcggggtccgggctgctgagcagcgccaccgcacacacctcctcggcgccgcggttgtccaccagctcgatgcggtagtgccccgccgcgtccgtcgtcccctccgccgatctttccaccgccccg

SEQ ID NO: 32359 - DNA, 8839 bp, Oryza sativa
aatcaatcaatctcgataaattaataaccgatcctgcttatatatatatagcagctatatatatatcgaatagttgaagcgatcgatcggctgggaatggaacgacggcccaattaatcaggtgatccatacattaatttgcattgcatgttatatatgactctattgttagttagttaagttgcttgcgttgttgaccaatcgaaagtactcctaatgaacttcccctacaattaattaaataataataatgcatgagagataatcaacatagtactagacatatatataatcaaatgcctcctctaaagactaaaatactaatcatataagtacaatcaatccggatggatgaggatacaagcaaaaagctagctgggactggtagtatacatggctctctcaggatcggaaaagaaaacaaataagctagcagctaggagtattaattaattaagccatgatgaggagggcggcgagtaggacggcagctgcggcggtggccttgagggaggtggcggcggaggagggcggcgaagggggagtagtggtggccacaggcgccggggcggaggaggaatctgcctgcacgacgtcgatctggatcttcatgttgccggtgccggtggtggtgcagtgaccggggaagccacagatgaagtagcgggtgccggtggaggtgagggggatgacgtcgttgccggtggtgtgggtggcgatggaggtggaggtggagcacgagtcgtaacccgccttgttcacctccaccacgtcgtgccgctgagcagagtacttgaacactgcaaccatccccatccattaccatatatatgtattcaccggcagcccagccaatcgatatatacgatacgattctgattgcatacctatctggtcgcctggatggaacctcttttgggcgacccagtttgtgtagttggtggtgagatcccatgcgccgcccggctcgcccacgttgtaggtcgccgccgacgccatgcccaccagcatcgccgccatgcccaccagcaccaccgctactcctcctatactacccatatatactctacctggaaggggcaaactaattaaagcagaggagctagttaagctaactactctgaatcaattgctgtatgctttaatttgtctgtgatcgatgatcgatgaaacaggcagcttttactggagtatatatataagcctcctttgcaaggtcggttggtcagcaggtaatactagtccacggttggtaggtactcctactaattattattgtctttttttcttatttttcatttttgctccttctttttcttcataaaaaaataaatacattatattatttgtgatggcacgtctatccgttcacactgctcatagctctagtccttaagtacgactcactcaatccatcagaccatttctaaatatatacgcatgcttgattaagtaagtatgaattattatatatttagaaaatagatttatttttttaaaaaaatctataaatatactccctctatttcaggttataagatgttttgactttggtcaaagtcaaactattttaaatttagctaagtttataaacaattataataatatttatattaccaaattaattttattaaattaataattaaatgtatttttataataaatttattttgggtcgaaaatattactatttttttctataaacttggttaaaattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttaggttgctcgatcatttgcgagaaatttgataatatgtcatccattccaatgccgtgtacttttgcccttcgccacgtacacatgtcagatcttaggtcccgcccaacgccgttgccgctacgcccttccagttgatctatccactcaagatcgatccaagccaagcttgcccgcccctatctatgtgcctcgccgcctcggccacacctttgctgctgtcgtcaagaggaggagctggtaattaaactagcacctgttttcttttcaattaagtaataatataattttcaaatagtaattaagcttatttacacctgcttgcctgcttaattgcaaattatagtatattacatggtcagcatgtactgcaggtggccggtcgttgtacgcgtaaaagcgtaacaccgtgtttagatcctaatttttttttcaaacttttaactttttctatcacatcaaacttttctactcatataaacttctaactttttcgtcacatcgtttcaatttcaactaaaattgaaagcgtgaaataaacccaggctaagaagaattggaggaagaagaagaattctgcaggttgttggcctgctgcagtctcatcttaataatttccacacgatataattaatttatactagtaccacaagagagttccaaattggcggctcaagactactgcggctaactggtcatgtgacacgtatgttagctgccagttgactactctgctggcctgtggcgtattacgcaactaaactaatcagatcgatccattgatagatcatcattcaaattaattctgctgacgacaattcgatgtacactaaggctgcgttcgtttggagaacaaatgggggaatgtttgtttcgttttccgcgcgcacgtttcccaaactactaaacggtgcgtattttacaaaaaatttctatatgaaagttactttaaaaaatcatattaatctatttttaaagtttaaaatagttaatactcaattaatcatgcgctaatggcttacctcgttttccgtatcttcccaatcttctcaatctcctctccctcaaacacagcctaaggctgcgttctttcaggagagataggggagatttcactcgttttccgcacgcacgcttttcaaactactaaacggtgcgttttttgcaaaaattttctatagaaaagttgctttaaaaaatcacattaatccatttttgaagtttaaatagttaatattcaattaatcatgtactaatgactcacctcgttttgcgtatcttcccaatcttctctatctcattttcctccaacacagccttaagagcaggtacaatagcaggctataagccagctgcaaacatattttaaagagataaaagatgagagagaagggcaatgggctacagatttgtagccagctgtagcacggactccaagacgcagtgtatgtatgacaggtgggaacagatattaatagtgtagtatataactattgtatgaattggctattaagttggctataagtgaattggagctagtaattgtctatactattaaacttgctctaagggcagttccaacccatagtgtccataagcagtgtctatgatgccatgtcaataaaacatcacaatagaaactacactctataacccatggtttcttaaaattggtcattaaaaaatacatcatatctcttctctaccaatcatatttattcttcatctattatgaagacactattctcttccaatgcaaaacttgatagtgtctagtgtataggttctcatgttgaagctgtcttgcatgagacccaatttctttctctcttcactctttctcttagttaatatagtgtcacataagctaaaaatcttacatggcaatgtagttaatgccatagacaccgtcttaggtggggttgggactaccctaggcatatccatgcgtcaacttgctactagcatttacaggtttaggacctttgatttgttggtgacagaacccaaggcgcttggatcagccaccgggcatcgatcagttgatcatcaaattaaaatttcagttgattaaaactacgtactaactggtcgtaattatattaattactcctaactagtatactatatagttatattagcaaattaattaaggacagcaatcaggggtaaggacagtcaatcgtatcgatcgagtgtatatgcatacgtgcgtaaattaagctagcatgtatgtaggtaggtactgtagctatatactgtataagtgaagtagaagtatatgacatattatatagatagtggtagtacatgtatagagagagagagagagagacgatcgatatgattgattatgcggcggggcgttggtcatcgtcgtcgtcctccggcggctgcagcttctggggacgaggggcaggctcggaggaggcgccggcgacggtgaggtactcgagcgcggtgacgacgtcgctgatggcagggcgcatggtggcgtcctcctggaggcacatggcggcgatggcgagggcctggtagaggcccttggtggggtaggcgccgcggagcaaggggtcggccatgtcggcgaagagcttcttgtccttgaagcgcggggcggcccactggacgaggttctgctcatcgtgagggcgggccatgtcgatggcgcggcggccggtgatgatctcgaggaagacgacgccgaagctgtagacgtcggagcaggtggtgagcttgccggtgagagcgtactcgggggcgcagtagccgtaggtgcccatgacgcgggtggagacgtgggtcttgtcgccgacggggccgaccttggcgaggccgaagtcggagaggcgggcctggaaggaggagtcgaggaggatgttggaggccttgaagtcgcggtagatgacggggggacgagctgcgtcgtgcaggtgctcaaggccgcgggcggcgccctgcgcgatgcgcatccgagtggtccagtccagagccgcggcgccagggggcaggtcaagcaggtggtcctccagggagccgcgggccatgtactcgtacaccaggatgcggtggtcgccgtcggtgcagtaccccagcagcgtcaccaggtttgggtgctccgccagcaggctcagcatcagcacctccacaaggaactcccggttcccctgcatcccgttccggtccagctgcttcaccgccgcctccgtcaccgtccccttgatgctcagcctcccccggtacaccggcccgaaccctccctcccccagcagcgactccgccctgaacccgcccgtcgcctccgacagctcgccgtacgtgaacgcccgcgccgtcaccttccccttgccgatcttcaggatctcgtccgccacgcgcttgtgccggtaagtcactgtccattcatttatccatgaaaatatacaatgtttgtttctttgtttgttgtattccgaaaatgtaaatatatggagtagcttagctaactaactaggagtacatacgatacctgactctgccacgatctcgttcaccaggttcaccaggttgctgttgttgtccctgctgctcccgcccaggctccgctccgacgctaaattcttcttcttgctgctgctgctgctgttgctgcagccgctagaggaggtcgagggaggcgctccgtcgccatcgccgtccccgtcgcctcctctgtcctcggactggaagcagcagaagatgcccattatatttatggtgtgctgggccctccaccaacgccaacaggaacgaatcctggaaccagagggatgatcctccaactctgctcctcaaccagcatccggttccaaactgataaggcctagccagccagccaccaatctgatgatcgatgatcgataacaaagggatgtataattttaattgagattatcaaggatgatcgccggacggcgagcttgtaccgtacgtacaaactgccgacgagcgaggcgcgcgcgcgcgaatggaatggggaaatccgattgcttaataacctttctggcattgcccattggaatggatggggtaaattaattcgtccgttattagtttattattattatttgttccgatgaaaaaaacaaaaagcagaggtgctctgtttttttggatggctcctaatctgagccagaaacacaaccaaccgcatgccggccttggcctggcaacgccaactatattaagactgcctgcagttatctatcgatccatgtagtgtacgtagtagtattttatttatttatttattgggtaaatatatatatgtatatattgccagtgcccagtggcaggctgtgcatactgttgctgatgagtggagtagtagttaacttgacagccaatcgatggatataattgaggtttgtatgcaggaatataatggatggaattatacatggatgcatgtagagtaagagtagtagtagctgctaggtcccgacgtagccgaagccgacgatgaaggcggcggccgactggaggagcaggtagatgtagaagctgtcgcggccgtaggcgatgtcgtagagggcgcagtagagcaggcaggcccccaggaggatctcggcgacatggacgtcattattgaagaagcttgtgcggctggagctggtggtggtcttcctcccaggcctggtggtggtattagctggctgctggtgcttggggttggcgttgcctcgcttgtcggtgacgacccactcgttggcgcgggtggcctcgagcaggccgatgagcgtggccttggtccggtgcatggacatgacgttctcgaagaggatccagaagatgaggagatggcaggagcgcggggtgcaggcggcgttgaggagggtgatggcggcggggacgtagagggcgacgtacttggggaggcggacgtggtcggagccggcgaggacgcaggcggggatgacgacgcagtagaaggagaaggtgaggaggtgggcgacgagcttgcggaggaagaagaaatcgtagaggaggtggagcttcttccagggggacacgcgggcggtggggcctcgaggaaaatcttgcggaacaggttggcggggccgcacgaccaccggtgctgctggtaccggtacgcgcgcagcgtgctgggcagctcgttccgcaccccgacgtgccccacgtacacgaaccgccaccccctcaggctcgctcgcaccgccaggtccatgtcctccaccgtcgtccgctccttccaccgcccgcctcctccagggctcgcacccgccacacgcccccgtgccgttgaacccgaagaagccgtggcacgccgaccccacctcctgctccacgcggaagtggtagtccagcgacatctcctggatgcgggtcagaaggcactcgtccgcgttcacgaaccgccacctcgcctgcaccagcgccacccccgggtccgccaccagcaccggcactgtgcgcaggaggaagtcggcgtccggctggaagtctgcgtcgaagatggcaaccaactcacactccctcgcgtacgccttccgcagcccctcccgcatcgcccccgccttgtacccgctcctgttccgcctgttctcgtaccttatgctcacgcccttccccgcccatcgcccgcactctccctccaccatctcctgcaatccattatatatatgttctctaattaatttcctctttccaaattactagtatatactgtatgaaacacagacgtacgtacccttatggctggatctgtagagtcatccagcacctgaatcaccagcttgtcagatggccatgtcatcccacacgcggcaccgatagaaagccggtaaacctgcgcattgcaccgtacacccctgttttattaggccagatcgatttggtaaaaccaactcttcatatatatgcacattaatttcatgttctgttctggacaatatactagcactatataattactgtggaaattaacatatattatattaactagcgtagtggcccacgcagattgcgcggctagcattattatattttctgtcatataattacatatatgttttctcaatgtattattcaaatatattaaaatgaaaacattattttaaattttgtactacctttacaaaactactaatgtataatattcatgtataatattcatattgttttttatatacatgttagttattaattatttttaatattaaattttagttatttgtaaattatattcctatatggactttaggctcttctttcaatattatttatttttaattctgaatttttattatttctaattgtatttctatgtggactctaaactcatctttcaatattctttaatttttaatttcgaatttaagttacttctaaattgtattcttatattgactttagactcctcttcccatgtttttttaattttgaattttagttatttataaattatatttttatatgaactctaaactctaattttaattttattatgtttattctgaattttagttagttttaaattcttatatggactctatactctacttctaatattccttatttttaattccgaatgtctattatttcttaattgtatttctatatggactatatactctacttctaatattccttattttaattccgaatttctattatttcttaattgtatttctatatggactctatactctacttgtaatattccttatttttaattccgaatttctattgttctcaattgtatttctatatggactctagtcttctcttccaatatttcttattttttaattacgaatttcaactatttctaaattatatttg

SEQ ID NO: 32360 - DNA, 7198 bp, Oryza sativa
aataaatctagacatatatatatgtctagattcattaacacatatatgaatgtgagcaatgctaaaatgtcttataatatgaaacggatgaagtatatattttcatccctagagaggataatctcatttttcataagatagatcaaatatatattttcaagctgggaaagcatatattttcatgcacttcaagtttatattttttgataatctcattttctcaatacacaaacatgtaagttcaaatttaatttctataaattataacaaaaatatcaaataaaattgtggattcacatcaactgatttcagtttaatttattattttttacaactcgtagaagtcaaatttgatcttgcatatattgtaaagtgatatgtctcatattaatttatcttatcaattttttttaaaaaaatatgactatttagatggtaagagatgtctcctcgatggataaaaaacccatcttccttagatcttaaaatctactttctgcatgtgcttttgttagttagtgcatcatatgtgtctattcggtcgtttcgcacgagctagctagcgatctaggcactacaaaaattgatttttgcatgcttctaaaggtgcgtatcatggtgctttctctgtttcatgctacaacatgttttgatttatttatttgtcatctaggctcactagtgttcatataatatttttagatgggatacatccatataaatttggacacaaacacattaattcatatataaatatgttcaaaatctaaagtatatattataattaatgtgaaatagataaagtagttgtttagaaacgaagatcggtacggctgggaagcaataaaaccagaaaggaaacatgacagtagtgatgatgcgtgggccaggcgcaatcaatggagattttctgcaatactgctggtgcagtagcagtggctgacgtgtggacccggaaccatatgtcagtctctgctactacatcagcagtactgcagaggatgtgcatctaggcgcaatatatgtatatcatcgttaagtactagtttgtttcgagatgtaatgacgtgcactcctatagttgacatatatactgttgcagtgccatgcatatattataaatgcacttttcatactagctagctgatttgttttgcgtgtatatataattaatttcttactttacattagacgacgtggacaggcatgtagtggaagcacggagagcaagttcagcatgaacgcacccactgaccatgcatttgcgcgaactaacaatgtactacatgtgaagttcgttttttttttaaaaaaaaaagaagaagaggaagaagagaagaaatcaggcattttgcatgaggaatagaaaccacaggcgcggcagcgcgcagctgggggatcgccgccgcggccgaccgcaggccaagcttgattaattgtacgttctggttgctcgatcgcttaattaattagtatatatgtgtgttaattaattaatgttacacatatgcattgctgtttcccagcgtggtgtggtatgtacatatacaagtgtaggcggctaggcggtggcagtgagagatggtggatggatcgataggagtaaaagtgttgggtcgggaaaagccaagaaattaaagaggacgtatatacagtacagtacagtacagtatagcaagaggtagcacgcacagattactactgacctgtttctcattgaacatggggatctgcaccaggaccatggggctgttggccgcctccgggtcctgcagcagctggtcgttttcagcgccatcgtcgtcctgctccctcctgttgctgcggcggcggcggcggcgaatcagccacagggcggcgacgacgagcgccatgtagagtcgctcgaggaagagcatgatcgacatggcgacgcagacgtagacggccagctgcagcgtcggcaacaccaccccgcaccgcactgcccgccatgcccatgccaacccgccgctcatcatccggaccgacctgcctagcttgatcgatcttacttaaattaattaattgatcaacgtaccagccgatcgaatatatcgatatacaggagtacagtatatatgatcaattaatcgatatgatcgatcagttccccgggcgcccttcgacttggatttgaccgcccaggagctgatgacccgcctgttctatttctatacatatgagtatgtatgcaacattattaatttgggatcgatcgatatgatgtgtagtggccggcctagctctagcgctaagctagctgcgtgcacatatacatatcttgattgagcagctagctagcttggaattggtatatatagtgatatatatgatcgatccagagaggaaagctacagaaactgctagctactacttaattaattaaagttttcttaataaagggaaaagggtctcctcctttaatttgtgtgtgcatgtatatattggccggtcagcctggattcatgcatgtttttttctttaacaatacgcaaaccagccggggtcctcctcctcctgttttcaatacaaaataatgcgtattttttcttggcctgttttgctttatttgctggctgcctacgtggtatatatgggtacagcactagagccaggtcagggccggtgcatatgcggtgaggtctacacgtatctacgtacatacgtacacctttattgtcatatgtagcctaccattgccatacagctaggtgcctactcagaagacatgtttgagactgctgctacctactacgtccgtcctaaaatatagtaacttttggctaaaatttagacacatagttgtccagatttatagctaaaaatacttatattttggaaattcgtcctaaaatataataacttttgactataaatttagacacacagttgtccagattaatagctaaaaatgcttatattttaggatagagtgagtataattctcatgtaagcctcttcataattagtacacgcacgcatcgatcgtttccttcacattatatatatactctctcacaagtcagatccgttctccccccctaaaaaaaaggaacatgcatttgtttaattaatctctgtttaaatctagagttgaatttgccgttatactaaatacgggatacctcaaagatatgcacatacatcaaagaagtaacacttacaacttctacgagaagacaaatcccttaaacaagagatggctagcaacctcactctagccagcccgatccaaacagctagcaggttgagaaggtcgcagatccgatgcaactgatgacctcctcgcttggtgatgcggcggcaatgattgcggtggttgtggggaaggggagggaggatggatcgtgggaggggaaggaatgcaagggtcgaaggggccgagggacttactgcaagctaacttctccttgtttcatacattccaatttatttactgaattaccacgattcatgttgtgaaccgacaatgatactgtcatgtatctggtgggctgcatgggctgctggagaaatgggcttggcctagctcacatactgaaggtgcaagcaaccaagaagtataaataccaaccgtggcagtgagagaaggcattgatgaattagaacctgatggctgtggcctcttcttcctcctcttgatttctcctctaatcccctactctgtgtttctctgattccctttaccccctgcttctcttcccaatctctgctgctagttcttccaatttgtatccctgaacttgatatacagagttggagaggatatattgctcctgtgcttgtgttcaccagtgagattcatgtgggatcgtgacagatacaaatttattacggtagtcacccgagtcgcctaacaacccatgcccttcccctacaagggtgatgatggtacacgcgaccgatgtgcaggcatcatgccatcacttgtcactccttactaaatgcgaaattcgcttgtggacgagcacgttgcatcccgtcgtcattaataagttgttgtttccctcgagttacagatgtgcaggctcgatcatcccgtcgtcgcatatgctttcaatagttgtatatagctttgtatttgcacaactttaacctccctccatactaagaccctgtttggatccgaagggctatttaacagtcctttggaatcttgctatttaagagtattaaacgtagattactgacaaaacctattccataacttctaggctattttgcgagacgaatctaacgagatatattatcccatgatttgctacagtgatgctacagtaatcagccgctaattatggattaatatacatcattagattcgtctcgcaaaatagcctaagggttatgaaatcggttttgtcggtaatctacgtttaataatcctaaatagcaagattccggagggctatttaatagcccggaggatccaaacaagacctaaatgtctaggggcttgtatgtacttttttccaaataattggctcgatcatcccgtcgtcacatatgctttcaatagttgtatatagttttgtatttgcgcaactttaacctccctccatactaaatgtctaggggctcgtctgtacttttttccaaataattgaaatgtaaacataggagtagggtgtatttataaataaaaatatattaaatgtttgagggtttattggcaatattatttattagccggcacaaactgggtttcgtgcaaacatcgtcaaaagtcaacgacattatctataaaaaaacagcaaccgagaaagtgttatttgtgcgcctacatttaaataaaattacattatgcattattgtgaatataatataacttgctgagatttattcttatataaagtggctcaaagtatagccagacgatttaaagttctttcactattccactaagtaccgatctaacctttttcttgccatttgtctctctgtattgggcctggtattccatagcccaaaggctcacatgtggagacccacttagtggagcaacctaagcagcgactcgatcaagttggtcgatctctctccctcttcgcttgatccctttctctctccagtcttatcgcgtaacaccatccttccggtcctcagccgcctctttgatactccctccatccctaaatatttgacgccgttgacttttttaaacatgtgtgaccgttcgtcttattcaaaaaatttaagtaagtattaattctttctctatcatttgattcattgttaaatatacttttatgtatacatatagttttacatatttcacaaaagtttttgaataagacgaatggtcaaatatgtttaaaaaagtcaacggcgtatatcggttaaatatgaggaccgcctccgatattgttaaatattgttaaatatgagggagtatatcggttagattggtccacctccgaggaccgctaccatcaccacctaccggaatcaacacgtcaagttccctcgaattcggcctctctccgatatccgtcgctctcggcggcggcaggatcttgggccaatgtatctctgaagcatctaggccccctgtaggatcaaggaggccgactagaggggggtgaataggcggttttaaaacttaatggcacttaaacaaaactaacctaagttgctaggcaaggtgaggtgaaaggttaactaagcaactaagttaagttttgcaaacctaggtgatatgggctcaaatatgtctctatgaatgtaaattgcacaaatataaatgcaataaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggtgggagccggcccacggagaggactacccaagcctcgatcactagggtagttcttccttcactccgaaggtggtgaactccaaaccactcacaaacggcgccgggcctcctccacaatctcctcggagaggtcaccgggcaacacctccacaagccgtctagcaggcggcaacctccaagagtaacaagtctaggatgcttgccaaggatgatcaagtgccacactagctataacaatgaagcaatgcacttggattggcttaactcactctctaacacctcactagataaactaagtgtccaagggtgtgagagctcttgcaagggttcaagataatgcaatggagtgccaaaacctttcccttgttgctggggagtgggtatatataccccaaccaccaaaactagccgttggaaccgaaatccccaactccgtgctctgccggtcagaccgccgttgtgaggccggtcagaccggactactttgtaacagctagttttagccgttacagggcaatcattgagcccactcaacttggtcggtcttaccgtagtgtagtggccggtcagaccgtccacggctcggtcagaccgccgtcggctcggtctgaccggttgcggctctggcggctctgtatcgccaccaaaaaccagaccagtgcaatagactagtggggccggtcagaccggccttaccacgccggtcagaccggctaacaggcccggtcagaccggcctaatgcccatggttagaccgcaggtcacttttcagctcaaccgaccgttagtaaaacggcgatatctcttgactcgggtctcggaatttggcgttcttgtactctatggaaagcttattcaaagggccatccaacccatgaaaaaaccatgcaagaaacacaacttaagccaaggataaagggctcacactccaaaggatatccaccggacatacccacaagatgtcactcactcctattggacatgcccacttctttcttggtttaggacttgataaaaactcatcacacttggctagacaagcccaccaaatgcacctatatgcatatgaactaatatggcacaagatcatccacaagctcccgcttcatagacccctcttgaaagtacgacgactatctagcaaatccggtctacaccaaacaccaagaccgggaaaagactaagaaaatattcttagctacattatactttgccttgcgccatccatcttggggtcaagcttgagtcgagatcaacacttgtgaccatttgattcaaccatgtttata

SEQ ID NO: 32361 - DNA, 1685 bp, Oryza sativa
tttttcttctgtcgccatggtactgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatcagttttaatggcaaatttgcagtttgcgtttttttaatggctatttcgaattagagggtaagagtagtggtatatttgcaattctcccaaatatatgcatacaaataaatatacaagagatgcaagtgtatgaataattagagaatgaccaatgggggtttatcctatacacatagagaaggcatatgtagtaatgatgtagaccaacataaaacacatacattcatgatctccatgttcttaatgtaaatgagactaaataagatacgactcgagtaaaaattaatctcacacttatatatcaataacatggaaatcatatatatgaacctatcaaaaagtaggagataagaagtggtacacatcattttatctccatacatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttaaatcttttctctctttggtgatgggtaataacccgatataaacaatatagagagatgagatgaaagatgatttcaaatcaagatagaaatcttataataaacaaaatatagaataagctccccctcaagatgtgcatacatatggatataaaggaacacatatgcacataatcaatcaagatcaatgagggctctcacattatattttggatccacaagagagaccaagttagaatatgtgaagtttgatacatacctctcatcatttttattttcatatccaaatgagactagtcaaagaaaggctcataaaaacgttagtctcatataattagatttgtcattaatcaccaaaaccaaattaaggcacttgaacttacacccccattgttaattttggtaattaatgacaagtactaattgtggactaaccattgtctttgagctatatattttttgagttaggttcacattatgtgtgtgcgcatgagtgactaccgatggattaaaattgatggcgcgaagcgaagaaaagaagacggtaaaactagtgctttagttttaaattgatcgaggtgtaggggcgatcaaattgcttgttta

SEQ ID NO: 32362 - DNA, 2467 bp, Oryza sativa
accttcggagtgaaggaagaactaccctgagtgatcaaggcttgggtagtcctctccgcaggccggctcccaccttgcccaccccttgacgaagggggcgtgcggtggcttcgtggttgagcggtggagttgggctcgcctcgacgggaagtaggaaaccgacgagtttccgaacctcagtgaaaaatctctcgtctccttgtctcatttacttgttgcatttacatttgtgcaatttacattcctacagacatactagagatcatatcaccttaggattgctaaactagacttagaaagtgtgatttactttcctagtgatagacttgagccactttcaccctaggattgcaaaacttaacttagttgcttagttagacttgttcctcaccaagcctaacaatttaggttagttttgattaggtgtcatttaattttaaatcgtctattcacccccctctaatcgatatctcgatcctacaatctcgcacaatgagaaggggatgactcatgaggggtggcctttgcttgctgacgaccaagaaagatcaagcaacagtgacgctcagatccagaagtccgtggaattcagggtcgatggtgtcctccatcttccttttttttttcgaacacgcaaaaaaattgcacgtcaatatattagcagaaaaagagtttttgttacccaaagcaatcagctagactggcttatgcctaaaaagggaggggggagttgaagctaggaactactacgacggttgtgtcctccatcttcccaatatcgtcttttaccaccccctccccccacccaaatggtaggcgtcactatcgcgtgtaccagacgccagcaactaagaggcaggagacggaagcagggaggcgcagcagggacgggtggtgattggtgaattgctggcgaaaccaaccgaggcaaggtcaatggacgatgccaatgtagtgtttgtactttgcagtgttatttcttttttttctttttattgcgctctacctctaccacattgaataaggtgatagaaagttcaagaacattgtgttttgttgtttttaccaattcgatcgagctatcccctcctacatagatggtacttacttgttttagtggatcaaagcatgtacaatagcatactataagctagctataaacaaatattgagaagataaaggagggaaaagaagagcagtaggctacatatttgtagccagctgcaacacggactccaaagcgcaatgtgtgtatgacacgtgagaccagatattaatagtgtagtatatgtttgtagataactattgtatgaattagctattaaattggtttagatgatttggacttagttgctctcaatcaattgacgtttgggggttttacttttcacatagggtgtgtttagataatagaaaatggggggtgtgatcgtgattaggaaataaataaaaggttaagattaactggacgaggaaaacgaatagttacggtttaaactttaaagatgtgttttggtgggtggaaaatcatttccctatccattagccaaaccctgtcggatcaattttttttaataaagttaagttatatagtgctttcaaggggtggtgctggcctggcccagaaagtccaacacgtggcagggaaagggtgtctctctccaccgccttggggccacgttttagaggaaggaagcccattgaagcacggcatctagtatcttgttgttggaagaaaagccctttctctctctctcattcttgtgtttcttctcgatcgatctctcgatttctctctgtgcaccagcatcagctatggtgtccgacgccagcaagaagaaggcggcgcagaagaaggccgccgccgctgccaagaggggtgacaaggccaaggccgccattactctctccgagcgcacctgcaccgccgtcctcacctcccatcccctctcccgcgacatccacgtaccactatttttctatttcttccatccccaccccccgcccctatctatttatctccccctaagtaactaattaatccatctttgtctcgcagatcgagtccctctccctcacattccacggccatgacctgcttcttgacaccgacctggagctcaactacggcaggtaatctttattatttttttcatcaatcaatcaatccatcatctgtaagtaagtactagtactatagagaccattcatctcgtctcttaggcgatatggtttgcttggcttaaacggctgtggaaagtcctgtctcctcaaagctataggatgccgggagcttcctatccctccacacatggacatctatcatctcacccatgagatcgaggcttccgacatgtctgcgctacaagctgtcatcagctgtgacgaacagagactccagctcgagaaggaggctgaaatcttggccgctcaagtatgtttattttacttcccttccttcttacca

SEQ ID NO: 32363 - DNA, 1962 bp, Oryza sativa
cctctgctgattgaattactaaggatgacggtggcggcgaagccctggaccgcgtttatgaacgcttagaagccatcgacgcatccaccgctgaaaagcgtgctgcagagattttgtttggcttgggttttaacaagcacatgcaggcaaagaaaacctgtgatttctctggcggttggcgcatgaggatcgctttggctagggcgctcttcatgaatccaactatccttttgcttgatgagcccaccaatcatctaggtgagtctcttgagttaccatcttccaaagccagtttaatcgtttgcaatgcatcgacaaccaattcacttagagtgggtgggatcaaattgcacctgtttgaactatacttcttttttccatcagatgatataaatattttttacattatggtcttaggcatcagcgctagttaatgtgcagcgtgatgaaacaacatgcaaatcagcattcatttgtttggcatgtaggctacatatttgatatttctactttatttgtttcatgtactggtgcatatgaaaaaaagtctgaagtgcctcatgtatattattgagtgaatatatgctgtgtgttaacttctagttgcatgtaaacagggaaagcattaccattaccattatggctttgtgttatgctacaagctagaagcaactacatgaaatcttgtgttgtctgctttccattaccatgaacctagattgtgactggtccatactactatatacatccgacaaatttgggtttgaattcctggatttattttgcatcgaacttcccagaaatgtgttaaactcattttaaaaaaaaatattgctggttttcattatgtgaaccatttattcatctgtcctgtctggcttaacaatgttgtttgcttaaccatatatatattcagtataactatggtttctgtgaattgtttgctgccacattgtttctgaataatgtttagcactaggctaccatgtgacttatattatttcagatttatcagagatatggatgctctgttcaggatagatcaaaagatctctgatgcatggttcctatgaagttttctggccctgaaatgtgcttttttcttgattaatattagcaatccattgccactgtttgcagatcttgaggcctgtgtctggctggaggaaaccttgaagaaatttgaccgtatacttgtcgtcatatcacactcccaggacttcctaaatggagtatgtacaaatatcatccacatgcaaaacaggaagctcaagctatacactggcaactatgaccagtatgtccaaacacgagccgagcttgaagaaaatcaaatgaaacaatacagatgggagcaggaccagattgcctcgatgaaggagtacattgcacggtttggtcacggatctgccaagctggcccgacaggctcaaagtaaagagaaaactcttgctaagatggagcgtggtgggctcacggagaaggttgtaagggataaggtattgacgttccgcttcactgatgttggcacgctaccacctccagtgctgcagtttgtggaggtcacatttgggtacacaccagacaacctgatctacaagaacctagattttggtgttgaccttgactcaagggtggcgctggttggtcctaatggggctgggaagagtacgctccttaaactcatgacaggtgatctcataccgctggacggcatggtgaggcgacacaaccatctcaggatcgcacaattccaccagcaccttgcagagaagctggacctggacatgtcagctctgcagtacatgatgaaggaatacccagggaacgaggaggagaggatgagggcagccatcggcaagtttgggttgtcagggaaggcacaggtaatgccaatgaggaacctgtcggacgggcagaggagcagagtgatatttgcatggttggcgtggagggagccac

SEQ ID NO: 32364 - DNA, 2848 bp, Oryza sativa
  unsure (1)..(2848): unsure at all n locations
acggatgtttgtacctgatctccatcaactacatctgatgctatagcccatatggtaccactactgtgtttattatctatattcgtcttgttgcaagcttggtagtaactatatatacttgacgctcttgctgctcttccatttgcagcagatgtaccgtcctcttcttggggtctctggagaatgaggaaacagcaagatccagccagcatagcatgtatgtatagtgtaattagctggtttgttggcggtgcacatgcataagatatacttcctccgtttcatattataatactatctattattgcccacattcatatatatgtctagattcattagcatctatatgaatgtgggcaatgatagaaagtcttataatatgaaacggagggagtattatcttggtttgcacttgcatgatcacctgctgtagttattattatcagtgaccaagttcccctagctagcagtagcactccatgaaaagatatctacatgaaactgtaccacccccacgatattatatatgagattggattttaaactcttgaggggatgtctcatcgttgcttgtatgttaaattgagaagatgtattaacatgtgatatatcttattataagcattcaacttaaaatttaacttctacatgtcgcaacgaaaaaacaaatttgactgtgaatatatgttaactagttgtagacatgtagtagtttaatttgtttttttcgatatgtaggagttggattttaaattgcatgttaatttgtttttttcgatatgtaggagttggattttaagttgcatgtttgtgaagtaatacatcacacattaatacatattgtcattttttttaattttttccataactatttgggtgacacgcaaacaatgagggacattccctcgagagtttagaatagttccctattatatatacttggatcgatacctatatatgatttgttcttagtaatgatggtccattattaattgaaagcttggatgacaaggtttagcccaaatgaggaaaattaaatcggtgaattaaacagaatatctagatcgaacctctattctatatagcctatttttattataacaaagaaagtgaaagggcggtattttaaggtctcatttagatgcgagattcctaaattttgtggggattggaccgattccttcaaatgtgctgtagatatcccacgagaaaagaaccaaattaacctactaaatagcctggatttttactactactggagaaaaacaaatcactagattgaatccataataaacaagaaattgcagtggtggatattaacatgcaaaagtaggagcatacacttgtttctttcatgaaaagtgtagatttttcatgatgggatgttgagaaccataataagattacgccagcatggaatttgaagctaaaacaaagggaaagggaaaaaaagtatcagacagacagacagaactgatataaatttaaccagatggaaacgaaatgcatctctgacctcacagaaattatgtatttggggacggccatatataatactctctccgtttcaccgtttcacaatgtaagatgtctagattcattagtatcaatatgaatgtgaaaaatgctaggatgttttacattgtgaaacggagggagtaacaaggatgaagatgatgaacaactaatgtatggtctttgaatagcagaggagcttacctttgaaaagaaaaaaaggcgcttgtctgcggatgcagcatcatcaagattctcagccaaatcggatgtatatgtgcgtcttgtgatatatgcatggatgtgaatcttgatgatgccacgcccgcaaacaccgactctaccgttccatccatggatttactgtactactgagcattgttcgtatcttctactccagagtacagtaaattcaagagatgcattggacacaagggagaagggagagatttgctcttctctagcctcttctagctaggggtttactccaatttgcattgcaggtagacgagagagcactgtcatactatataggagtacatctgtcagaagtagatcgagttaattaaaggagcttaatggtagtctacgtggcacagttggcagcgccagcaagtgcacgaagatgaaagtgatataatatatagtaatatacaccctctgtcaaaaaaagaatttaaattctgggtttgaatttggatatacactatgtccagatttaaatctagagttaggttttttttggaacggagggagtactacttatattattaactactacgactagtataactagccaattaaccactaaagtagagtactttgtgttaattgcccggagttacaaatatgggcaagttggtaaaaccgtaaaaggaaaagctgctgcttggccacctgatgacgtccccgcacaacctagccaaaatgcaacagccttttcctgcagatcaatggctttacttttccattgtccgttttgcagatcgatgacttggctgtgttcgggaggcacccgacacggaaaaccaagcacggattatagtgaaattaattagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32365 - DNA, 613 bp, Oryza sativa
ccacgggcgaaagcgacttagccgcttgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaatggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagaccccgccattcttcagttttttc

SEQ ID NO: 32366 - DNA, 1098 bp, Oryza sativa
ggcgcgggcgaagaagctggacgcgagggcgcgcagcggcggggcggccacgggcgaaagcgacttagccgcctgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgtcgacagcttcgagggctcggcccctcggcttgcgttcgcctgaccgcgccgttaaggtaggctggcgggcgcgacaccatggactgccgatggtgatttctgggcgaatttaagactttgataactttgccttccgggcatggaatcgagcttggtttattttgacggctacagaatcacaggcctcaccctagagaagatggattgggagaggtggaccccagagatttttctagaaaccacttacaataggtcacaaagcagcggttgtttcggtgaaatgtcgaagatctgaaggtccacaactggttttcaacggcgcggtaagtcgacgtgcttgacaccaacatcgtctaagctatccaccctaacgtcctatgtgccgttcctatcctaacaacctcgttgaaaaccagttgtggaccctcagatttttgactttttgcggaaacaaccactgctttgtggcctatggtaagtggatcctagaaaagtctccaggggtccacctctcccaatccagtctctcaagggtgaggccggtgattctgcagccgtcaaaacaaaccaagctcgattccatgcacggaa

SEQ ID NO: 32367 - DNA, 685 bp, Oryza sativa
cttgttattttggattaaaatatgccgaattatgaccaaattttcaacatcaactgagctcacatatctatgatccccacgattgttgcagtctcaaaacacaaagattacatgtgcccatgaaacaccaaccgaggtctacctctattttagcaaactgattgatcacatgtacaagaagttggcaaaagggaatccaaagcatttcacagctgctggacgcttggcactcatttcttcaatttaataatttccatgcagaacctggggggcaaagcaaaaggtaaaaaacctgaacatttctccatgattatacgtgggattcttctcagcatcccaaaatcgaaaccaattttgtggtgcttggtacacacggtttgggacttctttgagccacaaggttgaggcttaattcagagctgcccacagtttctccgtttcggtttattcagcggccatcccaaaaaggaacggtttcagttcatcacacactactcgacagccgacagtcactctcggagaagaaaggccgtgaacatgttggatagtactacttcgactaattgaccatttgctgctgccatgagaggaggacaaatcaaacggacagagtgtgacaagtcactctaaagataacagaattctaagtactagctttgctactgtatttgggcaacatggaaag

SEQ ID NO: 32368 - DNA, 1427 bp, Oryza sativa
ttcacaaattactatttgtttacaaatatgccacgaataagcgaaacgatgagccgtttgcaagtatgcggtgcgtgtgcatcaggagcttaaaaatacgttaatgggctggcccaccagcagtaaaccttattatccagagcatttggtaagagcatccccagcagatactccattcaggcctctatccacaaaatagaggttgggagaagaaaagtgagctccaacagatactccatcccagcatccaaatttagctatcctccatccggggagagagaaacatcaaatttggcgtttctctctcctcacgccatcctccacatcctgtaaccgccagcgtcccccgcccccatccaaagtccagatcgacctcccctccgtcgcgacccccccaatgtcgtcgtcatcgccggccagatgtgcattttttcccaaggagtgagggtggagagggagagacataccagatctggaacccgcagcccacgccggccgtcgcgccgccacgcctccgcgcccgtcgcaccgccgcgccgcagcccccgtcggccatcgcgcccgtcgtgccgccacgccgcagcccccgtcggccgccgtgcccatcacgccgccgcgcccctgtgcccgtcgtgccgccgtgccccgcgcccgttgcgccgccgcggccaccagccgctagcctccgcctccacgctgagcggagagaagaagaagaggaatagaagaggagagaagaagaggaatagggaagatgagagaaaaggagtaaagagaagaggagaaaaaatagttgggaatattaaaaatacatccattaaaataaactcatttagattatcgggataaataacactgttaaaatttagttgtttaaaatatagtccataaaaaataatacaaatgtatggttagttgaaaaatattagtaaaatataggagggagtgatattggaagatgcaatatagatgatctatgggagtgagaaggaatatggatgaggaatctttttagatggccatccatatgagcatatggaaaatcaaatatggatgaactgctggggatgctctaaaggataatatagtgtccatttccctgattccctccctccaccaatggcagaggctgattttttttcccctgaaacattctccttttcgtaaatgaatacatataattataatttggttgtctaaattcaagcttttcaccaacaatagtaataacctgatagtgtacgagttactgagaacagatttgatattgcatcaattgggttcttgttcaaaagtactttctttcgattgtgatctttgattaacaaaacattgtagaataaaaatttactgtcaaggcccagttttagaccatcaaaatgcgcatactggaaaaaaggaggttatgcaatatatagaaggagatg

SEQ ID NO: 32369 - DNA, 4404 bp, Oryza sativa
  unsure (1)..(4404): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctataataaaattgaaccacagaccatcaattgcaaaatagtaaaaggaactcatcgcgtaccatgatcgcaagcaagctagatgaaatagatggttgcaggataactttttagctcgagccattggtccctaggagttgcagatttcaaaagaaaatcagatacacaagcactcaaaacactacagatcctgtgaaaatctagaaattgtttaccctacagatggcacactcatcgtcgtatgcacagatttcatcatatgtagcatctggaagtgctccgtcgagtgaactaagtgcctttcgtaacttggcataagtttttatccgcttccaaaatgaagctataagagcctgcaaacattttcaaagaattccagtcagtacatcatacatatttatttaaagtttatcgaagttaacaagtgaatgtcacactcacgcgcaagttcaataggagaacagcgtcaaccagatgaaacgccataccacggagccagaagatcattgagtaatgaccaagtgacatcaataagcttatcaagtcaatgacaaaaccaaaatttctgactagtctgcctctccactcagaaaaagatcctgcagttacaaagcatgattggaccctggtggtaaagttgagataattcaagagacgcatgtacaagaaatgagacatggactgctcaacctgaactaaattaatgttccaacagatcatagagcaaaatttacagtattacaaacagaccagaccaacataacaaatgtcagatgagtgaatgaaacctctgttatatactccggcctgtcaggaaaaaaaaaaggttctgttttttaccattggcatggccttggaaaaaaaagatcagcaatttatataaaaccgattattgagatcaatatacatgttttttctttgtgaccaatctaaatattcatagatatgttaccagtgaaagataaaatagtttactgtatgcgttctaggattttttttttcattcactgaatctggtgtttgcattcttgtctaggttagtaataaccggttaaccacgaaactcatacagcattatcctgcatgctcagccctagagggtttactaaactgaattaaatgagtctctgagcagcgaagacacgcttatcacctgctgcttgcttataagttttttggaaatcaagatagtccacaccactgtccatttgatgtcgttgccatatgtcaaacaactgaaatccatgcaccatgattgactgctaggaaaatactatgtgagaaaaggttgaagatattcagaagtaataactgcatgcaggtaaatgctcataatatttttaacatctctagttggcatttataagcaccacctcctttgaacattaaatgcaatgcagatttctttgataatgcaagatcgttataaattaagaaaagataaggaggagaaacttcccacaatctgggttgaagtacctgcagtgtctcaaagccaatactaagtggctcaaaaaacataagccaaaatagttgagaattacacgacttgcagaacccaacacaaagctttatcctggagaagatagacaatcaattaagtgtgagcttttaaaagtattacatgctacagttgtgtcaaggacaccataacaaaaggaaatgtggtaaactcaagcatcaatacaactcattccattatactccctctggtcaaaaatatttgtcgttttaggaccagatttggacaaacttttaaaattccgaatacaattttatgtgaataaatttataaagtctaataagttcatgatattatgaaagtactttttgaggcaaatctatgtatatcatttgttttcttttttaaactaagcatttaagaaattattgatggtcagaattttaaaagtttgaccaaatcttgtcctaaatgacaaatattttttttagaacacgcaggagatctgcatatcatttcattaagaaaaaggagaaaaggtggacggtgttagagaaagactccgacacccgccaccaagggtacaatagaacaccacacacccaaaggaagtaaaacaaactagtgcattagcagcacagccctagtaaagagatcacgaagcctagcagctcctgctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgaccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtttagcccttccttctcattatcaggtaaaccccttactgttcttgaccaccaattggcaaacctagcagtatcttgggttggaaagctagagtagccaagccgttgcaggaccaaataaacgagatttggagtgagagatgtccctccaaactttttttaagaagaaattgtgagagtgttggggattgaacaagggatcttagggttgaaaccacacaccccttgccactgcactatcaagtgcatctctaaatgacaaataatttgaccggacagagtaagtttataacagaagttgcaagttgcaagaaattgtaagggacaataatttcatgttggaagtgagtaagtgacatcatgcatctctgacatctacaaaatcaaaataaatttaagtgtacccaacacctaagcaaagaaaaaattatgtgtaaataatatttctaaacaaaaaacagtaaaatgcagactaaccagggaatattaccatagtacatcagccgatagaaccagcaatagtgcagaatatacacgaaagtattttgatggagtcgctgatggtgaagcattgagctgttcaaggcgttctctagccaatgattgaaacatctggatgtacgagaaattttagttaatgtaagggtataatcttaactagttgaagacttgaagttctaaaacattaccttcagggaacaaagaaggcccaaccaacttgaccaaaggattatttgttgagaattaggaggcacaaccagtgggagaaaagttccctggaatacgagagagatcattggcatttcttcacatggcaggcaacaacaagaacataaataaataactgtaaattgatcatacatcctcccttagggcttgttcggtttggaaggggttgaaggggattggaggggtttgaggtgtaataattccacaccacaataggtgtggaataaatcccctccaatccctccctcctggggattaaccgaacatggccttaagattgaaattgaggatgtaccctcctggcccacaagttaggttgatgaccccacatgtcaatggcataggaggctaaatcctcaacttttgatttaaaggagggtatacgatcaaatctcccggtttacttttccaacttgtaaatcgtagtcttcacttctacaaaagggcatggaaacttctactccctccatcccaa

SEQ ID NO: 32370 - DNA, 13837 bp, Oryza sativa
catccctccaaaaacccttatatctatgaaagatcagagtatccacgtattggacttgtgctaagattctcaaggagataggattagatctaaattagattgtacatgtattatggctgatagttattgaacaaagtgtaagactgcatattatctaatttaaaagaactcactatcaagctgctttaaattcactaaagcatatattgcaaacatcattttagagcaagtctcttgtgttgaagactacgagcttatcagcagaaagtcaggagaaaaggggagcgcatgcgcacacagagagagagatggatagagcgcttaccttgtaaagcacatagttaatgatgtgttccaacacctttctagtctcagaagaggttaattgaacaaaaaatagtgtctgcataaaagaaaaaacaacattaacgccactattgctaatatgatatgcatacgttaaatataagctaagctgcaacatcctctttactaaaaatcattaaaagaaatctggatgctcaggtaaaatggtttccgctaaatcatggattggaacaatggaggaagaacaatgccctgccttgtgccttcaaaaaggtcacctggacacctggctttgtaatagtatgaaccatcctttctctcatatataagtcactaagaatctaaactaggatagcagactagaagtttagcttcctctatgaaatagtgtttttatataacatagttatcatgtttgcaatgcaaactgtatgcatacatggaggacgagcttttccaacagacaaaatgctttgattgaactacaaaattgggtcaaactctaatgctccttttaaagattcctatggaagtaaaaataattaagtacagccagtttacgacatgaatcaagaagtggatgtatcaatacaagttcttacatgaatattaaaccacatgcacaaaaatgagtctagaaggaaatcgcaacgaaccaagtcacacactgtcagcttagctcttgctctatcaaagccatataacagccattcagagacgtaacagaaatcctctagcatcgaacaacaaaagtaccacatacaaatatccagttcagatttcagaaccgcttaacgtaacaaaaatcctctagcatcgagcaacaaaaataccacataacagaaatcctctagcatcgagcaacaaaaatactacgtacaaatatccagttcagacttcagaatcgcggtgttcaagcctgtattcaagcatgttgttgtatagttgctattggcattgctacttccccatatgttccaactaccatagtttagataagcatctactcaactgaaatgcaactcctgagaacatgtggttcttcgcaatcagctaaagcacaatattcctactaaatcactccattatctcacacacttgatgattccaaaaacaacatggaaacaaaatgtcattagctgatttaatgaaggaaaacacgtccattctaactaaacaaattaagtttatttctacctaaacatcaaacatatcttcagcacgcaaattaaaccaacaaattgggcagcaaatttgaatcaacaaatttgggcagaaaaaacacctccatcttcccaactatcagcttgcatatattattattgcttatattattattactgacaagtggtcaaccgacaaaagtttttttttccccaaacagcacaatctaagcgaatgaccgcgtggccctgagcagcaacaatcccaacccccatcccattcccgatcgaccgattgctcaccttgagggagaggatgaggacgaggaacacgtgcgccgccagattcgccaggagcgcgacggtcacgtgcgagcccagcaccgtgccgagccagtcccctcctcctcctcctcctcccccgcccgccgcgtcggcatccccgtcgaggagggaccccgcccaccactgcagcgccgcggcgctggccgcggtggatgccgcggcgacgtagaggctgttcaccgccgccatgcgccgcgcatcgaagacaggtcccccacccctcctccacaaccctatggcctcctcgtcgtcctcgtcgtcgccgccgccgattcgccggcgatgcgggggaatcgcggggttgcttgcggctcgggggaggtgtcgacgacggctttatttcgggggggccgcgacgccgtgagaaaaggggggattgaggggaggaagaggaaggtgggggggggagccagggggacaaaattattgacgacgggatggatagattggaattaattatgttaattaaagtctagatatttgacgggtttaatacgggagaattgtgcgtttcagtcctaagggttatctgtaatattgtttctttcctaaaatagattagtactctctctttgtcctaaatgtgaaagccatataccagattagatattttatagtaatatgaatatgaacaggaaacctctgatcatattcgtctgatgctagtttctatatattggaatgaatggagtaataaattttagctatcaatttagacaaagtgcatgtatagattcgtagctaaaagttactaaaagtgcattatacattttatagtactacgaatataaatatgaaacatgattagattcgtagtattttaaaatatcaaatctgatactatatttctatatattgggatgaagggagtaataacttttagctatgaatttggacaagtgcatgtctagattcgtactaaaagttattatattttgggatggagttagtatgatgttagtattatttcttttcggagggagaactatgttatggttggatgatgccttcaacttgccaaatcccaactttaggtggttgttttgcagttgtttagttgatgccattgttatgggtagctatatttttcatcggcctatttcaaagacacaattttttgcaacactttgcctaaagcttcaccttatgtaatatgaggtttggcaatgttaatcatcaatcgaacatatctttatctatctattgacatgtttggtattgctccagcctagagaaaactcaaagctgtagagtttggacttgagctatgtttgatttggattattaggcagattactgctactgattatatacttaattatatgaataaattgaatactttaagaaacaaacttaacaaatatgcgtcctttgagtgtattttccaaagcttagagtaaataatccatttcaataatctgaaacgaaccataaaattgtttaaatatgacaatacacgcatacttaaatgtatatatttcctatgaatatagaagttggatttctagcaactattgtatttctctaaatttccctgtcaaacttacaaaccttctccatttaactgttattaccatttactgtgcacatgtctcctccctacgattgttgggggctaaaatattttttttatctctctacattaatattgtaataatccttttccagttataatagcgaagaaatttattgcaaaaagatagcggtggtgacagtgaacccgccaacccatttatcctatcgtaaattttgcaaattactcattcaaagatttaatgttaaaaatagagaaatatcgtggacaatcacatatgaaatcaagtgaatgtttccctataaaagataaggtagtaacatatttcatgaattatatagttttacttgtatttgataatagtatgatatagttcttttatcatagtaaagcataaacatttagctagtatttcgaaaaaggatgtggtgcacacacaaaagaaaaagaaaagaaaaaatggttcatccacggaatattgcaatatgctgcgaaggtaggtgcgtttgtgcaaaacggggtacgggccgcgtgcgacgcctgcctgcgcacaccaccagcagcgagagcgagagagggggcgtggggcggttggcgcgccaaggcaggtgggtcccgtgcgtcggtgagtaccggaaaagcgagagctcggtaggtgacgcgtagagcagcaagccgcgccacgagcgagtgaccgcgcgacacgaccccgacccggcccggtcggtgcggcgcggcggaggtcgcccgggtcagccgctcgccgccacgcgagacgagacgatcagacgagggctaaaataaaaaaaaatcttctttttttttccctgggcttgctaattccacgctgcccctctttaggggtggaaacgagccgagctgagctcgcaacaaactaatttggtttggcttggcttggttagggaaacaagttaaaactttagctcggctcggctcatttcttggctcgagccagttcgagctggcttgcaagcctttctattgaaacgactcttcatatatattttataaatattaaaaaaagtaaaaacaaatcattaacatgtaaaatttaaataagtttatatattcaattcttcaaaatcttaatgataaattttaagttgacaaataataacgccatataaagtaaaataatcgatataaacacacgatgcctaaggctcgcgagccaaaacaagcggctcgcaagctagctcggctcggctcatttcagcaacgagctaaaaagatggcttgggcttggctcgtttgacttacgagccgagcctagccaaccaaactcaagccaagcccgagccaagctcacgagcacgagttttttttccacccctacccctcttatccgtttgtggacacagcgaggggcattattgactttgcagaaatggagggagaaaaaaaaaagatgcactgctaaaaaattaaaattatactactcgcttcgttttcaaatactccagtagtactgccactagactgccaacattgactaggagacattcgtttttttcttgaccactaattattcctcaatagtttgattagactatgaggatggaagtgtgcttattccttaaccctaacactatgtaaagagaggattaaattttggacgtggcacgcttttcaaactgctaaacggtgtgttttgtgtgaaaattttctatatgaaagttgctctaaaatatcagattaatctattttttaagtttgtaataattaaaactcaattaatcacatattattacaacattgttttgcgtgaaacacttaatcttcatcttcatcttcatcttcaggagatttaaacaccacataagagaatggaagttttattctttgttgaacatggtcttttagttcaaaaaattccaacttattttttcaaactatttcaatattcgatcactttattcccttaagtattttttaagcttagtttatcctgaatttaattaaaatggttcactttattggttaattgcatttctcttctttgtttatctttatatgagtcatactttaagcttaaattttatagagccatagatggcatcattatcaaatttataaaaatttaataactacttgcttgaaagttaaaaccttcatgttaaaattagtttcggtgtttccaacctatgtaaacagcgataacaaaaaaaatgttgagaggtaagttataatacatatattaatgctatcaaattttatttcaaaatatgatttatacaggcataaacgaaaagcccaaatattatcatggagtaaggtgaactattgttaagagttgggtataaaatgagacgaaaagttgtctaagggttaagtgctctggtgaaaaagtttggggagtaaaattgacattttgcttttaagttactcaaaaaatggcctttttttgctttttttataaaatataaaagtttgaggatgaatgatttctattgccagctatttaaaaatgggggagtaactattttgctatgacgcagtatactaaagtgttgattgtttgcgctactttgcagctgcaggctgcatcaacagtagcagctactcaaaaattaaccgcggcagcagcagcagcagcaaggctgtgctgccacagctagcataaatgaacaacccttaattattctattcggtaattacatatttaacactgaaataagatattgtcaaacatttgaaactttgacaatcaataactctaaaattagttaatttcaaaatgcaaaagtggtatgggcaatctgcttagaaatgtactaatgtacttcataatatcttaaacttattaggttaataaacttgttctaatataaacttatgaccaaagttacacaccaaagaccttaaataacaaatatcgtattttttttactatagaaagcactgtcagacctctagcagcaggtattatacaataaaacaattaccagactgcaataaaaattaatggtttgcctcacaaagtaaatgggcacccaattaatgcacaatacaacaagaatagtacactacaattaatcttgtatattataacaattgaccccatgtagtataattattgcttgatccaactatcacaacaacaaagcaaagtgttagtctgtctactagcagagaaaacacacccttaacttgcatctattttgtagcatttttgtcatgttcctgcagcagcaagtgggttttccatatatatttcatacattgagctaaacacaaaccaggtttatcggttccgttccaatatgtgccattatattccaccacctaaagctatgaagcgagcgagcggcatattgttccaatcaaaatatcgttaatttcagttattctgattaaattctggtcggtattgatcagaattaacataccacttgtttcagtatattttaaacatgagtgatctttccgttgaatttggcttggtcgattcataaggatacatgataaattttgtaaaatatgatagtaacatgatgaataactttgaatcactctatttatattttgtaaattgcaagttctattctggagtgatctttatttcagtccaaagtggctcttgccatgcactggactttgctcgtgcaatgttcatgtattcttaataacgcggattcacctaaaggcttttttatagcattaactgcactaaaagtcagtgggtcacaattacattcaaagaaaggattatgtctagctataaactcaatcatccatgttatattgctctcattgctatcatttttagtataattatgggcacaaatttgataaaatattgcataatattccctccatcccatcataatatgagggattaaattatttaaatttgtcccaaaatataagggagtctagagcactacctgtgcaccaattgaccctcattcaattttcttcccactaaacaaccttccaaccctaatattgcctaatctagtagggaaaacatatattacaaacttcatatgtagtgtaaatctggaaactgtcgtacgatgtacaagtgaacgtttgagatttgtctatatcatcataagcaattttttttactaccagaacaaaaaattacttatgattaaatctaggagaaaaatactcaaggtgatatggatgaatctcggatgtccattcgtgtatcctacagtagtttctaggtatgcattacacacttcctcaatctattgaggggtatttgatctttttttcattttccttaatctctcaaatgcatactaaaatcacttctagtatatgatggagttagtaacatatttatactctctccatttcaaaatgtttgacaccgttgactttttagcacgtgtttgaccattcgtcttattcaaaaaatttaagtaattatttattcttttcatatcatttgattcattgttaaatatactttcatatacacatatagttttacatatttcacaaatttttttgaataagacgaacggtcaaacacgtgctaaaaagtcaacggtgtcaaacattttgaaacggagggagtattatcttattaaaccctgaaacggtacatctgtatcggttggtatgagaacttcctttctaagagccaaattggaatggcctctcgaatgaaattgacaatcttgatgcatatagggtagaaaaaaagctcgcttgcccggcttgatggctcagtccaaaattgttgcgattcatctagtttttcttttgagatacaaatttcaatctgaaaccagaagacgaagcatactaaaaaccgattggtatcttcgaaaaatagataagaaaaccaaatttgttttcgtcgaaaaatatagaaaaaaaatgttagataattggaaaaaaattgtgaaaatgccatttcctataaatttagtaatctcccattgacatacacacaatatgtaatacatattcataaaagacaatacatatcactcaccagtcaccaaccattggccaaatagaatgcctgtcacctaaatattaaagtccattacgtacatagtttagagtccaatacatatattgaagtccatttcattactacatggaatttggcccatgaaagggcttccctttttctaaataattattcttttctttcctactggacaattcaagaaatgcatggaatgcaacatttttttgaaaaaaaaaatatcctagtaggctctatgaacatcaaactatttataggatttgatttgatttttttcgttttttatcattttaaatttaaatttgaatgaaacccattgaaattctagacgactactacttttgagtcacgccaaaacttcagtgttcatcgaaattgtgaaccctctgttcactccctttagctttgtagacatacatagatcaatccaaagggcatgcttggtcactttcacacattatcacatgtgcgtttaaagcatctaggcccccgtcgttgattttggtaattaatgacaagcgctatttgtgaactaactattatcttgagttatacattttgagataggttcatatgatgtgtatgccatggatgactatcgaggattaaaatcgatggcgcaaagtaaaaggaatgaagacagtaaactagtggttttattttaattgatcgaggagtttgggcgatcaaaatttgctatatttatttatagctttgtcatactatcaaaaggggtaatgacctaaacaaaaagatgatcaaaatgctacattaggtcatttgtatttagacttggttctctgttagaattgaattgcatcttcggtccagggccggtctgaccgaggacattatgccggtctgaccgatgatcccaagtcggcctgaccagcgggttgaatgcctatggttggcctcgcgattggcgacccagagccgccagagccgcagccatggccggtctgtccggccaccctatggcggtctgaccgacccccgtgtgttaatacattaaatgcactgtaacggctagttttccaaccgttacaatgtagtccggtctgatcggccaccccatggcagtctgaccagtagagcacggagttggggatttcgaccctcaatggctagtctttgtgtgtgtgtgggggggtataaatactcccccaccaacaacagggggactctcttggcacttgcttcacttgcatataccccttgcaactactctcacactctctagtgtttgtgttcatccattttgtgtgattgagggttgattagtcaagagtcaagtgtattgcttcattgtagagctagtgcggcacttgatcatcttcgagccgggtcatcgcttgttactcttagaggttgccatctcctagatggcttgtggaggtgtttccctgtgacctctccaaggagattatgaagaaggcccgacgccagttgtgagtggtttggagtttaccacctttggagttaaggaagaactacctttagtgatcgaggctttgacatcctggccgagggcttaataggattaatactcatatcaacaagttgcaacttcttttccggaagccgatctctaaagaactctgaggttaagcgtacttggcatgcagtaatttagggatgggtgaccgatcgggaaactcttcccgagtgcgcacgggtgaggacaaagtgttcagaaaagactctatgagggcagtctataacctatgaaagctgcaagatgtaagtgggctcggcctgggaaaggcgggacgttacaaaatggtattagagccgactctcgcggtttcacgggcgcgcgtcgcagttgcataggcatgtgcgcatggctggtgtggactcttgcggtttcacgggcgcgtgtgtcgcagttgcgtaggcatggtgcgcatggctggtgtgtacttggagtggtcacacagcatggcacatgcgctggcattggacacacggacgtggccaagagggaacgttcctagcttgacaagttgcaacttcttttccagaagccgagctctaaagaactccgaggtctcgcggttttacgggcgcgtgtgtcgcagttgcgcagacatggtgtgcatggcttgtgtggatatggagtggtcaaacagcatggcacatgcgctggcattggacacatggacgtggccaagagggaacgttcatggcttgacaagttgcaacttcttttccagaagccaatctctaaagaactctgaggttaagcatgcttagcctggagcaatttagggatggatgactgatcgagaaattcttcccgagtgcgcacgagtaaggacaaagtgtgcagaaaagactaattttggtctatgagggcagtatatgacctatgaaagctgccagatgtaagtgggcctggcctgggagaggcgggacgcttgacgaagggggcatgcggtggatagaaagctgccagatgtaagtgggcctggcctgggagaggcgggacgcttgacgaagggggcttgcggtggatagaaagctgccagatgtaagtgggcctggcctgggagaggcgggatagtccacttcgtgggccggctcccacctcgcccaccccttgacgaagggggcttgcggtggatagaaagctgccagatgtaagtgggcctggcctgggagaggcgggatagtccacttcatgggccggctcccaccttgcccaccctatgacgaagggggtttgcggtggatagaaagctgccagatgtaagtgggcctggcctgggagaggcgggatgttacagaggcttgggtagtccacttcgtgggccggctcccaccttgccaccccttgatgaagggggcttgcggtggcttcgtggttttgagcggtgaagttgggttcgcctcaacggggattaggaaccggcgagtttccgaacctcgggtgaaaaattccttgtctcttgcctcatttacttattgcattttcatctgtgcaatttactttcatagagacatatctgagcccatatcaccctaggatttcaaaacataacttagttgcaatttactttcatagagacatattttaagcccacatcactctaggattgtaaaatataacttagttgcttagttaagtttatccctcaccaagcctagcaacttaggttagttttgattaggtgtgatttaattttaatcgcctatatattcaccccttgtaatcgacatctcgatcctacaacgtctaataatttgctagtcactggtgcatgggaagcgtgggaagaggggaagggcaatttcccttttactgtagtaaagatatgcttcctccgttttcaaaataaataaacctagtatgtgatgtgacatgttttactgctatgagattattaatactaactcatagtactaggatgtgtcacattccgtattagatttgtttattttgagacatgaataatatgggattgtggtgggaagagaacgtcgtggttttttataaataggattggggcgagaagaaaagggaagaaagacgattgtgctacatagtactagcaaattagccatgctatgccatgggatacaaaatgaaaccatttttccgtgtttgtagtaggaaattttagttttgtttctattcattttctaattggctggttttatggaaaaccattctttcttctttttttttggtggggatggggtgcaacatcgattttctccagtggtttttttagatttgttgaaagcgtgggtagagaggaggacgacttcctttttaatgtagtagagatagttgcctattttttaggagaaaccgttgtttttatagagcattagatcacatcattggttttctccgctaatttttgtagatacatgggaagcatggggtagagaagaggtgggcgacttgggctgcactcatttatgatggttaggaacttctcacatgggcttaaaaaacaagataactcatttgcacatgattaatttagtactccctatacagtatgcaacatatcttaaagactacaaatctggatatacagctatccaaatttataatcctaggtcatatcctatcctagatacatttatattgggactgtggagattatgggtaccccatacacacacggcatggttatccgactagttataggggataacttatatctatgaaatatgtaacagatcatgacttgggtattacgtttccttgtatattatggaacggcctaaggtcctggtttaatgatattgtaaagtagatttaggaaactgataccgtattggttaaggtttctattttgtaatcctgccctccatcctatataaggtgggcagtaggccctctagggggcagatgagacaactagatcgtcagatctataatacactcggcggattcaaatccccaaacagaagtagggtattacctctcattgagagggcttgaacctgtctaaatcattgtctccgcatccatccacttttaggtctcgtgcgctaccccttttattattgccgaattcttgtttcgacaaggacatagggaatattaacggatttcggtgattttttttgagagagagcattagagcaagtttaatagaagtatagccaactgttaggtataaaagctattccgttcatctaatttaatagcctaccatacaatagtttcatataaatatataatacactattaatacttagcccatctatcacgaaacctctaatgggcgatcgatcgcccagccgatggggtagcgatcgggtagcctcccccctccctccacctagtttccttttttgacaccgtattactttcctattttagtaagtttatacacagtttacacatctaaagtttagagaccaaaagtttataagtcaaaagtttatatatccgattcaaatttgaatttgaattcaaatattttttatatatagtatttctatacatctaaagtttatacacctaaagtttatagacccaaagtttataagtcaaaagtttatatacccgtttcaaatttgaattttaattatatccgatttgaatttgaattcaaatattttttatatatagtatttctatacatctaaagtttatacacctaaagttcatacacccaaagtttataagtcaaaagtttatatacccatttcaaatttgaatttgaattatatccgatttaaatttgaatttgaattcaaatatcttctatatatagtatttctatacctctaaagtttacacacctaaagtttagatccaaagtttataagttaaaagtttacatagccgattcaaatttgaatttgaattcaaattttttatatatagtatttctatacataaatttttttaacttttgttttttttttaaaaaaaaatttgtggtgtagaaggaggggaggaggaagggggagaggagggaggagtgtattgagtataggggagggggaggacgg

SEQ ID NO: 32371 - DNA, 4827 bp, Oryza sativa
cacacacacgtactcctccgttaaaaaaaaactcaccatcgaagacaataaatctgaacaatctcatgtctagattcgttgtcaagttattctttgttttagtggagggattaatatcttaaaactcgtgctgcagttcaacataaatctgtactccgtttttcttttatctccttttctctttcttcgcatatgttttttatgggtgaggattctctaccataatgtcactattacgtgaatcccacccttctattatttcacatgtcagtgtctgtaatggtagtgtaattatggtagaagatgtgaacccgttttttactaccttgtcttatagtattagatgtgaacctgttttttactacctatcttatagtaatggtctactgtatccgtcctataatatagcaatctaggatatgatgggatgtttcatagtgcaactaatctggatagaccttctgtctagatctattaaactataaaatgtctcggctgattctaagttgttatattatgggatggagggagtacttgctattacaacaactgatcaagcaagcaaatcaccgaaaccgctcccgaaaattcaaatatccaacgctccatttcgcttccccacccaaattcccaatcccaccccgccgccgccgccgccgagcgataccggggccgccgctccccatggacgccggcgacgcgagccgcttgggggagtcgctggacgccgtctccgccgccttccagtcccgcgtcatggagctccaggagctcgtcctcgcccgcaacagtaagctccctctctccacaacctcacccctcctcattcccatctctctctctctctcctcccatcaccgaaaccctccgatcccctgaccccgcctgcctcccccacacgttcgcagtgtacccggctacggcgataccggacctcgccgccgtcgacgtgtcgctcacggccatggaagcgcagttgcaggcggtccgccgccgcctccaggaggagcgcgaagccttccccaaggccaaggtatcgtcctctttctaagatttaatcaatgcactgttaaattggcagtacaggttgttccttggttgctgatttgacgaacatggggaggggatcgacacaacatattttgattaggacctaaacaatcaaagggatttgatacccactaatcccttgttaatccaatcctcctgtggcgtgatgggttgtgtagaaatggttggattaatcttgcctgttcctgcggcgtgatggggttgcagtgagtgtctgggtatgggggtaaatggatatatcagttaccgtagtttgagtatttggagaattgaacaaaaacaaggtctttgtctttctgggaaaaaaaagtattatatctttcgataattttgctattgctcctaaatccaatcttaattttgttcaatctacccgtgaaatgaaatatttctaactagtgatttcctcaaatactgatgtagaaactagtacaacagtccttgaagcaacagcggaggctgcagcttatgcttgcaaacatgccaactgggatgcgcgaggatgtctttgctacacctctggaacataattcatcaatgtatttgtgaatattaggaaaatacattggctgtttctaccttcatttgtgatatcaagttttgtgcgttacaggatgtttcctgagtcgctcaatttcagctcggctgttccagaagtcagagaccatgatttaaagattaaggaggagccaactgcaccacccaaggtaaagatatacaatcttatgtaacttttactcattgtctacaattcttttcagatagaaattataattgtgtcatcatctaatttattcttttattactgagaagaagggaagaggacctgcacctcgttggtacatatccactgaggagcttgattcgttgtcatcgtgagttctcaattgcaatgatagcttcatttcatttacttgtctttatataccaaccacattcctttatctgcatccaatatgtggttaagtgtttttttttggtgtttacatctgtccgtttgagataatgcgatgtataccatatgaatgtgctacttctttctacaccattcttcttttctgcatacttagattttcttttctgaacaaatggtaagaaatgctaggtgaatgttttgtgatttacctagggcctgttcagattgtagccaaaataaatcttaccaaattttggcattgtcaaaattttgccaatttggcaatattgccaagttttggcaagatttcttatttatttattagagtttggtacgaaactaaatggatgcacatatttggcaactttgccaaaaaaatggtatggtttgaaatggcatcaatctgaacaagcccctagaattgagcctagacatgacttgcagtcaaaacatctgccttctttgcctttgcatcatctttttgctatgtgggtctcacaggcaatgaaggttgtcatgaggtttatattatcaatccagcactactgagtatggagataagtgcctatttacctatgttcctataagttgaagctgttaaagtgctgcctattggttttgtaacccatctatttcattatacaccaagttcaatcagtagagaacctgaaatatcaaaactcaagagacaaacaatgcaatatagctggtatggtcaacttctttgagtttcttataaatctaggttctttgctaacttgtctttaagaaatggttatacactatagaatagacgaaatcacatggaagttggaacaatatttttactcaggaaggttgctatttcattttcccattgtgtagaactatataagacatgcaaactggtgccatgccttcaaactaaaaatggcatcccattttgttactacagatacatgagagggaggctcactctggagaaggttaacattgccatcaatgaagtggcttcatatgcggacggcaatgctcatcttgttgcatgtccaaagaaaaaggttgatcatttcaataactttactccaccttttatttataaaaaaaaatcaagattattgaaaaaacagtgggaactagctggttcctgcacataaaccaaatttacccccaaaatcagatgtttcattttctgtttttactaataagcatcatttgataaactgtagaaatttccattcttatgtggagactttggagagaacttgaatataatataagtactaaccgttaaggaaacaattgaactttcccgatagcagaaaccagcacatcttttgtcacagttttcaaatcaatggaagtttaacctgtaaacagccattgcccagttgtatggtaggattggttgttgaccatccttaatgttcttgcagttatcagaagacacatgggagaaggcactggtaagttctggaaggatgttgattcgatttactcatttttgtgcggaatcagcatttttttttctttttaggaattaagggacattgcagcaagagagtcagttaaggggaggcatttcttcttggaaactgatataaagggaccgggcttaaaacttgataccacagggaaagcaatccttactgtaagtatatgcagctttgaccacttgtgtacaaatgattttttttcttctatatctctaagatgattttaatgatatacatatttggtagacaaaaatgctattcaaatttttccctttgtagttggcaccctttcaaagaaatttggtagcataatttgtatttgtcaaacttgaacggggtagagaaagaacatggtacgctaaattaaacattaactgtggtattgaagttaagcagttaaacaattccattcatatgttttgccctgtttaacaaaattgatttaacatttcataactcatgcgacgcaccatacttacactgcattcctgtctgtttatttgtataacagccagtattaacgagactactagtaaagccatttacttggcaccattaatgatgaatatttgcttgaatgaaaataggatgctacacactaatttcttgaagatgtgaaacaaaaactactactgatttgctcttgccaattggaattttccttttctgccgcattaatcttctcgtgttttttcaggtccttcgtcatctcggccgcttccaggagacccggattgggcatcatcgcgttttcatactttcaaaacaacagtgaatgaagggtctcctccaagctttatttaggtgctggagaatataaagtttaatttggtgttaggctggagatagatacgcatgcattgagcttgtttactaattgctatgctgtagtttgttgtatacaggtcagggcaagtactataatgctctatatgctacccctaaaattgccatattggattgagtgatgaggtggaggagataagtgaggagagagatgatgaaccacccctaaatcaagaggcaacctccacacaaatctattatctatctatctatctatctatttctattatataataaaagtctattaaattttctacaaattttctcaagctgccacgtggcattctacgaacgcttctaagctgtcacgtggcacttttagaaattagaaaatttcttaaaaatctataaaaaaaaggaaaacattttactgttgatttttattaaatttagtggtcccattattttaagcgtttagatttatccgaatcaacctacaggtaggaacgtacgcacccctctttctatgttatggttgttaagatttaatccataatttgttacagattaatctatcta

SEQ ID NO: 32372 - DNA, 12004 bp, Oryza sativa
tcctcgctctgtgtgcatcctccctctctcagcagcacgaggaatccccgccgcctcacctgccccgcctgattccccgcggccgacgcagtccaccgccggaccagccgccccctcctcgctccgtgcgcatcctccctcctctcagccgtacgaattcccgccgcggtccactgccggaccacctcattcgctggtgcgcctcctcgcgactccccgccgcacgccaccgcatcgtgcccctgcaggcgacgtggtggttcccccttccgccagagccccatccgagatggccgcatgcagtcggcgtcaatccagggccttccatcgccgagctcgatctgcagcccttggtcgctggcgttcgaagctggcctcggtgtggagcacgccgttccgcctctgttcaaagcccaccaactcctccaaccgtaatccccaaccagacttgctccatctatcgccaacactcgatctgtatctgactatctgttggctactgccctggaaggacaaggggcatttgatgttggcagtagttcctcaccatcatctcctttcccagcgtgcactcctgcatccccagccatgccaagcctggcgccgacctccggcaaggacgacctcaactttgtgttgttcagcgtccaatacccattcaaaatattccagttggtcaggtaattagttactatcttggctaattgaccttctttgtctattttctcctatacttaaattgaaccattgaactttgctctttgttaactatttcatcttgtgtaagttggaattccagtaattaaaaatgttgattaggtttcttatttgtcaaaattttaatcatattcgatttggtgtatttaccttctcatttctagatagcacaaattttgattaaaaattggctgcaatagtgttctctgaattgaagaggcagctattaaaaccaattgagccttagattgttaatcaggttgttgatattgctcgcggtcactgtcgttcctaggtctgtaacacctccattactatgctaccaacatacacaactttttagcctatatatgttttcttttgttgttcctttaatttatttaaaccttttcaggatggatagggaattcaggatggtagttggtaatctcctgcaggtagaatccattactttttactgtctttttctcaatcatcgcaagcattttctttgcttagggtctgatttatgacctagcttccatgaatctggttatggcagtcttcttggtagatgtggcgttaggattgtgctcccactcacactcacactcagaggcatattgcctaggtctacagtctactccaaaccacatagttcaattcctccgcgttttaggtaaatcactgatctatctctgtatttgtgagaaaatttttgatttggtatatatgacgaccttgagaagtaatgatatgctttcttctggattctgtatatacttttgtgcagaactggagtcaaatgtttccgtttgttttgtggcttgattagtcctgtgcccatgcatctcttgctcccttactaatttctctggtgtgtagaattgcagatcaatgatgcatggcaaggtcagagcgccaatgaagtactaaaatggtaaaagaagctcctgctcctgtaatttcttagtatctctatgcaacaatggatgccctgatatactttgatacaggatgatctgttgattaccatatccgaaccatttgttctgactgtttatatatattgtagatcaagcaactactgatcatgccatttgtagagtttatgtgcttatcgttgcaaggtcaacaaaggctacaaacaacctacaaaccttttgctccttggggctactaaagcgctcttcttttggtgaaatggcaagactctgtttcgaagagtatatttggttgcttctagaagtaatactttttgcatatagttttgttcctttaaccttttaggatcaactaattttgttctccagcactgatttgatcttaatgactcattgcttccaattccataaggcacatgctagatggttattgacagccacaacaccggcgccgaggcggtctgccctttcgccattgacgcggcccaacagtcacgctgctcgactgcgccggtgtgcccccaacctcttgtccttgaagccacgtcttgctgaaacgttgccccaggcacgattagggcgcttgtggcactaattcggaaagatggaaggtaattacaatcttcgacccgcgattccctccccctctacctcatcgtgatcctctcatgttccctttcgctattcgcgctccggcgaactactcagatcggtcaatccctgaaatagcagataggctggtggaccttagctgtggacgactgggatcttgatggcaccgatccaagcctccgaggagagggatggctgtggaagggcacatcactgacaaggtagtaatttaccaacatcttagtgagcataattccacactaatgagcataaaagttcttttttttgcttttaatacatacagagattcagttcatctgcctcggattgctataaaaatactaattgtctattgcagcactatatcatgtccatttaacaaccaattcttgcacagctaagaaaatgtgtgtgcactgtgcagccacaattgcagatatagttaggtacaataagtgaagttgaggggaataatttggtgatgactataagattttctgcttgtgcttctcaatattttttagatatgttatcctctaatgtaatggggagaaagtctgatatattgtgatacttttcctgctgtaaagaagtatatatggattctagacccttatgctaaatattttcagtgttatgacgttagctgccatgtttaaattgttcatttatacaggtgatatttttttcctgcatttattaattcaaattctaaaactatatatgctgtagaatttcagtgttatgatgttggcagccaaatacattgtttaatagggaatatatttcttgtatgcatagtgaattcaaattctgaaactatgtcaggttgttgacacactatcatatatggctcactgcctcatttaaattcttgaatctgtgttgacttgcatctcccatgtggtactcaaatggactcagaagctccccatgttgatattgctaatcatgagcattctacaatcatcacctataaacttggttgatggactttacaaatgcatcttgtctaaggaatccctgaagtaagcctgtttccatacgattaatagaacatggcattatgttattgtttaatttatattaatgatgtgcgttttaggaaagagtgtattgtgatctcaaaggcttatccaattcgattgagtctaaaaacaaaatcatgaatcacttcgtatgaatcatcacctgggcattgagtgtttcaacatgattgtacagaggcttgcacacaacaaaattcctacatttaatgggtccaaaagttctgttataaagcacttcatggacatgtgattttgtataatatctctgattattacatttggtttcataggatacttacatcactctgaattttctatcatttttatttttttcggcaaaaattgagcaattttggacatcatccattatgctgcaaggttattgatgttaaatcatttgcaagatccatagatgtttggccatggatggattacgatctcgcgttctccaatgtggcaaagttcgctcacttttgcaatgtggaagttgcttacccttgactaaatcaggttttcactctccctaattctcgagctcgcatactatgtttagcacattatgcttttcatttcatgtgttctgtaatatgagagcttccatataattccctcatctgattggcagttggcaacagcctgccgtgtttgttacaattctgaatagaaaactttgcccatgtcggtcatgtgtttgacaaaatgctccagacacttgatcaaatgaatgtatttgtattttctcacttcctcagtatagcaacaaaaatattactggtttgctttttcaatctgaatcactaggtgttgttaggtttggagaagtttggactgaatcaatgcaatggacaattcatagaagatttcaagcagtggaaaaaggagacttctacaactgccacaggtacaatactctgacattgaaatagaagctgaccaatgcgctcacattgaaatagatatatgtttaagtacagcctgaattttccttaataaggaagaccatttaaccatttgtgcaggattaaaatttggtctaagatacagatcttgatggcatggtggtgctgagtgtatgccataattctggtgagagttggatgtaatttgcttgccttcaggataaattggatgtattttttgctgaccaactggatgtatgctttcttaaccggttttatttatatataactttagtcagcttgtgaaattatgtaaaattcagttcctgaagtactggtacttactgttgatttatttgtgcgtgcacttactgatataagatcatttgttattctctttacttacaatttcacttccagctggcaatgatttatacttcaatcataattgtttgcttaggaagtactctctccgcttcatattagatgtttgttttcttttcttagtcaaacttcttttaagtttgatcaaatttatagaaaatatattattattttcaaaagaaaacaaacatattatgaaaatatattcaatgttatatttaattatactaattttatattttagatgttaaatttttttataaacttggtcaaacttaataaagtttgactagaaaaaaaatcttataatataaaacggagggagtagcaacattgcaatgtataaatcatgccgggctaccttgtacgttatggatatattcaccaaaaaggattttatagaaataatccaaatagggtttttactatgatgtatgaaactttatttttaccttaacaatttttatggtctgcactgccttaaaaaaagtcactattgttctactccctctatttcacaatgtaagtcatttagcatttcctacattcatattgatattaatgaatctagagacatatatatttatctagattcattaacattaatatgaatgtgaaaaatgctagaatgatttacattatgaaacggaggaagtacctacatacatacattgccaaaacgtgcaagtgcacgattacgagtgctaatataaaaaaggagttcaccccctagcaatcctacgtgtgaaatcaaccactcttatcccatccgtccatccaccctctcatccaatctgagccgtccgctgtacaccgtagatctatatccacaagcgatttcgcccgatgtcatcccaccacgcggtaactgcgacgcgcaaatccccggtgcgatgacgactccgcctgctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggtgcgtgttcttgtgtgttcttgatcgatcgatctgcgttgggttgcgagatctgagatttttgcatgtttgatctgtgcgtgtgtgcaggggtgatgcgttgcagcaagagctgccggctccggtggacgaactacctccggccggggatcaagcgggggaacttcactgagcaggaggagaagctcatcgtccacctccaggctctcctcggcaaccggtgatttttcttttcttggttttatggttgctttgattgctttgtccatggcgtccatggctgagtgggttgctggctggctctggctgtctacgatgggcgtccatggcataagaggattctgaactgatgcataagagtgtcttgcatttgcagttctctaccataatcgtggtccacaacatagccgtgctttctgaatactttcaatggatagtcaacgaagctctacactacaaatttctgcaataacatgtactattattttttgtctgaattttgctttgcttgctacctttattttacctggagacaatttatatttggcctgtgataatactctattgtagtgtatgtactaaaatgtgtttttattctatttaggagggatcatatggaggttagttaactattgtttatcactgattctcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttggaacatttgctatagtattttctgatcttatcctgggatgtacctgaacttaatattctcggttgtaccggttcatttctgagttcattccctgaacttgttgactaatttcaatctgtgatgtggctcaattttttaatatatatctaccaaagtttggtttgtttatgttattggtgcactgagataattttaattattttggctgttacgttggtaaattatgcagttatgacattttatcacacttcctaatttttatatgtagtttacattttatacttatttttttatacacgtgcacgattcctagtatatctaatggtcaacttaattccttgacttctctcatggaggcaaaaccggttgtggacgaaattctgatgcatgtcccatgtaccttgatacatatgaggttcattggtggtcttaggttcgttctttaataaactgtctttacaacgatgaccttttaaacttaacatccaatttatgataagattaaaccattgtatttcttttagttaaattaactgtttgagctccataattagatatttaatgacttttttaaactgccacgtggcgctctaataaatccttaaaattctattaaaaaagcaaaacatctaatcgttggtttttatttaatcgggtgaacccatagttatcaccattagatctatatcttaaaagtcaccaattaaatctatccccaaaaccgccacgtttatgccattgatcgctactacctccgtcttaaaatatagtaacttttagttacgaatctgaacatacaattgtccagatttatagctaaaaatgcttatattttgggacagagggagtaagtaggaaggaaaaaaaagtacggtacgtttacgcccagccccacgtcttttttttcttttcttcttctctcacttagattagatgaaaaataaaactaataatttaagctcatatgcaaaaatatatgttatttggagttgtattataacaagctgtatgctgtcggatcatccataaaaaatataaacaaattgaaaatatagattatataactgtatatcacttgagaaattagacttgcatttccaaaaataaaaataacattcaaacattcccaaaagttaaatactgatataactaaataacattactaattttttcatatattatgtgtttttcttttgatagtattgatgtgctttatgtcctaggcttcattcgctctagctaattggctgagcttatcaggacgtgcaaaacaacgtaggtcattggcattgaatattatgattaattaagaattaaatattaaaactttaaaagtatatttatttaatttttagaatacttttatatagaaaccatttccaaaacacacacaatgttcggtaagcatgcttacagtaaacaaggggtggccaatcctataagtacttcggtactcaaccttaatcattacttcctctctttcgtaatgtaagccattctagcatttctcacatttatattgatgttaatgtatctaaatagatatatatgtctagattcattaatatcaatatgaatatgaaaaatgctataatgacttacattgtgaaacggagggagtacttaggtactaaaattcttaatatgtagtatataatttactttgtcaattagtagtagccaaatatatcaattatatgtccctactattcaccgtatatataagttctatatagaaaccactgtctatcaatcttcgagtctgtcgacggtgggtacccgtagaccgaatatagagggtattggggtacgttggtacgaggatctatgtaatacgacatcaaggaaacaagagacaaagattatactggttcaggtcccttaataggtaatagccctaatccagttgatatgggattatacggggatgaccacaaattacaaagagaataacaaaactcgacgataccgacgagatcgtagtcgagttgattcgactagatcacccagcgacttggctcctgtaggctccggcttcgtaggctgtggtcgttgtgttggctatgagatttgatgccttaggtcttcccggggggtcccttttatatcgcaggtcaggtggtctccaggtaggactcggagacatcggaccctgcacgatatagtgacgacccagtcctatacgggtaggaacctttccattgatggacttcgagatgaatttccttagcgtatacagagaacgtccatacacgcgcagatgtaccgtattgccatatcgcgtacatctaagggtaaagggtatatcttatccgtagccctgacagagtcataccctacacaatgcacctaataattatctcatatccaatgagcacgtgtaccatctagcattgaggatgaaggacgatactaactgggaaatcataaaaagatgacagataagtagatgatgccaccaagtgacagtcaaacaatagttgactacaattagattgtgactatgagtaataatattcctactctcctacaaccacttctaggatgttacatgatgctctaataaattaagtaaatgtaagaaaaataataagaaaaaataaagcatctacccaccgttttacacttaaaccggtggattcattattttcaaccattagattagatctattaaagtaattgctcgctcttaaaaaccagttaatccctccctatgtacacatgtacacgaaaagaaaaaaagaagagtacgtacgtatacaatcctcttgttcggtagttctctttctttctttctttctttctttctttctatgtagctctacgattttcctcacgttatatatatatatatatatatatatatatatatatgtatatatatatatatatgtatatatatatatatatatgtagtgaccactcctggtgaggttatcgaagaaggcacaccgtgccactgcacgccatcccatctatttacttgaaagtatttttttattaactatgaagtaaaagacaattgtagatgctcatataaacacgtgcacacccacccaatgaatgcacatacatatactctacccctaggagagaaaaaatatttgtttgttgaaaacccaagaaaaaaagtacataagtacgagactactaatcgccggaaaaaaatattcatgcgtatgtacactcctaaatgtcaatgaaaccacattataaacctttttttattatgtcagtctcttctaaatagtgttaacaattagtaaaaataattttgacaatatagatcattccattgtatattgcctcctgaacatgcataagtggatcgatgtataataaaaggagaaaaaaagccaaaacccatatttactcgaatgtttgggaaggatggtaatatgcgagtttacgtataatcgggataaagtttttttaatatgatagacattatcatttagtatatcaaagtctttggtctatttcacggtatacttatttagtttttatggttataaggtaatctatgattttttataatgaatatagtgtgatataacttcttttttagtattctcattacaaatagcaaaataaattgcccgcgcatctgcgtgggcttcctttatagtttcaagaaagtgtaagagtactagagatattagagatgacattgtatattagaggtgacatattatatggtttgcctcttaatttatgagtgaatgatatgaatgagtttggatgtggtag

SEQ ID NO: 32373 - DNA, 5507 bp, Oryza sativa
gaattcctgcagcccaagcgaaggggacgaaccctagttagaagatagggtccaccatccatgcttttgaaggggaaacggattcgaatacgatgcgtggcccggagcatccagtgtcgacgttagagaggccttgatcggccgctgtcggtgggaggagattagttccggtacttccatctgcattgatctcccaagacaatggtggacgtccactcgttctacctctacgacgacgacgaccgatacaagtcgcatcttgtatatggtccgatacgcatgtacggattactatattttttctccttgtgttggggatcgggttgccgggcgatctatgtatcgggattttgttcacacaacggtttttttgtgtgactagttaagtgcccgtgctctgtaacaggttctatgtatatataacctttatgtattgtataaacaggcaaaatgaattaatggattgtatgatatacaaactaaggacgagaagctgttaatattgaataagaacattgctaatatatactccctctgtactcgtaaaggaagtcgttttggataatttttaagtcaaatcttaggaatataaattatgaataactcttaaggttattgagtttgaaaatataaaaaaaattatatgaatagatttttcttgaaaaatactttcataaaagtatacatatatcacttttcaataaatgtttttctagaaacaagaagtcaaagttgtgttttcgagaccgtgtcgctgttcaaaatgacttccattacaagtacgtagagagtacatctcatatataaaatagactaacgatgcactccctctgtcccaataaaacttaaaccctagcactctagtaaggatttaaggaaaacgacaaaaaaacaaaatactcttagctaataaagaaattgtattggtgaatggatggatggggattagtgaaggaataacatttctcgatttgtgaactgatagtaggtaagaagatagaagttggtttattatttaggacaaaattcaaactttagaactgatttattttggatggagggagtaggagtcccgacacaattactgcttttaatacaatacataaaaaaataatcataaagaaatagatagatttgaagttaatgttagaaagtttgatattctatctcataaatcacaatttgttgtaaatgcacaccctcctacgtagttttgttgtaaaaatcatcccattacgcatgtgcttaatgaaatcaactcactatcgctgatgtagagccatcacatgctaagctagcgagtcaatcttgtccaagtacttgcattagacttatttcttcatgtttcattgaattcttttatgcatatagcgaaactaagtacgacaacgtttaaactctcatcaacaattctctttattgaatcttcaaggaaagtgttaaggctataattctagaagtatttaattttgatagagactatattgatggctcataatttataaaaacacattgattatagcctattacttatgagatgtaatcttaaacgtgttttataaagtgagtaggggtggacatttgcaaccaaattacttatgaggtggaatcgtaaactttaagtgatttatggggtggtttattcaaatttcataattttcaattgtagaataaagattagcgcttggcagccgagcacgtggcagtgagcctaaatctaactgcaagagcggagtctagagtagagctgtcgagtggtccgaaccctgctccatacttctagtttagttttttatatcactccagaccgcttcgttgctattttgggtagagttgaaatcatttgtttgaatttcaacttcaaaagaggtaaagctgaagctgtagccctgtcaaataggccctagatatcacaagaaatttgaggtgataccaaagtgaagaatggaaaggacacacctaaagcgattgaaataaaaaaaacgaatccacggaagaaagatgttactacacccacaccgcgatcagcagagttgccatccattagagttgtacacttacacactgagtgctgaattttaagcagacacaaaattaaactacacatggacagaatagtggaatgcaccaagaagaagaattaaattctgcagctagagtggtatatatgtagctaagctaggagtgagactccaccagaacgtacagtggcttcccattgagcctctcacgaccctgccaaaagaaaaaagaaagagaaaatttcagccccaaattaatcagtcatcggcgacagcttcaatttctctcgttttcttgacgggaactgatgcagagtcctatatatgtatataactggagagagactcagcagcagcaagccagcaaccagcgatgaagtgacagtttgttgaacgacaaatacgcgaatattagaaaataacataatatcaaataattagaaggggtgaggcttctaacccgggcagggttggaaatttcggtcatttcggtgacccccgatacgatattaatttggccaaaatttttgattttttcaattttttcatgaatttggataatatttgttcaaattcaactaaattttgttcaaaatttcggactgaaatttccgaaattttgagatttcggtgacctctgatataaacccctgaaccgatagagtgaaccctgaacccgggtcgtctagcccaccaccttgtggagctagccggaagaccctggacatttctcgcgatgacgtgacagtgacattgtggacaattaaagctgaaaatgcgacattcagcgatccatttggagactggtgatactcatattttccttttaatttgagacaactattagtttaatggaatagttaattcattactcgatgcagtctacggcgattcatcactagtcaagataaactccggttattgcaataatacaacatattgtatttattctactatcatcgatgtatttacaatattcaccccaatcaatatatcccaatgttttaatcaaaataatactagctacaacactttatataattcatgcatcttttcttttgctagtactatcttgcgtatctatccatctttttgtttcatgaaaagtacataaatgtgtcaatgttcaatcactctcggttaacgccggcaatattgaatttggatgaagaacgggatatatactgaattgaaagtaggagcgccacctgccaattcttctctaccaaagtacgcaagttatttaatttgggttaactagttcatttattttatctcaaaatatatatactccgtatctaaattcatagctaagagttactatattttagaataaaaatagtataacatgacctcaaaacaaagtgtagaatataagtgaaataaagatgaaggacatgttcagataacatccacactttacaacacactaccacaaaactccttatgggttgtactaagtcataatttgatggatataggtcttgtcacacatgagtcatttctaacccatcagggatgactggatctgaactagctggtgacactttcttgtcaaactttaccataattcatactcgtggcaaggttggatgaagaaattaatcgcaccatagcagatggagtagaaatgtgttaagccatagttttagttactatagcttgcctaaattttgatatgatataaagtgtgccattcaaccaaacaggtataaggcacttattgtacatgcatgaacttattaccttggtgtacttacgatgcacaccaactaaaaaattatgaaaaacaaacgaaaaaaaatctgcatgtaattgtaatcttaccctatctacatatacaattgtaaatttaaatttattatattttatgataaaaccaatgaattttgtagttttaaaagcatcattttgcttaattaatcagaattgttctatttcgactactctatctgtaatcagtcttaaccggcatatgcatcaacaccaactattaaaaatccgccaatccacatgtggtgtgtgaaggacaaaaatttacgtggatggtaattagaagtataagggtgtgttctttaccccatctcttcacaacttctattttctcctctttttttttttatgtacgcgttccaaattgctaaacgggacttttttttcaaaaatatataaaaaattaatttaaaaattatactaataatatattttttcaactttatttttgctaatgtttaattcactttgttttatgtgcggtgtggggaggtggagttcccaacctccacctccaaatgcagccttattagtagacttttttttaaaaaaaaaattggtgacaattatggttactatgtgaaaaattggtgacggtatatgtttaggagtgcgtgatgcatgtaggggttgtttggttcttaactaacatcgtcataactcactttaggtaatgttagacaagtgtggcttgccacactttctgtggcctacaaattgtaagccacatttgtggcaaagttaggcaaatgattaagtctataacatatggagtaagatggtaagaaaatgtggcttaccataactatggcaatgaatcaaacacaaagctaacgaggtgtggcagtttaaagtatggtctggcaagttgaagcattgaatcaaacagccccgtagtatcccgataatgtggggctagctgtcgctgtccggccggacactgccaatatccctgtcgccgtgtgcaaattattcgtggagaaggatggccggaatcactcgacatcaacactgtcggggggacgcatgaagcaagcaaattagctggtagaaaacatgaattatccttgtaccaatatattatatatttcttcttgtttgtatttctcatgttctcatcgaacttggaaatgagctcactacctgccagccgttaagctagcttcaaatagcttgtgacagggtcccctcctatatatggtatcccatctatatcctaccatgaatgaggtcatagcttgagccaaactgtggtttaatttatcaagtggaatttggtctagagtgaaacaatgcttaaaaattaagggagcaatgtgagacacgcatagcgcagatgcaagatcggtccaatgcggcatgaggggatgaggagacagaggcacgaccaccacagcgcagatgcgacatgttttttggccacgtgtggactcaccaagatcgaagaactcgtctccctgtgcggaggcgagaggctcagcagaggcacgggtttagtcgacacgtacgtaaaaatttaagctggtgatccaaagcaactcgatacgttctcgcactgtaaaggccctaatagtctctggacaattagctttatataatttggaacattgtgttcaatttttctttgataaatcacactctatttcatccaaatagaattcatgtaatcacggaggaattttaattttttatatctatatatattaccccttc

SEQ ID NO: 32374 - DNA, 24084 bp, Oryza sativa
catacggtatgttcttaattaagttttaagctagaatgattatagattatttcttaaaagtaaaagtgcctctagttaaattggaaggaagaactcaccttcagttccgggagctcaatcacacatgcacactccaccacttctgcaccagcacgctctgcatgcatgcacattcaaatgtcatatatgatcagaaacagaaaatgctcctatatagtacacattgtactgcgttaacatgttgtatataatattgagctcccccaaacagggtgatagtcacatttgagtcactattgcaccatataattcctccattccagaataaatatcattttttccttccttttatcccaaaataaatccattttaagcaattattgcatcacaatttgtaaaagtatgtgatatatgcatttccagtagataaaaagagaattaattgtaatggaatttgataaactgaggatattttagattttttggttttgtattggtatgtgtgggatggatgaaaaattattttattttggaacggacgggtatactataatacatgtaatagtaatacacacatatatatctcctgagaattcaacaattttgtgatattagcactaattcttcgatctgaatttaaacatatatcatgagtgttatcttattaagcccggctagctggtgaacgatcgatcgatttccaatctggcatatgcatccatatatatgctcattaatttaattacagatatgatataattaatactccattcaattcgtgcaaaaatatataaacctagtattaaataagatacatcatagtattacgaatcccaatactaaagtgtatctcatactatgtttttatattttgggataaaacgagtacgtaccaagcaagacgatggcggcacagagcgtgccgccggtggcgacgaggtcgtcgacgacgagtgctcgctcgccgggctgtaccgcgccgacgtgcatttccaagcagtcggcgccatactccagctcgtactcctttgacatcacctcacctgcgcacatgtatatatatacgcaatttatcaaattcccattcacatacaaaattctatgcaagtttcatttcagtctcttggtcaggtttatttcactactagaattcaatagcttccctagagtttaaattagaactcaagggataataagaatccctagggtgactatggagaactcaagggaagatttatgtcccctagagttacaatatgcaacctagggaacttatgccacatcagctctattatgaaattattggcaccacagtggcaaccaaagtgagtcccacagaaaattttggaggcaaagctcccagcagcgaaattttttgcgggaaggcaatatactgtagtagactaaaatatattctcccccccccccgctccaactcccctaaacaacatcagaagggtgtttctcctccggtcctccccaactttgctgcttctccaatctcccccaaatccctctccaaatccctatctttgttctggatgctatccaaatcggagctccctgctgattagaagacctcagatagagcattatggagctctattgctgtagatcgatgttggaagtgcatcgtcctctctaacccattgccttccctcgaatattgttagtaccttgcatatcagtaccttgcatattgttagttttgttgtttgccctatatatacaagccttatcaaacaaattggttgttcactaaatttgtttaataaaattgtaacaattgtttttttataggatgactcccaagtatcaggtgttagagaggaaactggagatgacagggtaaatgttatagctgaaggaatgtttggtggctacttgaccaattcatctgctaatggtgccaccacctttctcccagctttagatgaacttgatccattttaatttcaactggctgtggtcatagggccaacttttgggaaaacttggtagttatagcgcctaacttttgggtaaagctgattcttaccgaaacatgtgtaatgaagtggaattatgccattttgagggcaagatgattataatgcatcttttgaatgctatatatggtgctggtggatttaaacaatattttgttcctgtgtttaatcatattatgtgtggtggtggtctttgtgcaatattacttaccttcagtgcaatttattttacataaatcctaatgaattgattaacatcataaattgtaataattatattaaaaaatgctcaacataataagtaattcctagggaatgcatgtttttgttccctggggtttcaaaaggaatctaacaactctagggacagtaactttacacgtcacttgacacccaccagctgggcatttttccctaggtcaaacaaccctagggagcattcctttccctaggtttctcttgcaaaaaccctagggagctctttgtttcccgtagaccgtttccctagagggcattccctagggttcactctagggaaacctcttccctagagtttttcaccattcccttgggtttttggctctagggatgccattgaattctagtagtgtttgtagtttatttgtgccacgctttcatagtatgattttccaagaacttttcacattatgttagcattgtttatagaacttgttttaagctatttgttatatatatttatgacatataatatttaagtgactctaaaaaaggccattagtttgtttagtgaaaaactttcaaaatataatgtatagtataattgtactttaactatattataaattttatgtaacttgtatataagtattaaaaattacacgtaacttctcatacataagttatatataagctacaatatacgtagttttaatataattacaattataatatagttatattatagttacacacaaattgtactgtatttttttactaaaagtcttatgacaatttttagcaatctctatatttaactatttcctataaacgaatcaaccatctatcagcctttctttccatttcttctctaaaagtccatcccacagctgatggatgcatggctagaggcatgtttggttgaggattaatattgttacacattttttactaagatgactaagcttagtcttgtcacacttttgtgacaaacaaaataacaaactaaactcaggcaaagttaggcaagaaaataaagtgtatgacatgtggacaaagtggttaagggtttaggtaaagtagatttatagtatgaactaaacagtacctagtaaaattgtgtcttacctaagataaaatatggcaaatttagttgtcaactaaacaaaccctggatctttcgattctctcatggttatacatttatatagtctttgatgcgcatttcatattatggataatctttccaataagatataaacaaaaatagtaaaaatacagacaaaagtgacttaattttatgaggaatatactaaaatcatgtattaaatcttagtatttgttacatgtgaattgcctgtacgtactttctaggaagtcgcctgttaagaacagacagatcatagtttttacttagagagttaagcagccatacaattttctgtacctggaagtttgttaggttttcttagtgggataaattttgcaccaatagcgagcgctatgggaggaccgaaaataaaccctctagcttcgacccctgcaccagaaagaaaaagtgaaattaaaaaatctactggaatttactactccaaccaaagaaaatcaaacttaataaacatgcatgagctcaaaatggcctgccaggctacttgtacatataaatatcatggcagctcgatataccagcgaacatatataatggcatggatggttatatacaagtagacaaggcatgcacctaattagaccaattaacatcagaactgaaatactacatccaattttacttatacgacattgttaactcttaaacaccatgtttgatcatttgtcttatttaaaatttacaaatttagtaaaagaattgatacagatatgcaaatataagtaatgtttaaagtacttttaaagatgaaataagtcataataaaataaatgatgcttgcgtacttttttaataaaataaatgatcaaatgtgatataaaaataaacaatgccatatatttcaaacagagagagtagtatttttcatatgtgaatatatatatcatacatgatcacagataaaaggacaagattgtgtgtacacaaagaaaaaaaaaccaaacaaataatagatcgaggagttggcccacaccgacagaaatcgtactcaactacatacgtgcagccatggaacagtacgatatatgtgcactggatcttgtgatagctctcactcattgactagcttgatacatactatcatcatgaaagggagagaaagatctaggaaagcatggacaccagctagtagcttatatataaatggctattgctggcccggagagacagatcttgtggtgatcgatcatttgcatcatgccatgcatgtgaacgtcaaagatttaatgcccactggtaattaacatcgatcggaaccatcgttttgcttattcgcggaataagagaaacgatatagttgtaaacgaaaaataatttgtgaataaaacttttatatacgtgttcttagcgatctaaaagcaaaggctgataaataaagttcgatgaaaaaaacctcaaaatccgctccaaatataaggttgaaaatttaaattttggttgataagcataagtataagcgaaaagatgaggcccgatatatataactatttaattggaagtacacattatatatgccacctcagtttctcaaagtttaaactttgaaaacgcttcttctttttttagcaataattaaatttataaattcttcaaaaatatgttactatatatatatatatatatatatatatatatatatatatatatatatatatatatatatagagcgtgcaacacatgccactagtaaatagagatgatgttcacccaatgcaagtttactctaatatgattcattagacaatattgtggaatcatgttgctcatacaaacaccgagaaatagaagtaattaagatatatttgatgacctcgaaaatataattcatggtgaattagttaagttaggaggaacttgggggcaaggatctaactctaaatccgagtcatgacatggaatcaaagtgaaggtcaggattaattgtatcaaccctatatttatagcattaattaaaaactcatgcattttatattggtatagattattgaagtatgtattgttataaatataacacaacatgagatggtaataatcaaccataaaaattattcgagaatagacagtatagttaataagccacacatgtattttggcataaataaagtgcctgggatgatattggcccgagaaataaaccgagggttcctttgagatgcaagatatatagaaacaccatactagaaataggaaaatcacaggagcagtgttggaattgcacaaagtagttgtttgatactctctctgtccctaaatataagatattttggttggatatgacgtatcctagtactataaatctagacaaatatgaccagatctgtagtactagaattcatcccatccatccaaattttcagaatattttgggacggagggagaacctgataagaaaattacaataaatttaaaagtatgtatctagatttattagggagaaagaaaattaagaaggtgcctatgaattttaatcaaaggtatttgtgaacattatgttagaccttaattatgctaaaatttctccaaatcatggaggaattttatatcctatgaaattactttgaagcaatgctacatctgaaaactttaatttcataggaatgttttccaatggattgaattcctcctctttagattgccacctatcaccctgtgaaaatcacatgtggagacatatgagtcaataaatgatgtgtgaggaaaaccataaaatctccaatctaaagagtggtaagacatcaaatccccatttttttttctaaattaaattgtggtcacatttcaatagccatcagctatcctctccccatctcaaaatttggtagcatcacaattacccgtgatacgccatagtgcagtgacgtaggctatgttagtgacaaccaagagaatatattagtatgacctagtgagctgacatgagagatcgaatatgtgtatggcatggtgggcgccttagaataaagatgtctatttccacactatataggtcaattgaggcgtacatagagaaaggaaagtacacctcaattaacttatgcgcatgtgcatatgttgtcatgggtgaagtgataaggaaagagagcatacccaaaagttttgacatacacaattgatcatatacacggatgcacacaaaagggatggtggactaaagcaacatatgtgcacggcctacctacctaaatggtttctattatcgacctaaacttcaacaattgacgcaaagtattttttttaactgactattagtttttttttctttgtgagtactgactattgaagtttgtaaagaacaagataggtaggggtatgacagtgccaggtgtataaagtgaactcctacaggctatgggtaatagtggaatgaaatgaccactcctaaatgaattgacatatgtgtattagttgttggaggtgtgtattatagagttatgttccatggtttagttttgttgatgtgcatatctaattaccttttggttctagttgaagcttttttatgtggtggaggatccaatccaatgaacatgacaggaccatgaatatttgataagtcacctaatcaaatccaatttatgtatatttttcatagttagtggcctcaaacttccttttatgcctatttaccaatctatacctggtagctgactcaaatgtccaattgtcatgcacatatatatgatctcaaaatatttgtccaacaggcacaaacaagtggagggaaaggcaaatatttttgtcatatcatctggaagccttcgaactttacaaaagggtcagacagagaggccaaacctcctgttttgtagtcaattactactgctgcattattcttcatttctctgtacatttgactgtgacactcctcatacgaataatctctctcgctctgatcttacacactctctctctctctctctaatttatttgtcattttagaattattttcgttaatcttataaattaaattgacttagcattttttttggaatcgacaaatgaaaatcatgtcattagatttttccatgaaattacttcgatactactgaactttaccgattttctacagtaataagtaggtaattaacggttaggagtatgtattattggaggccgggtcagtataaaaaacgacaagtaaaagatattgtactgtacaacttggctagattttcaatcgacccatcgtgtgcctgtcaaagtcacgcttttaattaactatatttggatcttcataaataataactctgacttagtattaaaaaaataaattatatatttcaatggatttgataagatctgatatttttttgagataaagatcagattagttactactccctccgtcccttaatataagagattttgacattttacttgtactgtttgaacattcgtcttattaaaaaaattaaaactattatttattttatttgtgacttactttattactcaaagtactttaaacacaacttttcgtttttatatttgcacaattttttttaataagacgagtgatcaaaacagtgcaagcaaaatatcaaaatcccttatattaattaagggacggatggagtacttgaataaacaaagcgcacaagttcaaataaatcttgattttttcaattttttgagataaaaaacaaaacaattatatgttaccagcaacaacggagatgcctttgccagtgtaccgttcaacgaacaagtcgatggtgtccttgaacacagggggatttagaagtagggtcgtgatatcttggaacattattcctgcacatttcatcaagaaaaacaaatattatgaaagaacctgaaaaaaaaaggtattgcatagaccttttcttctgcagggatgtgtcattgatttaattcgcagatctagtcaatcgattttttttctagaaaaaaataattgccacaaaactcttccaaagtatttgtgggaattctataaattaaatttgggcgggcaagggaagatgagatgtgtgttgagaaaaatgcagagagagagcgcgcgcgcacgcgtgctcaaattaaactgataccaaccaatatatatatatatatatatatatatatatatatagagtgggaaaagacttctaaagggaaaatcataatgtctcgaatacacaacattttgctcacaccaccttcatcatcacgatggatgcgcttatcgaaatatccacataattagccttttgaatagagtgagagtttcacctcaataggaagattaaatatgtcttcatgacataatatagcaggaaaaataattttaaaaataaaggaagatcagttcgcagcaacaatattttgtggtaaatgtgcatgctcaaaccatgcatgtgcatgcctataaattgtagtaatgtgagaaatttggttataggttacaagctgcaaaaagctcatgataaagtcacacaagaaacaagctatattcatgaaagtttttgggttcagaaccaataaacaaaaaaaggaaggaaagaaccaacgaggcaaggatcaatagtaccagtggggacctttgcaaggaaacacagattttggcacttgaaattaaaggcaacccccaaggtcaatattctttacagaattgcagcccctattgcacatgtatatatgagattatgagcacatatatgctgaaaaaaaggatcagaaagaagaagccaaccagttgatacataatacttctgaaaaatatttatactcaaaagaaataacatcgttcggtttcaaaacaagaagacagagctagaaaaccacatgaattaactagcgagacatgcaagaactaagctcgaaatcacagtaaagcaagagaggatgcaagaataattaagctaaaaaacaacaagcaagagaggagagagaacctggcttagggaagttgggcacaactctaatggtggatgctatggcctgtgtcctggggtcttgcatctccttcttctcctcagaccctgccattgctcctcccctctcttcttttcttccctctctctacaaatataattgggagagagagagagagagatgcaagtggaggcctgtgagaggggtgtgtgtataaatagaggaggaagctagccagcagcctccttgcagtttcagatatatggatgaatgaattatagatgatgtagctacttgcaattgtattttggttctgtacaacagtgcatgtttgggctctctcactccaattccaatatatacctggaagatcatatcatagctaggacctgatctagagatgttgctacatagattaatattatatacttatagcacacataactatacaaaatagcacatatgcatgcatgatgaaggtgtgttagagcctctagggatgtaaacggccgtcccgtcgacccgtctgatcagttaattaatcagatcaactctcacttaattggttcttcaggttgtatgcctgtcactgaatattttttttgcattgatccaggaaaagacaaaattggttgatcaatggctcagcagctagcctgcagatccattttgtgttatcactctctgaagagtcagtatatcaatatgtgtgcaaggaacaaaatcctcgattgattgcaggcatgcaactccagtaatgagactgactgttataatatattcaaaattcagttttgcgatgcgtaaaagcaacaatttccattcgaaggatttttttgacctaggtttttctttggaatttgctacaatcttttcattcatagatcacttgagattctttgggtaaccatgacatttaattcaaactagtaagattctgtgctttccaatgggtcatctcatataattagggattggctgggtggatggattgagaataaaacatagactaacctatataattagggataggctaggtgggtggattgagggaaaagtattgaattctatattgattacgtacacataaagggacgcacaacctctggtgcatggtgagaagggaacggaaggcagacgattacacttttaaagtagtagagatatgttcgcttaccatattttgtttaacattttagctaagagtatgaatagcgagcaaataaatatctcaagtgtggagtattccacaaaaccttattgtaaagagaaaatcaagactatgttattaacaaacaagtatgatagaaaggtgaacacaataatagagtccatgctaggtacaataatatgcaagtctagggtaaggccacatttgtaatgcatgaaaattccctactaggattaatgttgtaaaaaccagtgttcggtatccaaccacggaaaatcactggataagacccaaacttggtgacgacaaagagagattcatgatatatatttcttagcgaggttcagctgaacttatatctgtttaaatctgtactgaatttatacgtatattctacacaagttataacaattaatcgttcctgtcatcgtgttccgaacgaggtctaattaaatctcaatggtacttggcttgataagaaagtgaaaatgtgggtaccattaacccaataacacaagtgctaatcatagtctgggagatgttggagctttacctaactataaactctagcagacggcacaacgaaaagccgagatttttcagtgccaatttggattttggagggccgggccacataaaacgaaatctcaaaagctatatatacatagttcgaagaaaacgaaaccgaaaagtttgacgactcacgaagaatcccaaggaggatttgccaaatctcccaacttgcaataaaaccaacgtcttaatttacttgtctctggttcttctgatctgcctatagcaatagcaccattcttttctatcatgtgcacacgtatatgcatactaacccatgcaaattaatagcttattttacatgcaacccaaggtttatttaactgctaatcttgttgattagtcagtggggtcctgtgcctttttgtactggagaagagaggttgagatagagcagcacatatgatccatgccgtgcatcttccgggcacggattccgatgcgtggtcccagccgtggatcgaatttgttgaaaaatataccctaccctatgttgtggagtacagattaattaattagttaacagggggtgctttagaaaacattgttaattatcatggtactatggtagctagagggattagatgtgtagatccactggtgttaacaatcattgatccaaataatttggagggtactgagctagacatttgcctaaccacaaactcccctacaaattagagccattggatttgctttcaatttgttgggctctactgcgagagagaaacaaacatgcatcatatatctcttctaaaatcctatgaaatttcttttatgtagcaatcctcagaaagtgcaacactcatactccctctgttttctgttataagatgtttatttgaccaagtttatagaaaaaaatagtaatattttgaccaaagataaatttattataaaaatatatttaattattaatttaataaaactaatttggtaaacttagtcaaacttgaaatggtttgactttcactaaagtcaaaacatcttataacctgaaacggaaggagtatgttttaaagatacaatatacacaataatatattctaagatgcaacaaatcctaatgtaagcatgcagtatccaccttctccaacaaaaagtcctattacaagtccacttgtttttctatttcccccttaatttaggccccctcagctagctcttaaattttgagataagaacatgaatacatatactcccatatgtcccataaaaaaatcaattcttggatatgaatctgaagtacataacctatatccagattcatctatagaagctaatttattttgggatatggatggagtatacaagaggcaagtagtatatgtgaatggcacatgaagacaatatatacgaacaagctagccgtgtgcatgcatcattgctagcaagatggaaccatccatttctgtggggtcccggggtttgaagatttgggctatctgcctgtgaatattggggagaacagaatgaggcaaaactaaagctcctttttttttatggatttaagccagtggaggcaaacaggagacaccaccaccactcttttttttttttttttgcgatcagtggaagttagtattatgtatagtttctctaaaaatatatatgtttgagattgtgtggtagagcgttcgacgatgtctatgaccatccgtgtttattctgctagtgctatatataggatgtacattatgcatgagaaagaaaagccaaatgaacggtataccttatctcttatatcaattatttctctcgtaatattttttgttacgtacattatgatcgtctccttggatatgaaaaggaccagtgtaaccggctcaaaaacaaattaaagacgaaagagtctatgtaggaatacataatgcatgggtaagggaaacttttttcccccgctatatcatctctagttaatacggagtcgtgtagactgcttgagagacaatcctttgtaactctttcaagtcataaaagtatgttatttttcagaggcaagtataggaatatgcaataatgcatgggctaagggaaactttttttttttctcttgtatcatctctagggaaccggatcctctgatgtaaggaaaccaacgtcagagggcagtagtttcttcatccaccatccctaaagcatccaacgcctctcttgcttttgcttcattgtggggtgccgcaacctctgttctctcgcgcgcgaaggtgatcgattcattgagacggctatcaaggaagcggtcactgtcgccgagtcaaattttcgtccttcacatccaaaccggattaacgcagcctacgaggacgacaacagcccgatcttgtacgatttgccattgttaagtcaagtgtactccctccgtcctataatataagggattttaagtttttacttgcaacgtttgaccactcgtcttattcaaaattttttaaaattattatttattttatttgtgacttactttattatctatagtattttaagcacaactttttgatttttatatttacaaaaaaaatttaaataaaacgagtggtcaaaatttacaaacaaaaactcaaaatcccttattatgggacggaggaagtatatatttgtgtgcaggtctccgtgtggcgatcaagtgcaagaacagcgctgacggcgagtacgagatgaagcggccgggaagctcgacggcgccggcgcattcagcgtgccgctcgccgccgacctccgcggcgccgacagcgtggctcagctccacagcgcggcgaaacataacgcggcatgccccggtcaggagccgtcgaggatcatgcagctgtcggagagaaccttcgttgccgtcgccggcaagacccactgcacgtcgccggtgtgcgcgtcggcgaccatctgcaagcccatctgccagccgcgtcgtcgaccaagccggcgcccaagccgcaccctggccagccgccgcacccaacgccgatgctgacgccgtcgtacggaacgccgagcccgtaccactcgccggcgaggaactaattaattaatgccgtcgagctcacacattattatgattttttttctgctctgcactagcttaatgccatttatgatttattgttgtcaaggttggagtagcgcagatagcttatgtattcgttgatcttgagtttcttgggtcgatcgaataaagttccaggttgatttgtgaggtttgagtcaatacaggttgatttgtctcaggattcgtttgcttggcgcttcctcgctcgccgcctcgatgaatcaatccccttcacgcgccagagaacagagattgtggcaccctacaatgaagcaaaagcaagagaggcgttggatgctccagggacggtggatgaaggatgaagaaactactgccttctgacgttggtttcctaacatcagaggatccggttcccatctctagctagttaacatggagttcgtgtagactgctctcgagacaatccttcataactctttcaagtcaaaaaaaaaatatatcgttctagatgtaagtacatgatcaagctaacaatgaaaagattagttttttcaaaacttcaattccaattataatatagtgaaattctgttaaagacagagaaagctatatattgtactccctacttctgatctcaatgttaatatagtgcaattgaagactagtagctgtccggtcatgcttaatttctgtcttaattacggcgcgtgttgcttgtcgtccatggacgcccacatgattggactgatgaataattgacacaaagcgatcgatgttgcacgcaacatatgcactgatctatgaacacacacacataattagggcatgtataaaagtcactgatgtcatgttaggttgttgcaaacatgcacagatgcacatatagagttgagaaaatatagctccatgtttagaagcaaatgaaccatatgcctatataatggctaccaatggttctctctttctatggatctagaccatatggaaagaaaactacgtacagaagatggtactacattatatatataactatatatcattatctagctatttgacctcaaaactttggaaaagtaatggctaccactaataagtttttacactatttttattgtcatagctctgaaaaatacacattgaaaggaatgtatttattttttctttttgctagccgtccaaaccgtgttctcttttccgccttaaaagttttgtatttctctctcttttaccactattctgttagcactcacttctcttttaccattatcattgatcaatgttagttgaccattagatttgcccccaaaggcctattattcccttatgaaactaaaagtcataacaaatttcaaacaaaaaataaggagatatagttttaatgttgttagttttaaaggttgtatgaaaatgtatatattgtaagaaaattttcagttagttttaaaggtttttatgtgaaactttaaaataaaatatggaaaatagttttcacatataaatattaagtagttgctaatattgtaaaaaatatatatattaaacatgcaatgcagttaattccctactataaattatttaatgaaacatttgagaaccgaatgattccatggtgcattgtttttgaaaaaaataagaaaaataacatgttcaccaatttaatgtttttaaaatcaatatactttaggtagacaaaatttaattatcctttttttttgtactcgttaaaaattttcaaaggaatgtttaatgttggaatatgcacaagggcataatggtctattaagataaagttaactgtgctcatcagaataaggcatgcgtatgtacgtttataggggtgagtgtgcgcgcgttatggttgcttgtgttagtaatgtgttactaagaaaaagaagttaaatgtcaactactccctctgtttcatactccctccgtcccataatataagagattttgagtttttgcttgcaacgtttgaccacttgtcttatttaaaattttttgaaattattatttattttatttgtgacttactttattatctacagtaatttaagcacaacttttcattttttatatttgcaaaaaaaattgaataagacgagtggtcaaacgttgcaaacaaaaactcaaaataacttacgttggacagagggagtatgaaacagatgaagaatcattggcttagattgagttcgggagtgggttggaaccctcactcccaacacatagagcggcggttagtgcatgatttattaagtattaaccaaaataaacttgagaaatggattaatataatttttaaagcaacttttctataaaattttaggactgaggtagtacgtgtgttataaaaattttcttatagcaaagttgagtaaaaagatcttattaatctaattttcaatgtttttaactaatacttaattaatgatgcactaatgaactacctcgtgctcgttgtcatggggggaagttatgaaccagtggattcgatgtcagccttaatagggatggcaaaacaaaagggtctgttgggctacttggctgcagcgctgctgcagcgctgtttcacacaagccaagcaagcagccggctacagctgtggctgccacagcctggctacggaacacacccaaaaatgcacactaacgggagaatggtgaaatgaataagtgcaaattaaatttcacccaaaaaaaagaatattgtgtgttcccttatgtgagctgaagaccgcatcgatcatcatccctagttattatatattaacgcacgcaagcatgcatattgtgtaagacaaaagggaagctggatagcatatccatgcgcgcatgcaaccacagcctatagctagctactcccttcgtttcataatataagtcattctagcattgtccacattcaaatagatgttaataaatttagacatatgcatatgtatatattcattaacatttatatgaatatagacaatgctagaatgatttgcattatgaaacggaggaagtagattagaatcatctttactagattttcaccgtatgccctaacagtggtttcactggcgcgatcaatcatgcaagatgcatatggacatgtgccaacactcgttgtttcactcctagtgcttcatcatgtgtacgggggtcaatattttccaccataagagccaacagctctcgacttcggcgtgcaccatggtcgaccatgactgggtttacaactttacataccaaggaaaactggccggtttctgcgaaaaatatattttctaggacggctaaaagcataaagcgttgggtttttttattaagtttgaagtggattttaattttttttcttttacgaaattcggtcagattaatttcaccgcttgtcaatggtttcataaaaaccaatgttctaaacctctggctatagcggcaaagatggagaggggaacaactaggatacttcaattttgatgctaagatttatcggccgctaatagttgtacttagcctctaaattaagtatgaattaggaactatgaactccacgtatgaagtatgaattatgaattggtgatgaacttgatgtgcaaatcaagtgagtgatcgatatgctaacttttagcctaaattctgtcaaatttttgaactttttcctaatattttcgacaacagctaatgtcttagctgttggagagctcaaccgctaagaggcttagccggagatttagaacttgataaaaactagaaaaagccccttgactaagtttttgtgaatggttaggtgttagctagtagaggttgtcctttgtccttgttccatggttgttagaaagcttcctaagattttgtgaaaatccgtttagtttgagataatagatcatatatatgagttgaccgtagtaaaattatggcaaatatcacctttgatcttgatgttcgagttacatgtacatgaatttacatccactgaagtttaaatcctaacgtctatacttaaatagttatgtatccaatctctcgagttacatgtacatgaatttacatccacttaagtttaaatcctaacatctatacttaaatagttatgtatccaatcttttacagatgataaataaagctcttaaaaatatgtttgatagatagagtagacatagccacccatccaatctaagggagacttctcaagaataagaggaacatgataactataagctactgtaatatattaaaaatggtattagtattaaaataaagtttctcttgacaatcgatgacttgactgaacccaacgtgccattcattaaacctactatctacacaaccacttcttttctggtttcatttattagaggagcctagctagataggcacaaatgttagcaacgaccccgatgattcatttctaaactagctagaattaagcatggtaacgacatgtaaagggaagacatgtgcacacactcacgatgtatggtgtggcgtgccctttacacgctcaagacaggccaaccgtaaatctataaacctcacaaaatccccattaagagcacatccacgtgtgcgtaattatatatatgtatatgtttttttaattgtgtgcgtaattatagatatcagaatttaaactctactgagtatacagggttgaacgaaaacaggacaaaaaaaactgactaaccgacgcgggacaaaagctatgttgctgaggactaaatcggtccatttcatccaaattcaaatttgaattttattttttcgaagaactcatataaattcctaaacaaattaagaaaatatgaatctaaatgacttgtttaccgggacagaatggaaagcgtgagaaaataaagaacatgttctgatgggctgtgccgtaaggccactactgaactgcaaattgcaatatgtaagcccatttatgtattggtaatagctctgcaggaccccatttatgttttgaactgcaataagatcgagtataagaccacgcgcttgaaccttataagaagaaattatgggtgtgttggggattgaacataagacttcagggttaaaaccacataccacttatcgatgaatctctacaagattaacctaacgaattaaccaacgctggagccgatgttaaacttgccttctccgttcagtttggactaatcttgccgtttatttccgttaggaaaatcgtttattccgatcggttttctatcgatagccaacaagcagaacgagaaaattcaaactcgaattcggttttctgtcgatagccaacaagcagaacgagaaaattcaaattcgaattcgaattttagtttgcgaaaattgatccaagtcggaggtttttgttcggttttcacgaaaacaacatttaaggagctgagtgaatagccaatatggtcctaaagtttcgcttcgggctcaatttagtcatcgatgtttcaaattgtccaaacaagtcctctaaaataattatttgggttaatatagcctttggacccaaaaaacgccacgtgagcatgccaaatcatcctcacatgcagcggtataaatgaaatatcattctacccttatatatcataattaaaaaaaaagacacaaacagaaaaaataacaagccagcctaggcccaacattgttgcagagggtgaacgacaaaaggaatttatacaatccgtggttggctgcagcaatcgtaagtgacaattctaaaacgatcatacacgtgcgaaatatttaccttctttttttttctttcttttctatatggtatataagggtagaccgctgcatgcgaggatgacttggcatacgcacgtgtcactttttatgggtccaaggattatattaacccaaataattaatttggaggacttgtctggacgatttaaaacctcaatgactaaactaagcccgaagcgaaacttcagggcccatattagctattcaccctaaggagctttattaagtcctggtggttaacctattgacctggcaaaatatattcccttaaaaaaactgggaaaatatataaaagaaactgcggcctgctgggctattttcttaggcccacgttaacagcattcacggcccatgcatctccgaattggaacatgactaattgtaacaatgataaaaataattcagaagcattcatagaaatatggttgatagcccctccgtcccattttaactgcagccataattttccatgcacaactttgatcgtccgttttatttaaaaagtttttaaaaaaagtaaaaaacaaaagtcacgtgtaagtactattcatgttttatcatctcacaataaaaatactaattataaaaaaaatcaaataagacagataatcaaagttggatacggaaacttatggttgcacttaaaatgggacggagagagtatttaagagattaggagcgcacgatcggcccccacaggcttctatattgtgaaatgtaaattgttgtaagagtaaattgcattagcagtgttatgaaaatatatgcacaacggagacacgaatttttacgtggaaaacccttgcgggaaaaaaccatgggcgccgaccggcaatgatcactatagaggaattggatacaaacgcaggggatacattgggctatcgcaccctccccgtgcggcttacaagggatatatatagcagaaatctaggagtcctaataggaaactaatcctataaagtagagtcatattagataactaatccgaatatattgtgggcccgaaattcggatcacatatttaacaatctcctccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattgggaacaaatcctaaatttgctggtatgacattgtggaacccagcagagacgcgaaactgatgtacaaacttcaaactcgccatgggaataaaatcctaaatctgctggcattaatttctggaatccaaacagaaacgcgaaaaattcttgtgcacaaaaacaaagtacttagatcccctgataacctcctggtatgttgggtacaatggtagcagaattcgccggacaatttgatcaccttgtgatcttgacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttgtcaaaccctaacagaaatgcgaaacactctaggtgcataaaacgaagtatttgatctccgtaaaaaacctcctggtagacttggctttgtgaacatagcaatttggaacgtgaatttgtgttcccctgaacagaaccaaaacaatgcaaggcttaaatccctggtacgatggatatgtgcacgcaggaaaaatccaacgtgaaatttaattcacatgaacagggcaggaacggtggcttccgcttcctgactttcttttctcccgacgtgggcgtgcgctggtagattgatctcctgagtcccgacgtgtgtatgacgccggtagattggtaggtggacgccggctgctcggagtcgacagatgaccccgctttaaatcggcgagacgacgcgacgacacgcgcctgctgccgccgatcagatgagatcgatttcttcgatcgtggaatcacgccagtgaccaggacatcatatagatcgatctgatggatggccacgaacccaacaacgaagcgactatagatcgaatctccaatgctctgataccacttgttatgaaaatagatgcacaacggagatacgaatttttacgtggaaaatccttgcgggaaaaaaccacgggcgccgaccggcaatgatcactatagaggaattggatacaaacacaggggatacattggactgtcgcaccctccccgtgcggtttacaagggatatatatagcagaaatctaggagccctaataggaaactaatcctataaagtagtgtcctattagataactaatccgaatatattatgggcccaaaattcggatcacatatttaacaagcagtacatatatcaagtaggtataatttagtactcaaacttgtaaaacacttattttagtgtatgtacatgtttgatgtgtgcgaaccaagatgaaaaaacacaaaatggccaagcttaccaagttagaagttggttaggacacgatgtatacaggcatgagacatgctatatttgtaaacttgattttcgctttattattgtcagttctacctcttgcataatttctttttttttatttttctccgtgcactcttaggccttattaaacatttttctgaacaatgtatgtctatgcggctctctcctcacttacatgttaatgtaacatcctaatcaacacttaaattagcaggattagtcttgtttgtgtgttctttggccttggttcacatggacctggcaagttcatgtaccaaaatgagtgttttactagttcatgtactacattacatccatctaaagtttgtgtaccgctagtgtaatttactcttgatgcaaatcatgggtagggatgaaacgaagcggataatttccatctgctatgggggaaaagaatactgataccgttcagagtggataattatcggatagtccggatacagatatgaatacagatatattttcctggatatgaatacgaatatggtgtcgaggctttcgatggatacagatatccactgaaaccatgagacatactcatttctttataactctaggacctttaatctacctttttagattttaatagtagccaatctcataacattagtccacactattaatattatttaagcttttaaatatttttataaattataatatattcaatgtaaaatgagctaattatgtatgatggtattgtttctattagaagttgaggtagttttcgtgttccaagaaaaaagtgtttccgccaatcatattcaacccttattcatattcgagataagctgtatttgtttccgtatctgagctattcatattcattttcatatccggtgaaaagaatagtaaaatgaatatggtatgagcattatccgaccatatccactctgtttttattcctaatcatgagtatatatgacatgtctaattgagggtgtctaacgtaacttcccacctgacgtggttactaacatgtgagcctgagggtggtatgactcacatgaaagcaaccacatctctctgattttatgtgaaagaaaccaatccccgacaaggataaataggttgtgtcactactacatggaggcaaatagagatcagcactgtagatgccgaaagtggtatagccggcaactatagtgcttttcccgcccactcacccgcccacgcggctgccagcctaccaaatcacctttctccctaaataggtgccagtttttaaatataaccagcaactattagcctgtcagagaaaggtgtcgagtttatgcatatattataggtgccggttttataccgatgatcaaagtcatttgtgcccgcacctatctagtgttctgtagtagtgtgtgcacatgtgcagaggtcgaaaatgtaaactttttccttgccattatcttaaaattgcatgtctcatgtcatgtagatatgaaattctctatgggcgcatcgcatgcatgcaagctgtcttgcttcctcatcacaacatcttccctgaacgcccgccttctacgtccctccccctcttctcgctccctccattccgacgtctcattctctctccacatttccttttgatcccttctcttttctctctctctccggccggttgatcgaggtgagcgtttcctgacctacttgctcggattaattacaaattgatttgatcacgtagataattacatcatcatcatattgatggatggatgcttgcacatatatgcatgcgttttgaatctgg

SEQ ID NO: 32375 - DNA, 3273 bp, Oryza sativa
gcattatacttccttagtctgagagtatatagcattgggcataaagttagtattaactattcaccatgtaactagcttcttagtaaaggtacaaattaaggactgaagagaaactccagacttttaatcttcaaactgaaggcaagtaatacattttcagcccttccatttagttccttggaggatcaaattcaaatgttgcgacggatgaagacgcacgaaatttgatgcttttatcgcacgttcatgtagtatttggtcaatcgatctctgcatcatgccttgaccaagatgcatatttagtttgatgatctctgttgcttccaattgcactccattaattgtttgaactaatagtcgttttgcttcatgtaatcgaatgcttcctgcgttcgattggtgagagaagtgcactccaatgctgtaccaacagtactcttgggtttttctcttaggagagctttatttagagtgaaagggacttcctaattaagatttctttattttgaaagaagctagtaattaagatttcttaacatatgcacacgtgaagttataaaacatgactcaaatctgatgttgatgtgtgttcgaccaagtccctaatcagtttttgcactttttcttctgatttctcacgccaactgatcaattaaggcaagtaggattttagttgtgttcttttcttattgttttcctttctcttgcttttcgctttctcacctcctacctccttggagacagtccacaattgtgaattttcaacattagaaaaataatcacaattttgtggaaatgattgaaaaactaattaataggttgcatttcacatgaacatagttaattagagaacaaaatgcatacactaggtgttagagcagtacaaaagttatagaagatgtcactgcttactgcatgagtatctttcttcacaatcccattccatcataaatattgcctaaacaattccactcaaccttgttgcttgttcaactttaattctttcataacttgatatgaaggtcaggacaattactgtagactagtttcttcatggttgcacgctgaataatcgtacacagatgcccttgctgtctctgaattctcaaacactgaacatatattgtagaacattttacacctattcctgtctgatctcttgctgtgtgtgtacggagcatgctgccgttcttcccaagactttgtgtctcaattggttatttttgacttgaagcgatccgtttcggtagtccctgaggcagctagcgtaagcctcttttgacttccaagcacacaagttacttgctgcctcagattcatcagcaagtcactagtacttttcggtatctagatgaagcatatatataaaccacaagaaaagcggctgcccatttgtgttctgatcatgaggagattcaggtggtttcttgaaagtatgtattgccattgcttccttttgcccttttgatttttcattatatgatgtagagagaaaattatatatcttatcgcatcgatgctttatttttcgttgtgaaagggatgtgaatctgtggttgcaagatactgaagaaagtaataaggtggttcttcaatcttcataggcttcagagttcagagttgagttaatgtttttgcaaacaaggtgtctgctgacagtttgacagtaaaaagatctgtatatatgggttcctgcggtaacggtagaagctctgaatatgatgatcctgcatcattagagaagatggaggaactggttttacctctgaaattgatgcccttacacaccaatggccggttgtatgacatgaggttgtcctcacctactgctacctgtgtgatcaatagttcatctggttcattcgacccgatctaccgagcttggacggtgagtttactaccatactagttgctgaatttttgtggtagcagtgtttgatcttgtaagagtggcgcaattttgcatttgttgttgttgcagaagaagtatccttcagctctaaatgcctttgaccacattgttgcctatggcaaagggaagaagatagcgctgtttttggactacgacggtacactgtcgccaattgtcgatgaacctgacaatgctatcatgtctgaccaggtggttttcattgcaatatctagctctgttgagtctcctcttgtcaagttgtattgactaaaacttctgcacaatatcgtgtatacagatgcgcgaggtggtgaggaatgctgccttgcatctacccactgcgattatcagtggaaggtctcgtgataaggtgcatatgttatttaaaaggtttcgacgtaatcattgtgctgatataatagtaaattgatatgttatctgtcattctgatactaactgtacctttttgtatcaattttaggtgtttgattttgttaaactaacagaattgtactatgctggtagccatggaatggacatcatgggtccagttggggaacatgattcagttactaaccataggagctccattaactcaaatagaaagcaggtgtggagagctctttacagttcagccaagcataatatttgtttccaaattttagtgcaaaatatgatacagtatttgttttttgaattgaattgatcttttcaaacggtttttagggcaagggagtgaagatcttccaggctggtactgaattcttaccaatgatcaatgaggtagaaaaatgtcaggctttacaactccatattttagctcagtgttcatcttaatgtaatggaatgcaggtttttagattgctcatcgataagacaaaggcaatcgacggtgtgaaaattgagaacaacaagttctgtgtatcggtgcactaccgcaatgttgaggagaaggtgaagatttatcttctcaaaatcatttcatgggggagaaactattcataaattatattttcaggcatatgggcaattccttgcttctgattaatctgactttcagaattggcaacttgtttctcaatgcacaaatgatgtcctaaaagtctaccctcgcctccgattgactcatggacgaaaagtaattatctgaaaactgaaattggctcctgaagatgactgtcagctgtatctgatcattgaaatgcaggttttggaaattcgtccagtgatagactggaacaaggggaaggctgtggagttcttgctggactccctagatctagctagctgtaaaaatgttctccctatttacatcggggatgattgtaccgacgaggatgcttttaaggtgcggaattctg

SEQ ID NO: 32376 - DNA, 2279 bp, Oryza sativa
tgtgttccatgtaaggcactgtttgatgacagttctcataattgttttttatgttcattcatgatatatagagctatttcaattgcaggttatggaattcttgaaaagactagtgatgtggaagaacgaagaagcatcacataataagtagattataaatatatctgatgtttactctagggtagatttctgaattctgacaaagagaataagcagaagggcaacagaattaacttggacatagtggacagttgtacatcatatagttaatccattttcttagcctagcaagtggcaaaataaaagtaattgccatgttgtacaagaatgcgaagcattctgcacaagtccagttctttgaataatggtctcagttgtagaatggtgtaacttgttaatgaactgtgatataaatttttgggctaaatcattaatatggcatattgtttggtgtgcattatctttacagatcatacataccttgcaaatttacagcagaaagcaaaatgagtatcaatgtttccaactccaagtaaaaggcaatttgaggtaaacatgtatacaaatttttctttacatacgaaaattgaaaaaagaaatcgattccccaatggcagattttgaagagttccctcaaactgaatgctctaaatgtgtaagttccagaattgagtgctctcctttggcaccaagtttctcaccattacgcactcttattgatcaaggggtcaacaatgacttgaggtttaaaatctggcttcaagtactctgaaagcaaggaagcatacgtgtcataacgggcagtcatgcggaagccccacttgtctttgatctggcgacataagttgaggtccatatcagatatcatcaagccatctcggtagcgagatagtgatggggtgcaagaagcatcaggtgctgagaaatggctggatccatagaaatgaccaaagtcggcatgctgaggtttcccgtcaccagaagtgaatgggtttgggaagacctctgtgccaacccggttaattgacccgacaaagtagctatttgcaattgcagcatttctggcctgaaagagtacaacttaagcatcagtgctgttctaccgcaaataagatcaaaaaacgaataaaattattcaaacttctgaaaatttcagaacgcaacaactggaagtaagtgctataaaacagaatggaatgtaagaatatatctgacctcaatgggccacattggttcactgagttcaccaacagttgcggatgggttgaatactatttcagctccattgaggccaaaagcaagccaattaaggggatgatgccttccataacaaatgtttactccgattttcccatatgctgtttcaaacactggatgcccagtgttaccctccatatagtatgtgctctcattgaaatcaccgactcttgggatgtgattctaaagtagcattttgttagaccggaaatgcttagagatatccagaggaaataaatatgtactgattgcacatacctttcgatgtataccaattatgttcccatgattacctatgacaacagctgtattccatacaatctctccgtggtttacatctctttcgaggattgggctcacaattaccatgttatatttcttagcaagttgttgaagaaattgagtagattctccatcaacaggctcagcaaactcacaccaccttttctcacgtgtgcagaaggcaaaaggcattgtccaagcttcctgaattttgggtatcaaccattagaatgatatgcacctttggaaatttaagccaatgtgtctagaacataacattgccagaaaattgagaaggaatattctgagcaacaaggatcagaaatgaattaatcaaatattcactattaacatggagaataagtattctgagaaacacattaggttggaaatgaagatatacatactaacaagttgcatgggaactctagagtaattcatcaaatgccaaaaggaagttgtacaaaccgataattgactcacctgtaaacacaaaatattaacaccagcatcaccagctgcatcaatcataggcttgactttctccatgatagccttcttctgatctgcaaaatgactggtggtaggaatagcaattgagttctgaatcaggccaactcgaataacccgtggttgcctgagatactctttatctgcatcaaaacggaaggcctgcagcacaaaagagcactacttaaaaattgagacaacaagagtgcagggaattatcagtttaattt

SEQ ID NO: 32377 - DNA, 1879 bp, Oryza sativa
cgtaagagcgagcacgtcccttttcctctctctcaacatcaatgactatcatggaggtaagggcaggaaggaataggcagggagaagagaatttagcggttgagcacactatggccagatctagcaagccaagctcaccagaagatgagcgaaacatgaggaggcatgacgcctccttgagtatttcaccatgtagggttccaccactgcctcctcttgggatcatcaagggagaaagagagagagagagagagaggggagcacatctacaagtggtggggggttcctagggagtgccatgacgacggtttctcacaatgagcacggagaaatcggcggctctcatggagcataggcggtgttggcatgtgacgagcacgtggcaagggaggtctagcaactgtgcaggtccatgtcttatgagagtgagagtgagagagagatagagagagagatgggagaatggggggaagacaataactaggtgctgacatacggagccaacatgatatttaaaaaatgatagttttgttaactgggttgccacatagtcaaattagtgccacgtgtatatcacatagtacaaaacaacccttgattatgttggggtggggttgggggtaattcatatggtttcaaaagtttaaggtcttaaatatcttcttccgtagttgagggtaaattgtattataaaactattttctgcatgatgaatggccgattagtttccaccaatgttcacttatacacggtagtttttaatgttcccttccatcctataatatagctaccttagcagttcaaaatataattattctttttctttgaaggaaaaaaaatataacaagatttaagaccttgtatatattcctctttattgtataccagcagaaattcattgcattgagtttttccatggagtgaatagagaaataggaaaaaaaaactctttcgaatgaaaatggaaaaacaaatgcgtcatatatcccacttggacaaagcaaattagaagaatttttctcttattctcatttgttccttcctttagaactacaaaaatatctatatattttagggcgaagggagtagacaagttgtgacgaaccaaaaattttatctagccgagacaaatatacttcctatcaaattacttattattacaacttgtcctaagtcaagaccatcagttctagaaactcgtataatttaacaaaatgcaaattattttaaaaatatttctcattgcgaatcattggtttatgtgttgatataaatatttgcctcaagagaaaactaaaacggcaatatgaaacagggagcataaatgcacacctatattctagtctcacaatcctagtttcccaccgaaatattctaaaattgaaacttaggcaagaaaaaggttaattggatccatgccattacaattgtgtcgaattagagaagtgccattataaatcgcctatttcgaagcatgccatccgtattgatgttaattttggtccatcccataatttggtcgtctcccgtgtttgtacacgtagtatcggatacatatttgtgtatggacggaaatgcccctttcagacgcgctctaaaactgacctggttcagctcaaccgtatgcttgctccatccattccctactccattccttcctattcgagctccagatctagccggcggtggaggcgaggattcgagcgagagagatgcgccgctagcaggtgatggtgctggaaatgtgatggcgacaacccccctccccgcggacccctgggcgagacggcgaggagatggatctaggcgaatccaatccgaccatctgttcaaggccatgagatccctaaccctaaatcaattgaaacctgtaatgtta

SEQ ID NO: 32378 - DNA, 4470 bp, Oryza sativa
  unsure (1)..(4470): unsure at all n locations
acaatagnagctgttggtaggaaaacttacacaaaaggtcaactcggtaatgggttgtggaatcagatagctttaacgttgagtttgtgttgagtagccttgttgagttaacttggggcccaaaccaatctcctaccatatggtatttttgtaagtcaattagtgaggacgtgagactattggagaatggccagattccagagttgtttgaaatatatgcagaagagagccactttgagcttattgtatccatcctggatgctgcaaagggtgtgccatttgctataaatgctttaaatcctatatgtgtggcgcctcctgaattccctgctgaaatccatcctgaaatccctcctgacatccctcatgaaatccttgctgacatccccgctagtattgttggaggttttgaccagcttacaacagaggaagcagaagttagagaggcagatatctttgacaatgaggagtatgttggtgttgatgatgagtgcctatatgttcctgcatctaaatagcaaggtcaacctggatctgaacctcagggggctgcagccactggtcagagtggagagattggttctagtgctagtgctgtggcaggctggcagctcctgaggcacagattacagatgattatcctcagatttataacatcattcatgaccttgagaatccaaacattgtgaaagatgctttgttcccccatgataactctcagaaaagttgtaaggcattatgccatcttgaaaggttttgaatttgctaaaggtatgaagacagatcctacaaggtttattgcaaaaggtgcagctgatggttgcccttggtgtataaatgcatctctgattgaggataagaagactgtaaaggtaaactcttcccaaatttcttttgttttgttgttcaaatgatgtttacttatgtgttgcattactcatgcagattatggtccttccatttgagcacacttgttcttctacaaagctacataaagggaagatggctactcaaggctggtgtgcagatagactctctgattggattaagaagaatcctagcaagggaccaactgatgccaggaagaagcttgaagaaagatatgagatcaagttgaaatactccaaagcatggtctggtatgaagaaggctatggagcagatccatggtacatatgaagaaagcttccagcttcttttcaactggaaggttgcactgcagaacaagtcaccaggtacaattgtagagatagagttgcagaaagtaggcaagaagatgtgctttaagagaatttttgttgcattgaaaccttgcatagatggatttttggctggatgtagaccttacttaggtgtagatgcaactaggttaactggtaaatatactggacagctagcttcagccactgctatagatggacataactggttgtattatgtagcatatgttgtgtttgactcgacaatagatgataaccgactctggttcatgcaacaactaaataaggccataggagacccagatggtttagttatttctacatatgcatgtaaaggtttagagaatgcatgaggcatctctattctaatttcatgaagaagtaccaagggctaatcttcactaatcatctgtacctagctgctagatgctataccgaggataggtttcagtggcacttgaagcatatatgggatgtcaggcctgatgcaatagagtacctagagaagcaccactcaaggatttggtatagatgtggattttcagaacttagcaagtgtgattacctgacaaataatgtttcagagagtttcaacaaccagatcaagggcctaaacggtttgctcatacatgagttggttgattccattagagaaatagtcatggtgaaatttgcacttagaagagattgtgctagcaagatggatgatggaatcctaccaggtgtcatgaaggagctgaacattgcaactagtaatctgaaggttgttaaggtggctagaagtgaccatggatttgctgaagtcacaatggttgagagtgataatagcacctagagggacactgtggacttggacaaccgaaattgttcttgtagggtatggcaggtgacaggaaagccttgcaagcatgcagtggcttggatatgcaccaacaggggaaagattcaggactttgtgcatccatattacagtgtctaatactttagagcagcttatgcagggaggattcaacccatgactgataggttacaatggccttcagttgatcttgggttcaaagtgcatcctccaagactgagaagaggagctggcaggcctagagtgcgaaggataaggggttgtcttgagcctgggagaaagaaggtgaaatacaagagatgcaaacagtttgggcactttgagaaaacttgcaaattggctgagccactagatgaagatgacatggctgccgaagaaacacccaggaaaaggtatgtactgaacccttccattttgatccatgacttcttactgttgttgaattatgtgtcttcttttcacttgcaggaggaggccagcaaatgtggatgttgaagctagctcatctgcaccaaacaaaaagaaaaaaaaactccaaagaagaaaagaacaccacagaagatgagagatcttgcttcttccagtgctccaccaacaactactcctagaaggctatcagattggtttggtgtgtctcaaccatccaacccagcttgatgttgagctagctgattactgggttctcttttgtaatatatgatggcccaagaactgcttattttgtgatgtaatgcatgtgtaagctagctgattagtgggttcccttttgtaattattatgtgatgtaatgcctaagacacacctatgttgtgatggctggcagacctgcttattttgtgatgtagcagtgaagtaatggcactaagaccttcttattatgtattctaaagttggctgtgctatgcaaactatcatatgtggcatagatgaatgaaattgctccatacatgtgacattctcacatttgtgttggtttgcttgaaatacctgcttgaaataccaaaaatttatgtggcacttgacatttgctccatatatgtgatatttatatgaccttatatgaatgaacttgctccatatattgtaacatcctcagatttgtgttggtctgctgaaaataccagcaaatttgttggtctgctgcaaattgtaatgttgctaacattctcacattgccaaattttgacagttttagtgcaactaacatttagtgtagctgaaatttacaaatgaaaatcaagtttgctcacatatgttgctgaaatttgtcacataagtcacatttcctcagctttgctcacatttggtaaatctgcaactagaaatgcacagcccaattacagatttcacaattgctcacatttaactaaaaatgaaactaggattaattccacaagtcatttacagattgcatattacatattgcacactcacagcaattactaactacctaaggtagttcttccctacaactactggcacacaaagaacacacatcaacattagcatgtgcataacccattggagcatgtccttctctgattctattttgtccttcatctctgcaagctccctcttagactgattcagctcatctctacacagctgcaattgctcctctttttcttctaagatactagacaactcgatgttgtgaccctgcgcatctaccaattgccaccgcaactggttgcgtctcccgtaggctattatactcgccggcatggtagtatgccatcatatcctcgacatactcctgaggagacctcccatatccataaatagcatcgtacaccttgcatgaaaaggaaggaaagggaattgggaaagaaatcgaggagatgcaactcaaaatttctcgtggccaaagattcacctctcccccacattgcagccatcgccgggcaggatttctgatagtggacgacgtgcgtggagctgccggccacccacaagcacacttgagctcggggatgccgcacgcttctacctgggaccgctcctcgctacacctgctcaaccaagaaagggttctcgattcgtccatcgcagccgctcccgcggtcccctagagatgcggagggacttgctgccacccgccagctagggtttctaccgccgtcgatagccgccacataatggtttggggacagggaaggagcggtttctcgtggtcgagacgaaccaactcgccgatgtatccatgtatgcaggggcattagcgaccatatgaaactacacactggtcaaattaagtcaacgcgagcctacgtcgtacggcatggcatggaaactattctgcccatattcagatggcacgctttgaaatactacctccgtttcataatgtaagactttctaacattgcccacattcatatagatgctaatga

SEQ ID NO: 32379 - DNA, 7014 bp, Oryza sativa
  unsure (1)..(7014): unsure at all n locations
atatatgtgtgcctagnatcattagcatatatatgaatatgggcaatgctagaaagtcttacattatgaaacggagagagtagatgatttgtaatggcatttctctaattcgacataactgtaatggtatattgccgccgccggcaggcaactctgtccctacaacatcggatcggaagcgtaatcagtgggcgactcaaaatttgaacgccatcgctgagaaccgtcggatggacttaatttcacgagcaaaacattacggtcgctcgagggctgacctgcggggcccaaggttttgtaggcagaagtcaatcgcgattcaagcgatcaatcttctccctaaaccactgcaactttcttcgctcaaccctaactcgacgaaaccttcagccgccgtgtgccatcctacgtacgccgagatgaccggccgcccagcggcgccaccccggggcctgattgctccaccatcgcacccgcacggcgcgctgccgcggaacaaacaaggatcgggagcagttcaggctgctgctgctgcgcaagacacaggacagcaaagaaggaactatgaccaagataatcggggcgcacaggatgctggacgtggatatacgcacgcggcaggcaaccatcgtcaccaggatcagccgggcgaggcttcaaccggcaatacagaggaccgcaacactgtcctgtcaatcaccggccagctgacactcatgctagtcgccgtcctgatcagagccgcagagaagaggagcgccaagaggttcctgctcgctaggaataggtaactgaggtgccggctaaacacaaagcaatggcaacaactgaggtaccagcggcaaaggcaaagaaaccacgaccacctttttgctacagatgcaagtgcaatggacatttgcctgctgtgtgcaaggcagatttgaattgcattatatgtaacaagaaggattcacatttgtctatcaagtgcccaatcctgaagatgccgaaaccaaatgcgtcgctgcttgggtttggcaagaatgagcttggttttcttcaagtgccagactttgattacaagctcgagactacagttccggcacctacagctttagtcacgatcacgggtggacacctaggagcggatggggtacagacagagcttgccaggcttattcgagcagattggaactgggaggctttgccacacggtaaagattctttcctagttacattcccatcggaggaggaactgaaaagaatggctgatgtcgagtttcgcctaaagaatcatggggttgctctgacgatctccgagtggcaggaagcaggtgatgttattccctcatatgaattggatatggcatgggtgcatgtcaccggtgttcctcatgcttggcggcattatctcggtttttgggcacttggtagtgtaattggggctacagaagaagtagacatgctaaccttccggaagttgggagtgatccgaatcaaagtgggcattatggatagggaacatttccctttcactactgatgttgtgtttgggaagcatgggtatgagctgatttacactattgagcctgaagattttcaacctgccattcccaccccatccaatgatactatggatcatgattctgcgggtactgataatggtagcaacatggatggaggtagtgctgatcatgcagcaaaaaagaagaaggcgaatacatcgacaccggagagttcgaatgctgcagtttcaggtccaactcctatgcagttagcagtgactccttttggggatcgtcgccctgtgccacagagacagcaaattatcctgggcactagagtgaacaagcagcacattgcggtcactccgttaagggtgaccggatcgacatcatacggtcggagagaagtttctctctcgacctcaacagctgcgccagccgcaccgacattgattgtgcttctaccgaagtcttcatcatcgatggatactccacccgggctgacaatggcggtgtctccacctacgcctgcacctttggggtggtcgctcacgtcgaccccacccccatccgctcctgtgcagaccctgccggcatccactccacccatgtagacccgttggcatcgtcgaggcaatcaacatcagcgccgacaaaatctccactagtgccgaccctgccgatgcctacttcactcgtgcaaacaccaccagtgcctactacaacaactcaaactgctgcctatacacatgagggtcatgtcactcagcccggatcgagctccatcaagcactcgaccttcgggcatgtgaggtccccatgcactcctttacaggaggaaaagaccgaagggcttcgccatagtgatcgctgcaatgcagccatatcatctaatggcattgcagcggccgatgaggattcaacgacgaaggctaaacgcagggcagcgatgagaaatctggatgggccaatgatgtccaagatggctgacttagcgaagtcatcactttcgtctacatcataccttgacccttctataggtatgcattctaacctcccatcttcttccattgtttatttatccaatgaacaattttcctccaatttgggaaagataggagtttctttgggtagtggaagtgaaaacgtggccttttctgttaatgctattaaacatatgaaggttgacagatggaaagtagcacctaaaactaagatgaaagctaaggttattgatgaagcgaatgatcaaaatccttttgatgatggtgatgatgaggatgccaaacctgatggcatcttactcgctcacttattcaaggaagtttctgaagtagacttggatgatgcggagcttagcacaacaatttgtgacttaatagatacccctcgaaaatccaaatctgcttcaaaaaagaaaggtcaatcgaccaggaccaaaagtaacaagaacaaaaaaggttgtaaatgaaaggcatcttctggaatagcagaggtctacttgacttggctaaatattggtatgttgctgagaacattaaggaacacaatcttgattttgttgctttattggagacaaggaagaatgatgtgtcaaagacgaatcttgatcgcctagctgggggcgcagatttcatttggcactgtcttccccctcgtggcagatcaggaggtatattactcggtattaatgcagctgtaatggacttgtccttgattgtggaagggaaattttacgttaaattccatttacgcaacaaagaggacagattcgaatggatcttgatggcggtctatggaccagcacaggatgaattcaaatctagcttcttagctgagctagtccgcgcttgccaacaaaatccacatcccacgctcattggtggtgatttcaacattttgaggagtagtacagagaaaaacaacaatagatataatgaccgctggccttttctcttcaatgctgtaattgacagttttgacttgagagaaattgctttagcaggtagacaattcacatgggcaaattccttagccaacccaacttatgagaagttggatcgagtcttaatgaccacggagtgggaatccaaatttccgatagtttcggtacatgctcttgagcgaggggtttcagatcatactcctcttttgcttgatactggttctgcggctttcatcgggaaccataaacagttcaaactagaactaagctggttgactcgtgatgatttccacgaccgtgttgtcgaaatttggaacaagccggtcaaagggcgcaactcggtccaacgatggaacaataaaatgagtgctttgcgtaagcatctacgaggttgggcggcccatatgagtggtatgtataagcaagagaaaaaaagtttgcaatcgaccatagatgaattggacatcgctgcagaggttcgagtcctgactgaagttgaaagagatcaacttactcaagcaagagatcgactagttatgcttctaagagaagaagagacaaagtgatttcaaagggccaaaacttctgatgttcgtctaggagataataataccaaatacttccaaatggttgccaatggcaaacacaggaagaaacggatattctacctagaacaggacgaagggaaaatagaggggcaagcagctctcaaggcctacattactagtttctataagaaactatttgggccacctgaagataacccttttacgctagatgaatctaggactggggatatatcacaggtcacagaggctgaaaatgaattcctaacggcaccatttttggaaaaagaaatacgagatgctgtatttgacatggagcataacaaagcaccgggcccagatgggtttccagcagaattctatcagaaattctgggaagtcattaaacatgatttgatgaatttattccatgaattacatactggtgaattgccattgatcagtttgaactttggggtgataactttgctcccgaaagtcaaagaagcgaatcgcatacaacaatatagacctatttgtctgcttaatgtcagctttaaactattcactaaggtcgccacaaataggattaactcggtggcggaccatgtagtgagtccgacccaaacagctttcatgcgaggacgaaacatcttggagggtgtcgtcattttacatgaaattttacatgaactacatcggaagaaactaaatggagtgatcttcaaaattgattttgagaaagcttatgataaggtcaaatggccatttttgatgcaagcacttcgtatgaaaggattctcaaccaagtggatttcttggatcgagtctttcgtttcgggtggaagtgtatcaataaaagtaaatgatgacgtcggaccttttttccaaacgaaaaagggccttcgacaaggtgatcctctttcgccgatgctttttaatattgtagctgacatgttggttattctaatcaatcgagccaaagtagatggacagatttgtggagtagtccctcatctagtggatgatggcatttctattctacagtacgctgatgataccattctttttatggatcatgaccttgagaaggctcgtaacatgaagcttctgctttgtgcttttgagcagctctcaggtctcaagattaactttcataagagtgaattattctgttttggtgatgctcgagccatggaagaccaatatactgatctctttggttgtgcttctggcgaattcccattatgctacttaggcattcttatccattataggaaactaagaaatgcagattggaaaggggtagaagaacgctttgagaagagactcagtagctggaaagggaaactactttccacaggaggaagtttaacattgataaactcagtgcttagtagtcttccactgtatatgatgtctttcttcgcaataccgagaggtgtacttaagaaacttgattattttcgctcgagattttattggcagtgtgatgatcaaaagaaaaggtatcgtttgacgaagtggagtattatgtgccgacccaaagaacaagggggtttaggaattcatgatttagatatgaaaaacattgcccttcttagcaagtggttatttaagctactcacgaccgatggggtctggcaacaattgattcgtaacaagtacttgggctcaaaacctgtgtcacaagttgagtttaaagttggggactcacaattctaggccagccttatgaaggtcaagcgtgactttttacgatttggcaaattcattatgagagatggtgcccaaatcaagttttgggaagacaagtggttgggagaagcaccattgcgagaacaatatccttgtctatacaatatagttaggaataaacatgatactgtagcaaaagtgctacaaaattaccctccgaatgtatcttggcgaagggatctcattgggccaaaattagtggtgtggaataaccttcttccacgaatcgctaacctagttcttactcaggatcaagataagtttcattggaatttaacccaaaatggagaattttcagtgaagtcgcattatcttgccttggtacattcagatttgcccaacataaacaaagtaatttggaaattaaaaataccgcttaaagtaaatatcttcctatggtatttacgtcgtggggtagttttgacaagggataacctagctaagcgcaattggcaaggaagtaagaattgttgcttttgtcacaaagatgagacaatattacatttgttttatgagtgcagatttgcccattttgtgtggtgcattatacaagtggctacatggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgtcagcccttggagcaggtggtcagggaatgttttacccagggacatgggtggcggtctagcttgaagattggtgctccctgatttttactgctttccttctattgttacaaactcttttgtgggtttgtgtgttttggctgtgtgcatcctagttatgcagaggccgggagttttcttagtatggttctatcaacaatgtaatcgtctgagattaataaaagcttcctttatcaaaaaaaaatatatccaattaacaaaaaaaaaaaggacatgtattagcagcatgacaatctacgtaatcagagcaggaaagcgtaattctatcgaccacaaaacggacggctcaaaggggaaggaaagcagataggcccgcgatagcttaaacccccctcctcctcctccgccgccgccgccgcccgcgctcgccgccgatggcggccgccgcggcgacccgcctctnccg

SEQ ID NO: 32380 - DNA, 3450 bp, Oryza sativa
gcaggcctcggcgccgcccccgccaccggccgccacggcggcggcggcggcggcctcgggggaggccgtgggggagttcaggagacggacgcgggtggcggatgtcaagggaggggaggacgagggcgccgcgtgggttggaaagcagctcgccgtgcgcgggtgggtgcgcacctgccgcgcccagaggaccgtcaccttcgtcgaggtgaggggaagctttgcgtttgcgctctcgcatccctttctgtttgaagcgtgaattcgtgatggtggcgctaatggttagcggtcttgtgtttgatgaaatgaacggtgcgaatgattagtttgcgcacattgcataaaattgcattgtggactaggaattgggagtgctggaaaagatgctttccttcagtgcactattcacattgcttccccaatgtcgttgatcattttacatttcatgaaacatttcgatccatggttatgcgattgtactaaactagctttcattgtactacttttgtacaaattacgataacaagactgaacttctggatagatattacagaaatcatttttgtgactgtttgataagtcgtccttcttttgatgagaattgcagcctgtttgacttgcataccagcagttctgtggagtgtgccattagttgtttggttgatgcctaaccttgccataactaagtttaggctagttgtggcatggtggcacaaatgtggcttagaaatagttggccacaaatgtggcatgcttagctctaaatttgagagcatgacatgtgggtcccaaagtttaaaaagtgtggcataacacaattgcggtagcgaaccaaacacatgcctagaaaattgtggcgtggcaaagtgtggcaaccaaccaaacagcatgttacttgcctacttttctctaaggcctacttttgtgttattaactgctttgaagttagaaatcaggacaatttctctaaggcctacttttgtgttagtaatcagacttcagacagtctttcatggaccagcaatactaatctagtaatctgcatgccatgagtgcacagtataatgaatcagagtatctcatattctgaatgcataggatgttaatactgtcatctggagactttaaagttccctgaaataatggtaatgactattggcttttactttaaatctctaacgcgtcctaaaatttaaatttatttcaggttaatgatggttcttgcttgtccaacatgcaatgtgtattgactcctgatacagaaggctacgaccaggtaagcaatcattcagggaatcagggtacaactagatagtagaaacaatacatgttaattttgttttgttattctggtcaataaaaatagtttgatcaatccaatggttatcttgtgaacacagaaaataaaactctgataattgtgacatggcaccaacaatgacaccagcgttgtctagttatgtctcaattccttttattttccttgctatagttgcagccaatgtgttcttgtggctatagtacattttactggtcaatattttcattggtggatgtcagatagactctatcactactggggcctctgtgttagtggaaggagttatagcaagcagccaaggtggtaaacaaaaagtggagttgaaggttcaaagatcagtgtggtaatggtttcattctgcctatagtttcctccttttcctttttatttccttttttctttgcgtgcctcacaaatctaaatgaaatgtggacagattctggagtaactagctatttccagatatcaaaataaaatttctataatttattgatataggaaaatacttgtggagtagttaaggtatctctttttgtatgctactatgctagtcttgtactcttgttaaagacagatatgagcgttaaccgaacactcctatatcgaataagttatttgatgatccctaacgtggtaacacacaatgcacaaaaaaattcgcccctatgctttctttttatataaagaaatttctgatggcatgacaaaaggatagacctatagactgttaatgttgattgagaatctgcagttgcattttgctttatcaggctgtagacaatattatcccaggtaagcacgcttctagtgcatttttttggtgtgttctgatgtaggtttcacttctttgtacagattggagaaagtgatccaacatcttttcctatacaaaagaagcgggcatcaagagaatttctgagaactgtagcccatctccgtcctcggacaaatacttttggcgcagtatgattttactcattgctagttcttttctgatactttttttttgctcagaagctactaaatctgtagacttgtgttatgccttggaaatgatcatgccctttctgtccacaacttttctacaaaatgctcatcattatccttttctagatgcgttgttaattccctaatttagctcataaattagcatacaagttgtgacaaggtttgctatgcaaatattacaaaataagtggcatgtttatagatgacattctgtccaatccaaccttggatatggatctgccaatgtggtgatgaaatacatacattatgtagaattgcaatggactatgatcaatgcagccatggacaggaaatgtgtgtgattctcatattggcaagaatccaacaaactgctgatatagcatcatattctgcacatcaaaatagtgcaaacgttggtagttttatgtgttgtagtaagatgaacttttgcgttagaaagtgcctttttcttatgatgaagaagctggctggtgtccaacatttttcatctctctagttatgtaacttattctatggaatttttactgtactgttgtacttatttaggtggcaagagtgagaaatgctttggcatacgcaacccacaaattttttcaagacaacggatttgtttgggtagcaagccctattatcacagcatcagactgtgaaggagcaggggagcagttttatgtgacaacattggttagtatttcgtcaataagattctatagagtagtgtatagacagattgcttggtatgtaacaaatttactgtttctgggggaatgttctgctcataatgtcatttcctgtactaacatgctgttcatattgcaacacacattttggtcttctctatttttacctcaaaaccattagtgtactttttgctccagttcagaaattaagtgctctttttctttttttcctcacaaaaaaaaaagaaattaagtgctccgcatcatcctgtactaatatgcttgtccaaatcagaaactacttgaagttttcttttagttttgtacttctgtgtctgtttagaacagcttcactatgttattaggtgcactgctaaatcagtttgaattttccatctacagatttacttatttaaaaatcattaaagttctgct

SEQ ID NO: 32381 - DNA, 4906 bp, Oryza sativa
ctaattgccataacccctttcattatgtttctatttaatgctgttagatttttttccctgtcatacagatttcgaatagtgctgaaggtggttctctagtcaaggatattccttctactaaggatggaagggttgattggtcacaggtaaaacttcagaatgaatgcttatgcaaccttttgttgttaaaagtcaaatgtttcttccccattttaagcaaatttacccgtataatttttgtgatatgctctgttatactgcatgccaacagctgttcaagtaatccaaatgtttcaatgtctttgtggttttcgtaacaatggttatttgcttgtatctatgctaggatttcttctgcaaaccagcatttctgacagtgtctgggcaactgaatggtgaaacatacgctacagctctatcagatgtaaattttcatttgccagattcatttgaaataattttctgtcgtatttgatatagctgtaaccagtgtttctgtttcctgacattgcttattctacaggtttacacttttggtccaacatttagagctgaaaattcaaacacctcaagacatttggctgaattttgggtatcgcaatattcttttacatttatgtttctttcagaattttaaattccagaactcttaatttacaggttttttttttgttggtttgtgttccggggaagatgattgagcctgaacttgcctttgcggatctaaatgatgacatggcatgtgcgagttcatatctccagtatgtagtaggtgcccttttttgcttggtgctcaactctgttagtgattatttcattcagacaatattttatggatgcttcacagttactgacttgctgaattgtggggaagatgtctctatatgcttacaccatttacctagttactgcttgtttgatacaggtgaagtatgttctagagaactgcaaagaagatatggatttctttaatacatggattgaaaaagggatcatcgatagattaaatgtattcctctcagatctttcttctgttgctgcactatggattgttttggtcaagtttcatgctgaaatattgaaaatgtttcttcttgcaggacgtagttgagaaaaactttgttcacttgtcatattctgatgctattgagctacttgttgggtccaagaagaaatttgagttcccggtaacacacaaattcaattatttatattctcatattctcatttggactacattacaattttgttccttgtgttctatttaaagtcctaaccaggaaacgaaaattgactgcatatctgtctttggtgttggatggcatgtcaacatgcttgttgatagaacaaatgcttatactttttgtagttactgataatttgatttgtttaattttaattagtgtgcacaaaattacctgtttgttttctacttctacatactcagttctgtgtactgtggatccttcaacaactgtccctgagtaggcaaatgggtaaatgcaagaatgcgagtgattattttacaaaaataatgcctctttcttttgtcttttgaaccatccataggtcaaatggggattggatctgcaaagtgagcatgaaagatatatcacagaagttgcttttggtgggcgcccggtgataattagagattatccaaaggtttatatcgtcactggtctgtgattaactagttcattaacaaagttgtcatacttcaaaatttccttttattttgcttaggaaatcaaagctttctatatgcgagagaatgatgatggtaaaacagttgctgcaatggatctattggttcctcgggtaagcatatacaccaatagctgacatctcaaacaatacatcatatgtaaaattccgagtatataaatagacaaaatggaggcaaagcttctagcatatttgaattagttgatttgtaatataactcttttcctgttcaatttcaggttggtgaactcattggtggaagccaaagggaagaacgtcttgattaccttgaagctcgcttggatgagttaaatcttaacaaagatagctactggtggtacttagatctacgtcgatatggatcaggttaaatttcaaatatcaaaatgagctggataatgcaatttctccttttacattacagatcatttaaaatttgttattcggtagcatgatttcccccctgtcatgatccataacgaatttccaccttttctgtaacagttcctcatgctggttttggtcttggatttgaaagactagtacagtttgcaactggaatggacaacattagagacaccattccatttccccgggttccaggctctgcagagttttagaatccaacattgctcacaaatactttttgcaacattctttcctgagattgggatttcaagaaaagtatacactctactgtttcattgtacagagtttagttaagttattgcttacatcgagcaaaacaatattgttccaaattttgttgtttggagtaacgtgcttgcaaatttcattgaacttccgatgtacattattgttactggacgtgttataatgatcacctgatggattgatatagtgcatttgatctgttttaccgcatagcaagaattttgtctataccggtcctgtcagaattttatctcaaggtacgatgatttgtttcacaagtaaattttgctgagaggagttatgatagtacttaaatttaccacatagcaaggaatgttgtggtctagtcttgcccttctggtgacaatgttttgattagcaagctcatttaaatggattttttttggttacccatagcgccctaaatattctttttcaataaaatacctttcagacgctatacaggaatcaaaggaagaaagctatacaatttacacgctaatcttgaaataacagcggtttctctatatcgttggctgttccgtcctcaaccattctgtcaacctggcattctttcttcttagcccacagaacgacataaaggccggagaacaggaaaaccattcccagcatgctgcatgcatccatacataaccaagagcaaatcagtttgcttttggaaaatctagcacgaactaaattgcagtcatgcatatctaagtttctaaacacaagcggtacacattgaacttatgttagcacaattattgttgtttcaagaggtcctacatgtcatgtttcgcttaacatagattagacccaatgaatccattagatttttaggtatatactacttttgttttttcaaatagataacactgttgactttttatcacacatttgaccattcagtttatctaaaaaatttacgtaattatatattttttttgttgtgagttgttttatcacttaaagtactttaagcataatttatattttatacatttgtataaaatttttgaataagatgaatggtcgaccatgtattcaaaagttaacagcatcatctatttaaaaaatggagagagtgagtatatgggcctgtttggcacagctccaactccagagctggagctcaaccaaacagtttcagctccaccaaaattgggagtggagttgggtggagttctctcacaaaatgtactagagttgtggagctgggttttggcagctccacaactccactccaaactcaactcctggagttatatttaggagttggagctgtaccaaacatgccctatatatgcacatagtgagagaagaactatacctcactgggtggaccaccctacccaagaacaaggccgagaagatcgccgatccgacggtctgcgtcgggctaaagagggagaccaccacgggccctttcttctccagcgcccatgtctggaacatcacgcacaccgagcttactagcccgccctgcatacatacgcctccatgatccatccatcaatagtcacccgtagcatccttattccttacactaataaaacaaacattaacatgcatgactcatcattgccagttcacctcataatgttttttttctcctttttctaaagtctaaaccggtatgtatcaacagtgatacgatcaatcactactgattgctcgctaccggataataaggaacgatagtgatgctggttatggaattgagatttgcttgatagtgcaatagtaaaggtgtgtgtggtagtgttcaaccctaagatcccccattcaatctccaatacactcataatttcttcttaaaaaatatttggaaaacgtctctcctttcaaagctcgtttttttttaattatgctgattgcgaggtggtggtggccggttcaccgctagcctaggcaagcgctagtgttgatcaatttgcatattcatcattcatggtttaatttgatgtgttaactagtatactccttccgtactcgtaaaggaagtcgtttaggacagcgacacggtctctaaaacacaactttgacttcttttttctataagaatatttattgaaaaattgatatatgtatacttttataaatgtatttttcaagacaaatctattcatataatttttatatttttaaactcaacaacttgagagttattcatgatttatatttcaaggtttgacttaaacattatcctaaacaacttcctttataagtatggagggaatatatactacttcactatatataatactccctccgtctctaaatatttgacgccgttgacttttttaaacatgtttgactgttcgtcttattcaaaaactcttgtgaaatacgtaaaactatatataaacataaaagtatatttaacaataaatcaaacgataggaaaagaattaataattacttaaactttttgaataaggtgaacggtcaaacatggtgaaaaaaggcaacggcgttaaacatttagggacggcggaag

SEQ ID NO: 32382 - DNA, 14016 bp, Oryza sativa
tgaacggcgccgggaagtgcaccatggtggccgcctgcagcacggtggtgccggacaccaccagcaccgcgcccaggaggcacgcgcacccgacggcccagtcccccccgccggcgttcgccgccgccgccgtcgtcgtcctgtggctgctgctacgcgtggcggcggcggcggcggggctctgcaggacgctcatggtgacggcgccggcgaggcacagcaccgtcccggcgatcttggccctcgtgtaccggcagctgaggtcgaccctctcgaagccgaggcacgcggcgacgacgaagatgaagaccggggcgaggttgggcatggtggaggcgatggccggcgacgtcttcttcatgccgtgcagcatcagcgcctggaacaccgtcaccctgcagccaacgacaaggatcgatataaatctgtcatcagacatgttttgcacaaaatgtgataataatcgtttgacgggaaaactattttaatctctcaaggggatatccctttatttttttcacgtcacttaaatggttgtgataaaaaaaggtgtattaatacgcgatataatactccacaaacatacaagttcaaattcaatttatacatctcgtaatgaaaaaaaacaaattaaaccacaactagttaacgtatatttagagtcaaatttgtttttttcgttgcgagacgtagaagtttaaatttttttcttgtatatttatgaagcgatatatcacatgttaatacattttcttagtttttgtcataatatttaagtgacatgtaaacgatgtaaacaatgagaggatatattaaaatccacttcccgattgacatgttatacatgcataccctccgagggcgagcaagaagaggcggagaagaaggtggttggcgttgaggtgcgacggccatctcttcctctcgaggttgatggcgaaagggagggtgaagaggcccgtggcgaggctgccgaaggtgacgaggaagagcgggtcgaggccgagcgccagcaccggcgcgagcaccaccatgtacgccgcgcccgcgagctgcaccgccaccagccccgcggagatcgccacgtcctcccactcccagctgcaccaccccgccgccggcggcagcacgggcagcagcagcggcaccgccgcgtcgtcctcgccgccgccaccgccggtggccgctggcgccattggacgacgcgcgcggcaggcaagggcgaagagggcgcgcgcgcggcgcacggcaccaccacacgcccacgccacgcgccccggccgtggaacggaaacccagcggtttcctctttggcgcgcgcgcgcgcgtgcttgtgtaggtgcgcgctttcgtccgctcgctcagcccaccacgttgctccgcaccgcacgtcccgcgcgcatgcgcagtatcgctcgccgctatttttgggcatcctccccgtctagccctcttttttcttcatcatgtatatatgggatacagttgataaacagttataaagagcctgtttggcacagctctacagctcagtcaaaaaatttcagctctacctagagtagagctgaatgtacggccccgtttggtagggctccaaactccaactcccagctctaaacttctactctagttggagctagctcctattggagttgcagacccatcaaaagtgtttggcaaatttttagctccagatctgaaaaaaattgaaaaaaaagaaaaaaaaaggaatcctcgccgccagccggccagcccccgcgccgctgccaagcccgcacgccgccgccagcccccgctccgccgctgagaacgtgcgtcgccgaccagcccgcgcgccactgccgaccccgtgcgccgccgccagcccacgctccgccgccagcccgcgcgccgccgaccagcccgcgcgccgctgagcccgaccgccgctggttgccgccggcgccggcgccgccagcccgcccgccgccggattttgccggagaagatgggaggagagagaatgggaggaggagtttagggtagttcaatggcatttttgtgtaaatacataaaaaattaaagggtagtgggtcttttggggtgaagtggagctgtggagcagaaaaacctagctccatccccgtagtacaaaattgtggagctgctctgcaaactccactccagaaaacagagaatttgtaccgtttggcacaactctagctctaggtaagttggagttgggagctggagctgtgccaaatggggtcgtactctctcataaattaactagagagttggagttctttggcacccgagctctatggtcgctgatgcgttggccaacaaccattgaatccgcgatctccatggctccttgggagtccaggcaatcctgcaatacttgcagatttggtcgtcgttgtgaacaacaactctctaagagggtcatcctgattctttcatctagaggtgggagagttcggggtcgtactccacccggtcggcttaccttgacctcttctcgggcaggatctcgtttcggcacctgccaatctagcgatcttttgccccgccccgatgtcgctacttcatgtggctggtcgctcaccgacgctgctggacggctgaccgactagagaagcatggactgccgcacccaacctattgtgccttctgcgaccaactggaagagacaatcgaccacattctgattgtgtgcccggagtccctccagctatggtggactatcctttcgagcctcggtctcccttagtgtttcccctctggcactaattccttccatgagtggcactgctcttgccggctcaaagttccgagggagcgtcgtagtgggttcgatacaattgtgactcttggcgcttggtccatttgaaaggaaaggaacaatcgtgtgttcaacaaccgttcccggtcctggcctgaggttgtcacagccatggcgcaagaggccgccctgtggcatcttgcccatcccatgttgctagtgctccctagttagcgtgtttggtcgttcggtcgtcacattgtaatagcgagagtaggcttaagtgcttgttttcctttttctcttttttctcactctctcccttctttgtttgccgtttgtataaattttattcctcttaatacaaaaagtacgcaatccttttgcgtattcccgaaaaaactagagagttggagttgggtttaggctgctccataactcctccactccagacctaactcttggaactaaaattaggagttggagctctaccaaacaggaccaaaagataagcaattataatagcgaatttgttatctgtattatgaatgacttagaatgagggatactgaaaattagaaaaaaaatccaaaacaatttaaaatgaagtttcaaaattctaaaatcaattctaattttggttgcttttggtaagccaacaaaccaaattaatttcagaaaatcatatatgataaaagttgcacaaaatcgaatatagggcttgttcagttcttatccactttctacaataccaatttactttctacaataccaaaattggcacattttcgtatcgccaaatttcagtagcgttggttgtgtttagtttaatgtcttagactttttaatagtgggaacttctagaattattaaagtttggtagtatagcatcaataataatgtgtttagtttgttgttttactaaaatttggtattgttgaacaacaaagtgaacatgcccataatacgacttgtggcataggttaaaaccaccacgacataataatgacttgtggcaacatcaaatattgcggtgtcaaaggtttaaaaaaaaccccgggtattatcatctggtcaaacttttgtaagacctgaattttcagatcaacgactagcacatgcagaagcagacttccctatgaaaactgcgcctgaaatgaagtactgtcatatagcctaacctagtcatacaattcataacaatataggattagaggttgcctaaaaactaatcaacagcagcctagctaatgtcacagaatgacagcacggaaaaacagggccacatgttccaagcaaaaaacaacatcgcagtcgatagcacaacaggttacaggtgagcccaacggatgcttcgtttcagtggatgcacagctttcttgccgagtggagcagacagacatgctctgataccttctctcttgtgcctacttgggtttatctgtaaggctgacgagggatttcacgatgccggggctgattctgtctgcaagggcacctttctctgatatcacaaacgatttctccttcacaaagctctgtagcttcttggtgtcatagtctagtcgttcttgatctgcatcattatgaaaatgaagacaatgagttaatttgacaaaagaacaagttatgctcctagatgacacaaccgcaagtgaataatttttttttaatccttgctgcactttaaaatggacaatagaggccttcctcaacagtattgaaaatagatcaagagtgtacctttgtctagaacagtgtgggccacatgaaatggaacacgagcaaagatatctgatcctggaaacattaaccatgtatcttccttggggtcatgatctccacatgttgggcatatctcctttaccagctgcttgccagaggttccttccaaccctttcattatgatttcaaagggggtcggaacactagttttggttgtcttggctcttttccggagggctgtcagtgcttccctattaccattccttatcctatcgttttccactaactggttatcacagaaaaacataaagttatcagtatcaatacctatctaacatattaacaagaaaaaggcaagtcggcaactcataaatacctgatgccttgccagaagaagctgctctgcatcagtttcaatgtcaaccagtgcttcttgaagttgcttcattttaggatccattatataactacaaaacaatgccatttaatttgaaactgtaagtgaatcatgtaacaagaattcatgaatcttcctaccataaagaaatgtacagtgatggcaggggcaggcccaggtttttcaacttgggtattcgaaattattagagatagaaaaaattttccaacccaaaatctaatagttgtataatatgtaacggtataaacatgatttcataaagtcatagatggatagaattgaccataaattgaatgcgttaagcatattagagtatagtactaaactattaaatgacaaaacatatcaaatttatagagcatacaaaatggcaaaatgataagaaatcttataatttaaagaactttccgtttcttaatattttgaaaatgattgacttggaccagttggttcttgagttctcttttttacagcagctttttctaaaaaaaatttagattaaccatgggaccatttttttctcttcatgtttcaaacatacaaacaacaatatcaaagagcaattgagcaaagcagcactggtttctaaatcctaatctatatagttattcacaagctaaaataaccaatatacttcagtctgaaattctgaatcagagaagggaacttgtaaaaaccaatgatgcactagaatctctatggcttatcatcaaagaacaagcataagacaatcaaattcctgaaattactttcaactagattactagaaatctagaatatctgtggctcatcatttagctcatcaagaacaagcataagacaatcaaattcctgaaattactttcaactagattactagaaatctagaatatatgtggcttatcatttagctcatcaagaacaagctacaagcaatatcctcagttagtcaattcgacagttcctcttcctcaccgctgctgcagttctgcgctggccggtgaccggggaccgccggtcgccggaccggggaggcgccgaggcggcgacgcggcgtcacgacagcgtcagcgggcgcgacgcgcgagtgcgcgcggcggccggggggccgtgccgccacgggcgacggggcgcagggcgagtgggcgaccggcgaggcgggcaggcggctgggctggcacggcgacggcgcctcggcctaggcgcccggcggctggcggctgggggaggtgagaactcaactgagaagagatagggttagaaatgcatttgggctttgttctgctattgggccaataggcctgaaatggtgggtggtgggagggttagtaatcctttcagtttgggcttcttttgagttttgaatgtgtatatgcattttttttcttttttcctatatatacatatttttttagataatggaatataatatcccggcctttgctcaaaaataactatagccaattattacaaagatccacttcagaagagagtgtagttcaagacaagttgaacacaccaaacaagagaagagaggacccaaacagagaaaagcaaaacaaaatgtggagctagaaggcctcgtccaggcctaagactgaagttcgaagccaatgcatagaccaatgacaatatccttgtacgaagaggtttctccaaagcggtgccccaaggaggatgcgacgtggatcgccgccaccgctcgttcggaaccgaagcaaggttttcacccggagaatatggtagggaaaggaaatgggtatgctaaaacaacgcctccaaggaggggaacgacgccaaacagcgtcgtcgttgtcagccggccaaatggctcagcaaggctttcgcccacgattccctgtccaaacccacaccaccaatccgcacaagaaagatcgttgtcggtcaacaacattgtcccttcagcgattcggcaaaggccacagcccacaattgttcccaccatcgatggcgcgcccgcacccggactcctccttccccgccgccagaccccttccccgcctccacataccgccgccgacgacgatgcaccgtcagccggatgatggcctttaaccatcgccgccataggtaccatcgtcgacagccgccaccgccactgccacagccaccaccgtcgccagccgccaccgtcagccaccatcgccaccgccacggacacccctgtccagccgccaccgtcagccgccaccgtcgctagccagcgccgccagacgccagccgtccagatccgaccggggtggtgcggatcggaggtgcagcgcgaagcgcgggtcgccggcatcatggaggaaggcatcacgggcacggtgttcacagccggagcattgacgagggcgccgcgccttcctcgtggtggcgaggttcttgacgagggccggcgtcgcggcacacgccgcagtccgccgccgttgtcggcaacttcgtcgttgccacatccgccaccatcgccgccgctagccaccctcctgccaggttcgcggagcggtgccggcgtcgaccgagcccatcgccggtcaccccggccaagcggggagaccagatctggcgacgcagtcgcccgtcgctggagccgcggagagccaacaccgagcgccccaccgccgcgcccaacgccgcgccgtccccgtcaccacgacctcgccgtcccgccgccatcgtcgccacgcccgcgccggggcgaggtggagccgaggaggatggccccgccgccgccatcccagcgcgtcgcccggctttgccggcgacgagctccggcggcggcgaagcacagaggagggaggaggaggggcggcggcggaggctagggttctaccccctaggggcggcggaggctctttcttattggatctctttcatacccttaccattaggtttccttcaggtggctggttggtttgcttcaaaatatccattactagcaaatatgcccgtgcgttgcaacgggtgaatatcaaataaatatggattgtcaatattgcttgcatacttatttaaatgcaataaaagcagatgcatcacgtccaataggaaattgctctgttttttttttaaatctgggtgcatatatgagtaacgtcgagcgagactcttagtatccatactaaatattgggtgcatatacgagtcttgcttgtgttttctgtttttctaatataggttaagaagatgtttgtatcctacttccatgtaattcttattcttggactttgtaattcctgtgttgtaattcctaagctatgtaattgtatctaactcggtttacgcttcaatcaatccttcaacgtgcgcacccaaataactgatcgggaacggtggtggaaaaaaccgggctcaccaaaaaaaaaccgtgaaaagaaatcgccacccacgaaaaaaacggtcggataaaaaaccagtccataaaaaaaaacacttccaagagaaaaccgcgtgcggaaaaaaaaccatcgggtctcgcacatacggacgaaacggagtgtacaaaatctcaaattggtccatacgtagcaaatcttcaaattttataccgctttacatattaggaaacggatgtcattataaaaaagcaaattattgcacaacaatttcatatatattaaaatgatggttcaaagtgattaaaaattagttatgtaaacattaaatgatttttagcgaaaaaaataaaggcaaaatgaataaggcccgaaagctagcgacggtccaaaactgcgtgcgtcggcccgataatgcacgaggctcggccagtgcggcccgttaggcaaggaggcccttcatcgcgtgcggcccgtatcgtgtgcgagcagccgagtagaccccaggcaagcgcgagcggccgaaatgtcggttagcagctaagcaggccgcgtgcgagtacgtgcagcccagatacactcgcaggcccattatccagtgtcgttgttgcttgcggtggtgtgaggagttttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgtcgcctccgttcgctctcgggcgacggccgtcaacgaaatttgcaggcggcccccttgccgccctccgctagggcgattttgtactgtgcggggggccgcctgcaaatgggcagcggggggcctggaattttgcaggcggcccccttgccgccctaggggagggcgattttatactgtgctttatatttttttataaatatcaatagttatcaaatctttttatgttgaaaactatacaagattaaaatctccaagactggtaaaatacaattttattattttttagggcctatttggaatgttacggtacaaatattttgttagtgccaaaatataagcaagttttggcactaacaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcgaattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtttaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggtcgctcacgccacgtgggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttttatcatgagggaagacttgagtatgcatccatccccacaatagcacaaaggacggtcacaccatggtggaaaccaaccagcaaaaggatcgcttcgccagttgagacgatcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactatatgtcaacaggcagcgccgaaagttgatagtgacaactcgagctgcctcttttcatgtatgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatgtaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctaaactgtaccgtgcgaaaccggtgctgtaggtcgcactgctccgaagctaggggcgctcgaaggcaaacgaggtcctgcgaggatggaacatcaagttacgacggggtgatgttttcgcacaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacacatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggtgtctggagtgaaggtcacacgcgcacgagtgcgaagaaggtaccagcgaaggtagtcacggtagttctcctccgtgtgtgggaagagctcgttgatcacctcctctgtagctaatacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctatgtacggctcccagatgacgtcgctcggctgtagatggtcaaactcgaacacgaagtccgggtaacctcgtctcacctggacgtgagcgtaacgacgctgcaataaacatgatcagaattagacatgttatgtgaagaaaaaaaagaagacgactgataaacttataacgcagcgaagttgcactaaccccacgtcgacaccagtaagtccccatcgtgggaccgtcctctggccactgcgcgctgtgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtggccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccccctcaacaagcctacaaagtggtagaaggcctgccgcacgcaaccagtatagagcaaacttcaaacataagtacaacacaaagcaaagttgagttgaaatgtga

SEQ ID NO: 32383 - DNA, 13924 bp, Oryza sativa
  unsure (1)..(13924): unsure at all n locations
gaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaacataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgctaaacactatgttgttatcggccatggacggaccaattttcttgtatcgatccctaaagtacgcttgcgtgccgtgaaggatgaattcaataatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttattcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccaaggtacatgatcaccctctgatataacaagttcagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaatatcccctgcattgataggaccctctacatcttcggtttgcattgaaacatttatatctttctcttgtaccgacacaaatataacgaggggccatgaccgttcaaaagccatttccacatatcgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgataaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgtttttttggatttttagtgaatataatgaaatttcagagaggggggactgggctttatagggggaggcaaaaatcgccctcccccagggcagcaagggggccgcctgcaaaatttcatgccccctggccgcccatttgcaggcgaccccccgcacagtacaaaatcgtcctagcggagggcggcaagggggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaattaaaaataaaaaaaagtcgtggtgtgagtcggcacgattgacggcgtcggtaggatattgatcggacaactgagatttcatgagcttaggacaaaacaccccattcctgaaaaacctaaccataagccatttctaccctttcccccgatttctccagcgtgaggagggaggtgatggtggcggcgatttggtagagcggcggcgactgtgtgctcttgcgcagcgggcttaggccacgcatggctccgacggaggtcaagctggcggtgtgccacgaattgatatcatgtctacctagtcgggtgcccatgtgcactaaggctgtgtttgaggagaagtagattgggaagatacgtaaaacgaggtgagcaattagtgcgtgattaattaagtattaactattttaaatttaaaaaatagattaatatgattttttaaagcaactttcatatataaaatttttgtaaaaaatacaccgtttagtagtttggaaagtgtgcgcgcagaatacgatgtgcaatctcacccaatcacctaagaacgaatactaagtgccagcgacgccaaggtgatggtggcggcggtgatggcacagggtgggctgaggtcagctatccgctcccccacctaggttcacctccgcaactgaggcgagcctcagtctcgcacgaccaactcaggcaggcacgggactggtctgggttgcatagtaaggtaggtacacggtagagctgaaaaaataaataattacacagatcgcgataaattttcaagacgaattttttaagtctaattgctctatggtttgacaatgtggtcctatagtaaacatttgctaatgatggattaattaagcttaataaatccgtctcgcgttttactaatagattctgtaattagttttttttattaggcctccaatatttcatacgacaccctgcataatatctgatgtgacgaaccaaactttacacctctcaatctaaacaacaccccctaagttagaagtattttaatgtccatagtgcaaacactgtgagcatcgactgtaataatttgttagagataaaaaatggacgctagatgaaaattcaatttagctaattaaaaaaactgattattcatctattttgcgttaagaacggtatatacggctgatattttggaaaattttacggaaaggctaaaaaactgtcgacacatttttctctagaaatatgtcgatttctgatccattagatcaactgtaggattcgtgctattttagttgacgaaaataaaattgtactgcaaagaatcgaacctaggatctccagtggcttgtccagcggccctgaccaactgatcgagcaaagattttggcttgaattgaaattacacactaattatacttaaattgcatatcatttacatatataatttagagacttacattgtaaatacactaaaattacatatgtaatttagagacttacatatgtaattgtagcacttacattgtaaatatactaaaattacatatgtaatttatgaacttacaatgtaaatacataccgactattttttttatgaaaaatatgacgccataaatataactacacccaaattttatgtgggtctcacggccacgtgtgatgcgaaccagcgaaccaaaattgtcttcgcttttctgccgaacgtgtcaagccgagagagccgcgccttgattcctccgccccgcccttatcctttccctctcctcctccgccactcgtttctctcatcctttctctcctccgcgcgctcctctcagctggcgaggagctccgatgagcaatggcgccggtgatttattcattttcttggatgattttgattcattgttgttagatttgtgactttgtgattcaatggatttgtgattttgtgatttatttggatcggatttgatctcgttcaagggggcatgggcatacgggacgggatgagcgacgcacaggtgaaaaggacacgcggtgacggaaaaaaagtgtgacggacgaaaaaacacatggtgtaaagatgtgacgaccggaaaaatgctaatatttatattagttagttatagatatagatatagatatatctatttttttaaaaaaaatcttgggtattcatttgaatacccatgaattacagtgggtccgcccctgagtgatggtccacaaatctttatatgtggtgctatatcctatccaccttttaggacgaggcaacaataggataccacaacatatttacaaaaagctgtgcagaaacttacttgcaaaaaaaaagggccgtagaaataaagaacactgaaccatacaaatacaagcaataacatagctgcaataaagaaacaggagggaatggggatttggtggtgtagaaggcgcaatccagatgcactcagagatggatctaaaaatctaacggtcccaggatgaagatcctgatctcctagaccaattttcaatatttgtgatatattttctaaaagaggatcaattgtattttgtcttagcaaggaaaatataataagataatttacttaaggagtaccatgtgtaaatcataatagaatagagcaagaagcatctagatcagagaaaaaattgaactagttcatgcatagcttggacatcagcatttactgtgcagaaaattcctgaatggatacagtagttcggcaatggccaatggggtacatccatggttctgtcttatggtgtcttcgtttattcaaaagcatatcatggtatgtgatgtcttatcatctactccctccgtcctacaaaatcatgaatcctggagggggaggtttgtaaaaaaaaaaaaaaacgatctgtgcacagaaaaaaagattgtgggccatagtagatgggaaaggagcctgccacctctctctctcctatcgttttgaccgcagaaaccttatctcctcggcttttctcgtctcgttctctcctccctaaatcgcatcgctctctcttcccccaaatcacgcccagatgcgacctcctgcctccacgccttcctccccgcaaatccctcccttctccatgccgctccccctcactccctccctgccttcctccccgcacatccctcctgctcaacgtggcggcggctggcgggggaggcgacgagcggacgccggtgttcttgcgtacatgcggcctcgggggtagcggtgacgagcggacaaggcatcggcggcgacaagcggacgcggcctcgtcggcggcggcgatcggcgaacacggcggcggcggcgacgagcggacacggcctcgtcggggttcttgctagttcattcgtcggggttcttgctagttcttgtagtatctggttcttgctagttcttgtagtatctctttttctctgttcctggctctgttcttaattgacagatgcgaggctccaccagtccacctccccgcgcctccctccgttgtgttggaggctttgctacgcggcggcggcggtggagccttgcatgcgtgtggtatactggtatgtggccgatgcttgctttgcatgctgatggacgtggcttgttcgaatgcagctgttatggtggaaggggattgacgatgggaaggacaaccacaaggaaatttatgcttgtctttttttttaccgttaattaatggttgtactttgtaatttggtgagggcatactagtcttttaccactgctgctaaagtcacctcgggtttataggaatcgtgattttatgggacggagggagtataagactacatcatcctagcaaatagcatactgctagctgataagatttgtatgttaagccaaaaaatgctgctacaagcatgacgtcactacggaacacatctctccccaccaaaaatttgtggaaaaccctaagcacagctgtttgcagttctcactataagcttgaatcagctctatctaaatatatcaaagttcacaccgatgcaaaccgatcaacaaatgaaacgatttccacaatgaattaaactacagtgcacttttttttttttacaggaatgaccaaaggaggccatccaaatgacattaagattgaggggaaaaagttacaagacagcaaattatgcatactaagtgcccagctaatagaataaacaataacaaaatagaacgattaaacctctacaaaaacaaacaacgagatttaccaactctaatagcacaaatgaactgattggttccagtaagggctaagagtagtttcagtcaatctaaatgtaaacaatcacataatcacaaagtcacaacatacgtagaaacaggataaaatcagatgcagagttgcgcttggcaacttatcatatctctaatttttttttgggagggggggggggggggaatcacaactctcgtctaacaatccagccctctctctcagcaaccacagcaacttaggccccctttgattaaaggaaattcataggaattttagaggattttatttttataggaatttttcctatatagctctttgaatcaaaggaatggatcttatggaatcctatgaaattcctatgaatgcctaatgccatgcaagttttggaggaatatcatgaggtagaacctcatagaaactttccttcgagtctttatctctcctctaattcatgtatttttcctgtggtctaatcaaacggtcattcctgtgttttgtaatcctctgttttatacttatattcctatcaaaatcctacgattttcctattcgtacgttttctcaatcctgcgattaaaggggcccttattgaggattgcttttgaatttctgttcagaagggagcaaacttagcgaagggagggccgccggtaaggggcgggtgactggggatgcgcccgccgccggcgagagaggagggtttcctcggcggccgctttgctggggctggacgccggagcttggaggcggcggctgttggtaaggcaacgcaaggcaaaggcaagcagagagagagagagagaggatgggccagatattattgggcttccaaaagaggcctgaggtgggcccacgtgacagtctcacagcccactcccctcaactccgctcttcccaaatgggcccaggcccaagcctgggtataaaagcagagctctcgccatcttctggcgcaagcctcactctcctcctccccgcttcggattccaccgtcgcggagctcggcgcgggcggagatggagggcgacgccgccggagccggtggcggcgaccggtcgagcatcgtgatcggcctcatcgagaaccgagccaaggaggtgacgcctctcactgactaaccccccccccccccgccctcccatccctccccctacacccccgcacgcatttttgcttgtcggattgctcgcctagctagcttcctcctcttctcctccaaggcccccgagggtttccgtttcgcgttctactcggtcttcgctgcgccgcggatcggcttcgatcgtgtcgtcggcctgcgtgcgtgttgtgttcgcgctcccgcgggggtggtggtcgatcggatgctgctcgggtggattacttgctctagctggtcagattggtggtggtggtggggggggggttcgtgttatatggcgttctgagcggcttgatttgagggtttggtggttttaggatttgaggctccagctccatttccggggcgattagagcataccctgtcctcgatagtgctgctctagcggttcgaatcgagttggtgtgatgtgtacagtaaattgttggagaggtgggcacaattactgcagtgacctgctgttgcaattttttcctccactgatttggccggcactttcttacaagttgggaatccggataaccaacggtcaaaggataaagccatttccataacagcaccatgcgccatgcgggaaagcatttttatctacgatatattagttgttctccaggcttgttttgaaggagttgcaagtttcattgtaaacaggaaaattcattggatcatggtgcattggcgcagaagagagaaatttgatcaaagtgttgtagtagatcaactcataaacttattatggatgaattttttttagataatgtattatggatgaacagattgtgaaaatgatttctccattgtacacacttgttttgtggtttactaatgaacaagatcttctgagacgctgacctctctgtacatctttatttttcttgttctaagtcaagtgtatctttagttttggaagcatctcaacatttttgccaacgtaagaattctttgtagtgtcagttttggaaaaaaaaaatcgtgatatgaacacgtgtagattgtctgtgcacgtcagttgataacttgatatgcacaccatccaattcaactcaaattgaaaacatacaaacaaaaatcatggagttaattatttctcaatttctttattatgaaccaaaagatcacgaagatttatcaaactagtatttttgcaggttggtgttgctgcttttgatttgagatcagcctcactgcatctttctcagtatattgagaccagttgctcatatcacaatacgaagacacttctgcatttctatgatcctatggttgcaatagtgcccccaaacaaaacagcagcagacggtatggttggagtttcagagctggttggtaaacatttgccaacaaataaaaaggtgatggctgacatatgcaaatttgttctatgttttctcataatatgaacccactttcgtttattctaaacagagttcaccttttagataacaatggcacgtggctgctttgatgacacaaaggtataatgatttgtattcctttctgaccatttatttgcttaattgttgggtgattaactgctgcttaacatcatgcatgttcttgttttcttttaagggtgctgttatggtaaaaaatctttcagctagagacccatctgcactcggtttagatacttattgcaagcaatactatctttgtcttgctgctgcctctgcaacaattaagtggtacgcgtgctatctttgtctcgatacattgctgggctacattttccctgtttaggattaagttaataacttctgttatgtatctcccatgaacatagttgtgtattgcttcaatatggacataacgacttgacaaagctgtgtcataatttctattttttcaaagtgtaattggagcatatgaacttactatgtactacaacagtgcaactctcaaagcaagtacttactaaattattttacaatttgtctgttacttctcatgtcatttcataggagttatgcctaagcacctcatttgatgatactacttactatttatacaatgccccagaatatttgttgttacttagtacattgaaatggaaactgagataggattttcaagttggatacttggattctataaagcttatcttggatcatcaaaacatatttctcatattgttttttttggtcatagataactatttttttcctcgtattggacggaaatgaggataaaaccgaaatatagcagatgattagatctcatgttgatagtgttgataagtatcacaatgacaatttactttgtttcttcttgcaggattgaatcagaaagaggtgtaattatcactaatcactcattatcagtaagttttttagagttttgtttcatataaatcatcgttgtttagcctttttttcacctgtaaggccattcttacgatattatgtatcaaaagtctccattttgtgactactcttctatgggctatgctgatctgaaaaaaatctatacattatggggtcccatacattatctctaaaaacgttttctctaaaaatgttagctgatgtttccgtatttttctcttatatatgtatgtataacttttcaggttacattcaatgggtcatttgaccacatgaacattgactcaactaggtactcttttggttaaattgagcagtattatctgtcacttgataaatcatcttcaccaaaggagcagaaacaatataagttaaaattttctgctacacgatctgaattgccttcattgttccatatatgcacctagcagtgtacaaacattggaaattattgaccctcttcatactgaactgtggggaactagcaacaaaaagaaaagtctctttcagatgttgaagactacaaagactacaggagggtatggctttcccattctccaaactaatcttttttacatatatttacactgcaacattcaatatctcctcatttttgcaatttgaacaatcttttctgagataaaaagtttcatgtcaacttctattgatggtacaaaatagtttaactttatgtagtctatgtattgaaatatcaagcacactgcaacaattctcttcaaacttgcttgttcaggactagactactgagagccaacttgttgcaaccgttaaaagacattcaaacaatcaatactcgtctggattgcttggtaaggagattaatcttttttgttattctcaattcttaaattggaatgtctgtttgatcaaattggtcatacggtaatcctgacatttgaaacttccaaagttgcacatattaagttctggatcttctagtaggctaggttctggatcttctgtgggaatgaactaacttcatggagtatgaaccctgctttatgcatgtggaaatcttagtgcatatagtcttaaatcgttactcgaagggtttaccacaatcatgtttgtaccatttatagttcatttcctgttggagcactttgcaatataatggagaattttactgcaaccatgattgtacaccacaggccatatgtgaaagtatttccatgagaaggggaagcaatagttcttgtaatattgatatgcaacgctcctttgcaagaatgaaagtcaactggaatctgggatataacaagtattcagttactaatattatcatcgaaaatgatcagtaatatatccaataaatgcatgtttattaattttatatcttaaattttaggatgagctaatgagtaatgaggaattattctttggcttgacacaaggtcttcgtaagtttccaaaagaatcaggtgaacttatgtcctttttctctgtagaaaattctatatcctcttctggctgtgcaacactacagataataggtaaaatggttgctggtgttacaacttccataattttattatgcctcagataaagttctttgccacttctgcttcaaacccaaaaaggatactgatgaagtgctaaagcctgccaatggtagaaagagccaagggctgatttctgacattattgttctaaaaacagctctggatgccataccattcctctccaaggtagtgttatagatgtgtttgtcctagtattcaatttagcaatttattcattctgatttttcattttgttttgtttttgaagatgcatgttattttgttcatttaagggtaaatgtcttttattctagaaacatacccatctaccttttcacgcatgtgatgtgtagctcatcacaggttctaaggggtgcaaaaagtttccttcttcgcaacatttatcagactatatgtgaaaacccaaagtatgcaagcatgagaaagaggtactgttttctgacctttttcctcccatttcaaaggagaagttgaatgaagactgaaaacagcatgctaacttcaggcttagtcttcccatcctgcttttgtttgtacatttgtttttagtttttagtaatattgccagtatattagcattatgtgactgtaaatatgttcgtccacatttattaaataacaagtatatccatctacattctaaaagtaaccattcacctttgatttggttgcatgttttcttttatgatcctagaattggggatgtcattgatgaagatgttgttcattcaagggctccttttgtaacctgcactcaacaatgttttgctattaaggctggaattgatggactgcttgatgttgctcgtagatctttctgtgataccagcgaaggtgtctatcgttttcatgtttgttttctaattttacctaacacagctgattgacataatgcatttttcagccatacataaccttgccaacaagtacagggaggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32384 - DNA, 208 bp, Oryza sativa
aagaagtggaggcactatatacttggagggaaattgataatcaggactgatcagaaaaacttaaaattcatgatgaatcagaggctagtagagggaattcaacacaaattgatgttgaagttaatggagtatgattactctattgaatataaacctggttgggagaattctgtagtagatgctctgtcaaggatgcctagacaacaag

SEQ ID NO: 32385 - DNA, 44725 bp, Oryza sativa
  unsure (1)..(44725): unsure at all n locations
taccagctgttggtccagatggacaggtcaaaactgaacctgtgctgtgctgcaaaggagaatggtgcctagaggggagtagcagtaacttagtggctgattttgtggcagaatttgagtcctgctgatgcaacttgggaggatgcaacagtgaaccaaagtatgtttccaactttccatccttgaggacaagaatgctgctaagggggaagcaatgtcaggactcagcctagaaatgagatgcagcgaactgaaactctgaatactccgaactttctgaatgtttgagttatctgaagatttgaggaggagatgtagactttcgggaggattatgaagatccaacgacagacaaaccaagcaaagcgatatcacgaaatcctagccattaatcgatgtcggggaccactgttctggtcattcttttgcctttttcctacttttgagctgtctgatgcttgagagctaagactacctcactttgtataaaaacgaattgcatatgagaatgaaagagatatcaaaactcgcaattatcttatcttaggaagtaatctagatttaggaatcctagtttaggtccttgcggcgcaaaccaaatacgttttattctctgaaattgggttccatttctagtaaaatctttctctgatcttgacatgagggggatgggaagtagcttcctcgcgccgtgcaccactctgaatcgccgccgtgcgttgccgctgtgtgccggcgtcctcttctgcagcaagatctgctggaggtcaagaacccatggacaagagagagaacagacatgaggggagaagagaaaggagaggaaaggagaggggaaggaacctgcactgccgccgccaccagtgcgccacctctaccgatgcgccgctttttttcacccgcacggtccgctctcttcacggatgcgcgagtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgagtgaacacggtagggctcacctaaccgcatttattgcggtctggtcaagcgtgtcacgctgcatgcagcgcaatgcagcgcgctcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgccgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaacctccgtccataaagagaagaaaagtgcagtttggaagggagaggggacatgtggtatccccttaagatataaaaggaggaccatgcccacaaagaggggggattttttttccagattgagagcctagaacaagggataagtcggctcacactttgtagctcctccacagacaaatccaccaaaacacaggagtagggtattacgcttcccagcggcccgaacctgtatacatcgccggtgtctcgcgtttcttcctggcacgcaatctgtccacacacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccactaccggttccgcgtcgtcaagacggagggcgcggcgagcggcggctgttgcacgccattcggctgccactccctcgtcggcacctccgactcgggaggatcagcatggagagctggatgcccgcctcgacatcgagcgtcggcgtaatagccggcgtactccccgcgcaacggagggcgcctcttcgtccagagtgtcacctcgacagggacgtgaggaccagccctccatgcccccggctggtggtgtcggctgtagagcctttgtggcgagtcttcggaatgtccgttggcccccaaggttccggcccaccatcaccgagaagtatgacgggagtgtcaaccccaccgagtttctccaggtctatacgaccgggattgaggccgctgggggtgacgacagagtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtgctcccagcaaggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgctgcggcccctactcatgaggcgacacgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccaaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgtatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttccttgggtagccaaataggacataatgttgaggcttatgtcgatgacttggttgtaaaaacgcgcaaccaagaaactttactttcagatctagcggaaactttcgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgtgcccctgctactttacttagcggcgaccccccaagtagttagtgcagcgttggttgtggagcgcgatgaaaacaatcctcatttcgtgcacccccattctgtgctaacttggcccgggagcgagcggggaggagaggcccccgagtcggacggtggcctacggcccctgacgaccggagtcggccctctgcccgcttgtcagacggtgctaggtgcccccaaccctcaggagggccccaaggccactgcgggaaggccgcacttaacgccctttgaccccgaggctaaccctgtgctgactcgacccgggaaagagcagggagaagaggcccccgagccgaatggaggccagaggcccctgacgaccggagttggccctttgcctgcttgtccgacgatgccaggagcccccgacccccaggacggccccgaggccactgagggaaggccgcccctttcatcctccgaccccgaggtcatcggcacagaagacaagtgcgccccgaaaggccacttgaatgaagaacgccccggggatacggcccctagcaaagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttatcccctcggacaaatcttgcataatcgagagggtacaggacgggtggtaaaatgggcaatcgagctttctgagttcgatctgcactttgaaccacgccacgctatcaagagccagaccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcactttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgcccttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgaggggggggggtcgggtgtcaggtttcgtgctcgggctaaccccgcacccccctcgggtgtgcagggttagccgggggctaccacacatgcacagccttacttttcttatttcagcatttcaataaaagcagtttcaatttcctaagggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaaagttaacatagaaattttttatcatttttgattgcagattaagttgatctatacaaaaagaagaaagaaaattggagattggcgggggcctgggggctcattccaatgcgcccgggtcgccggcctcgtcgccactgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttcttggacagcccaggccatcctcctaaggtgcggggcgaggccttccagattggtagagcgcgaaattgtctggcctttccagaggcccgcttcccgaccggcgcgatccagccgggagactgcatcccaaagcatgccgggccctatctcacccgacaagcggagggcctcggcctccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggatgcattccagattgcggcgcgcctgctcctcctgcgctgccttgcggagggacaggctgtccgccagccgttgtgtcgcggtctcggactcctcaagagctcgctcccgctcagcaagcgcgtcctcgcggagccggagcgcggactcctcttcggcgcaggcggcctcatgcgccgccaacgtcgcctcccggatagcggcggcggcctcgcggtccgccaagctaatctccacggcgccggcatgatcttccagcgccatggcacgggcttcaagggcctcttcgcgccgtcgggatgccgcttcagcctccgttgctcgctgctctcgggcagcggcggcgtcaaggacccgctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatatggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaggacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgaatggcttcttcagcctgacgagcccgggcggcctcctcccgagcagcttcttcggcttggcgagcccgggcggcctcctcccgagcggtatcctccgcctgccaaacccgagcggcctcccgggcggcctcttcagcttcccgaaggcgatctgcggcctctcgccggtcagattctcgcctccgttcctctgcggccgccggatcttcggcctcggattggtcggacttgggatggcgggaggaacgcgacgggacatcgctgaagcagaaaaaaaaaaaaaaaaaaaaaaaaaaaaaaaaaaaaaaaaaacggaagacaaacaaggtggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgctccgtctcgggctgtgatgtcggcgcggccccctccgggcgcctgcggctggcacgcaccgccccgtcccctcggggaggagatgggggaggtgttcctccctgtttcctcttcccccgggcgtcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctaagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacactggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccagccattgcgaaggggaggaagaagatggaccgccccgggtaatctggtgctgggcgcgcctcgcccagcatcactatctcccggccggtggcggattccggcatgaagcggcgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcttttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcctttatccggtctgtgaccagtcacagaccggtcagatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgccgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaacctccgtccataaagagaagaaaagtgcagtttggaagggagaggggacatgtggtatccccttaagatataaaaggaggaccatgcccacaaagaggggggattttttttccagattgagagcctagaacaagggataagtcggctcacactttgtagctcctccacagacaaatccaccaaaacacaggagtagggtattacgcttcccagcggcccgaacctgtatacatcgccagtgtctcgcgtttcttcctggcacgcaatctgtccacacacagagagagcttgagatctcaccctaagcccccggccgaactggcaaaggggggcctgcgcggtctcccggtgaggagccacgagctccgtcagcgagacaggagagggagagggagagggggagggaagcggtatgggctgggggtgggggagagatggaggggtagttggtggcatttgctggtaattttggttcaactttcggggtacttttgaaatttggttggagttggagttgtggagcgacgggaatgccgctccacgccgctagtacaattttgtggatcgatccggcctactccgctccatttttttgtggagctggactgtttggttgtgcaccagtcagatctgaggcgaatctaggagtgggagctgcaccaaacaggccctaggtaagagaatacctgggtgttacaccctccaggatggcctcaagtatagcagctataccattttgtgtattagcttcagataaccagactttgtagaccatgaccatccatgcttctaccaattacatcaacaatagatcaatgtccttggctgaatcgaattcaagtgaacaaactatagtgaattttgaaagtttgcaccgattgtattcaactccaccatcagtacagccttgtgcacctcctctaataaatgtagcaacattatccttctgaaagaaatcgtagcatcattatacacttcagtaaccatttgccccactaatgtagttctctttgttgatcatagagggcatgtgtagtgctcaataatgtgatccaccaatcttgatattgccgtggcataagcttggattgtatttccattggtaggaagcgagcaacctgcaagagtgacactcaagatgggtatgttttctttactatgaaatttcagcaattcatgcaaccatgtcatctctggaagatctagtgcaaacattgccgtgtcaattttacaggtttgcgatggggatcgatttactgcaagaggcctagtggctggtttgaaccgtaccaagtcgggttgaagtaagttcgaccaagggcaaacttaactttaatggttatttctttctcctattacttcgaaaataataaaataataccgcaagtgtccaacacctaattaccggttttttgccatgccctaaagcagatacgcgtttttatggtgtccccaactaattacacttttttggatgtcctgtagcaaattttgtctatttttttttacttcttggttggttcttttccttattcacattttcttattgacatgtactttatccgtcccacaaaatataaatctggctatgcttctgtctaaattatactctcttcatctatttttgatagtcatatttcatcttggcacactgactaaggataagtaattctacttatcatccatttaaatatgctactccctccatttcaagttataagatgtcttgactttggtcaaagccaaagtgctttgagtttgacttattttgtagaaaaaatagtaatatttttaactcaagacaaatatattatgaaaatttattcaattatatatttaagaaaactatgctggtgttgtaaatattactacttatttctacaaagttagttaaatttagagtagtttgactttaactaaagttaaacgtcttataacctgaaaacagagggagtactagttatttctcgtaaacaagcgattcattaatatttacatttttcgatgtccatgtagccaattttgtgtggaagaatggagagacacgtattaaatccgagaaagttgttaagaggatatgattgaaatatgccaattaaaactaaatttttcagatttgaaaatagatggagggagtagggttttttttcctgacggagtgcgaagaaaatggttgacattgtctacgaaaaaattattgttcaattaatatccaactataaagctgcccataacaccatattgattcctcgtctaaaaaaagcattaagaaaataataaagaaataaaaaccaaatatactccctccatacttttgatagtcatatttcgaaatctgaaaaacaatttgtttttgataggcatatttcaattcaacaacctatcatcttacatcttaatgattttctcgaatttaatgcatgaccttctattcttccacacgagattgactacatgggcatcgagaaatgtaaacattaatgaatcgcttgtttacgaggaatgactttaaatagatgataagtagaattacttatcgttgatctatgtgtcaaaataaaatattattatcaaaagtagatggaaggagtacctcggaagcctagcctatatatatccgccgtcttttctgttctccatccgcatccccttccccaccgtatccgcgattatccaacccccgccgctgccccccacccccccccccccacccccacaggaatgccctcagcgctcaccgcctctccgtggcgctccgtcaagcttcgcggccgcaagatttggcctcagcactgctgcgcggcctccctcctcctcagctagtagtagccgcctcatcacgcgccgctcttcctcgcggtctgggcgtttcgtcgaacacctggtgggctccccccttccgccgccgcaagaactcgatcgatcggtcggtatgaccgtcgcttcctccgacgaggcgtcccggtcggtgctgcggccggcaccgcccttgaagtgggaggacgaggaggctcacggttcgtcgccgggagaaggaggcgctgctggttgggccgtggatagcggggaccaagaaaatggtgcggatttggggccggtgatcgctgtggaaggacttggtgggctcgtcccacaacccgaggtggccgtcgtggccgtcgagttgctgcctcagttggttcaagaaccgggcaaagtttccccaagaatccatgaaaaggcgaattctggggagggtgagaatggcgatggcaagtatcgtgtcgtctacacagctggccgccgcaagaggtgtctcatctcgccgggaggcagcgacggcgacaggatcacacctcgcgacctcgccgtcgcctttcacggccaagaggcaggccaggtggctccagaagctgccaccgccgcaatcgccgacggtgctggtgtcgccgtcgattccgtgctcaccaaaatgcaagaactggtgaatcatggttcatgtggcaatggcaagaacaatgtccgaaaatccaggagaatccacatgaagcaagctactgccgtgcctgtttccgatgagctcaagaatctccatagccaagaagcagaggctgcccatggcaagatcaccgatcaatctgattgcgagattaagaaggagcctcgtgagagttgcatgtcctctattgttggttctgatgacagccacatcagtggcctgtccatcaggttgcaaagcttggggatcaacatcaccagtgtgacaccgatcctttcaaagaatgtatctagtactgactgccatcccaaccaggcccggctgttgctttcgcgccacgcggtggagggctcgccgcttctggggatgctcacaccgttggaggatgcccttgtgcacagttcagggctaccaatcgaggtcgttgacagatatggctgttcctatgacatgttcctgaggtatctcgactccaccacttcctacagacttattgtacagtggaggaatttcttggaaatgagccacatgatcccaggtgatttggtgaagctgggtgcgtttcgcttcgaggggcagcttgcgctgacattgttgcattatgggaatgccggtaaggcgaagaaggtccttgacagaaaacttaaggagaagaaggtggagtcaaactccactgtgacagagaaaagcaaagagttgacttccagggagacagaggaaagcaaggaggagttgacttccaggaagacagatgcaaatgatgcggagagtgcttcaagtgtggcagaggcaatcaagaagaagtggccatccgagatgcttgaggcagcggaaaccttactaatgctgtcgtgttctggggataaaccaaaaccatcagagtgattctcaatttgtccggagcaatgtgcaagcagttcctaagcagttctattgtcagaatttattctgaaggtttcgtagttctcagctcatttttgtgacttggtgccctgatcactggtttgtgtcctgggctgtccatagaatatagatacttaagtagtgattcttagtattaggtatactgtcaatatacctcaaattagacagagtttttgcaataaagtgggcatttaagcatatgatttgtctgttgtattagtttttcaccctgacaaattttctgcctgatgcaaagtttacacttctcctaaaactgatttgaatggttatttctattgtgcatattttgttatcctgtgtggagctattctgttatgctacagttacttctccaattgcatgattgctgtgctgaatcttcagaagacgctttgcaattttctttctagcctgaattttgttcctgaggtaacacttctatgaaatgcttattaatatttaatttgtactgtaactgtgcatagtcatgagcaaagttttgtgccaatgcatgcatgtaggatgtgtcgcttttgcttcattctattactgttctctgtttgggctgtagtactctaatcatccaatgtcactgaaacatcagaataaaccattgagtcttgtctgtcaggtctaaattggtactactagcataaccatatgtaattcgattgaaccctagtttgaattcagaatgttcttagtattatattttattcattgggttatatagtctggtaaactttctagtaatcttaattgatgttgctaatatctgtttataatatagtataatatactatggtttaggatgccatgaacttagttgctttctgggtctagaattgttacaacttacatagtccctaatttgcttgaaatagttggcacacgatactttgttagttgtgatgaatttcatctgtgttgaaaagaatggacactttctcatctaaacgatgaaattttcctatccttttatttggaagagacctagtaggaaatctactgggttgatcttgttacaaaaagttgcttcaggttaccatgtcagttctgacaactacatgaaaggcccgtactttcagacatgtcaacagttttcaggatgtcttgctactgattccaggatacatgatacactgtgccacgtactttcagacatcctaaaatattgcacctttattacagttttcacttttcaggatgtcttgctactgattccaggatacattagcactagatacactgtgccacgtacattcagaacttttgaaaaatgtcacaccttcacagttttcaggatgtctcgctactgatttcaggatactttagcatcagataccctgtgtcatgtacatctagaaatcctgaagaatgttgaattctgaataatgtttgcccctttacagttttcaggatgccttgcactgatttgactttgtcgccttcacatttgttcgtaagatattgagctgttgtaattgtaaggattgcattcactgacgattatttctgtagaaaaaaagttgtgatggtaagaactgcaaaattcctggagaacactagcgacagtactaatctacaaaggtttatcatattattactttagttactgatacattagcactagatacactgtgacatgtacgtctagaacttctgaaaagtgcctggggatctaatgaagagctgatttggtagaagggagctggagaagaaacttgtgaatgggaaatattttcctacagatatttcatttatattcaacttaatgcctgaaaaggtttgaaaggtcatagagctggtgttttccagtgacatttttttcttctgcagtcgtgatgctgatgcatgctcttcgacagataaacaatcaggtctggtcaatatcgaccctttattcatttacacttctttgtactattgccagtgtttgttgtcttgctgaatttgggttttgtcactacctgatatttttattaccatgtaaatatcacagtcagtctccagtcgtggtgaccattttccacacgaggaacagatgctggaagatgacctgaagattgctctgtttgctggtgacctgaagatgaagtttttgtgctagcttgctaaattgcaattattatttcttaatggccaaacattctctcatgaattgcgtcaatcagagaggcctgacccacttccagaagattgcgtgacgtgctgtgtgaattggatcccaagatgttcttcagaggttagcagggcagtcaaaaatactggctgcttgttatcgtcagcatcaacttgttcttgccgtcgtcatgctggcacaagcctgcccatgtcaccacgatctcgtcaccggaattaattccaggtcccattttgttgttatctctgaattccaagtcaaaatcaaagctttctttcactgttaatcgtgtggatgtggaaggatgcatatacaaatatatacaatcagaagctactgctgccgttctgcaccggccccatggaggaaaaaatgaccatgatcaagacaaaacctcagtatctgttgggtcttacacggagatatattggttgcagagacatctgaacctgcaaatgcctaccattttgttgcctggtgctgacattgcaagcagctgatcatgcctttgcatgcattcccattgaatggatcagcattgacagaatgacagctctatttgcaaaatgtttatttatacattgtagagataatttcttcactttgtgagatggcaagttagatgaaccacctttgttttcaaccatatctcgtaagcagaaatgcacacctatattgactaaatctgttgcagggccttggcttttccattgcattaaaatgaactaaaatttgtgagcttatgactagcttaatactattatatcacttgtgaaccagctgtaccttgttgtagaccatgcctgaccttttgttgcatgagaacttgtgtactgaagtctgaagggacactgtactctatgtcggctggtcaggattaaaccatttcaacgcattccagcagtaagtcttcagtcacagtctctgttactgaacgtgttacccaataatcttgtgttgactggaattgttcttctgaacctactcatgagaatcattgagggataatgatgtactcctaccaccgcactctgactgacatctcactgggcatgcccctgtttgtgagccactttcatgtaggagtattacccaagaatcatattgactttgagaaactatcaatgtgaagtgtgataactcgttctccctctgtacagattcattgtattaggaggagttacatctccaagatcgagttttttttaggacggagagtagtacctccgtattaaaagaaacctcagagcaatagccaactgacgatttctgaactaaaataagaggcaattctagtgatccatactgttttgatacatgcactccctcatattataaggtgttttatgtttgttttaatttatacgtttttgagtttagcaaaatttatagaaaaaacatagtgctatctactatactaaattagttttattaaatctaccaccgactatatttttttatagtatattcgttatgttttaaaatgattttcatttttctatacacttggtcaaacttagaataaactaaaaaacacaatatggaacggagggactacttaaaaaaacatcagcacaatagcgaaatgacgttggaagtaaaataagagggaattctagtgctatacgtttttgagtttagcaaaatttatagaaaaaacatagtgctatctactatactaaattagttttattaaatctaccaccgactatatttttttatagtatattcgttatgttttaaaatgattttcatttttctatacacttggtcaaacttagaataaactaaaaaacacactatggaacggagagactacttaaaaaaacatcagcacaatagcgaaatgacgttggaagtaaaataagagggaatactagtacaaataatgttgtgacacatggtattcagtacaattctgtttatttgaggagttgttaagtacaattgtagtaaaattgtacattcggtgaactaaagacatcaacctgcgactgaaatcatggcatatatactaaacttaacactataacagatcagaacagcaacatctggcgaatcaatcctgtcatacagtacaccaagaagtttgaattttcttcacatatatccacatttgagttcctacctacacatgcaactctcttcagcacatgcaaatacacagttacacgcacaagccttatcgcccattgtttcgcttatatttatgcttatccatatagtttataagaaaagataatttatagataaaacttttatatatctgcacttagcaattcaaaaccaaatgctgtaaaataaaccataataaaaaaaaaaatcaaaaaatcaactccaaaattaagttttaaaatacaaattatagtctataggcataagcataagtgaaacgacgaataaattagagttggcagggtaccccacatctgaacccctatatatacacaaacacaagacctaggatcactcataccataagcaatccaatccgatccgatccaatccatccaacaaccaccaaatcactttcagttctcacacaaagtttcagataaaattcagctatctgaagacatcagaagaagtagctaatttaagctaagctagagaagatgaagaacaagggcagcagctgcaggtatcttcctcactcttctgcaccatgcgccaccgacggcgccagatgtttccgctgcgaccaccggccggcgatcgacgagatcgtcagggagcagtcgctggtgacccagctgcgcgccgtcgtgctgccggcgctggagacgaaggccgacgacgggcgggcggagatcgtggcgcagctgttcgggagcatactggattgctccaggaaggtgatctctgctctgaattctcgctacgtcggagaatcacctcctgacgatgatgagatcgtcgacaaaaggagggcgaagaggaagaacagtgagggcaagaagggtgatgatcaggtgaaagtgaagccacatgagcacaagagaaggtatgatttagcatttttttttccactattcatttggactaattgctgtgatttgtacaacagttgctattcatccatgttctttagcttgcttaattgttgtgtgcaataatcatagttgcatatattatagttggattaattgtcacctattaagaggatagagacattttttataagagtaatgacactagctgtactagctagctatttttttttctttttttgaaagatcactagctagctagctagctaatgttgagtgtgtgaatgacacaagtagctaaagcatatgttgctcttcatatctttatcatcccgatatattgcttgtagatacctatatatatgttgatcgatgttgctatatatgaaaggtccctttcctaataaagtgagttcgatcttgatctactttggattgtctttcctcattggcactgcacttaggactctgaattgcctcagaaaattatttgagtgtgcatgtgtagatgatttgaagttggtcttgaagctagcattatgtttctattcatgtaaatatttcctaattgaattaattttgcccctcatgtttcagcaggagatacactaactcaacatcacaaatcacagctgttccacattatgacggtcatcaatggagaaaatacggacagaagaatattaacaactcaaaccaccaaaggtatatacacatatatccacaaaacctcaattatttcatctctctctcacacacacatcaaggttccgtttttgtgcccaacatacgacgcaactaattaattaagttttggcaaagagaattcttatggcacaagcacacaactaacaatttgcaacataaattaataagcaggagctactacagatgcagctacaagcatgaacaaaactgcaaagcaaccaagacagtgcaacaactggacagtgccggcgaaaccatcatgtacaccgtggtctactacggacaacacacctgcaagactaacatgagcaatgctcctctccatgttgttgaaacaagtaccactcaaagcatctcaacaacatgctgctctgatgatcttggcgattatagccaaaagatggagaacatgcacacaccagagttggcagaagtgtgctctgatgagcttggttcttaccatgcaataataggggcagagcacagtgcactagggttggaggatgaacacatgcacaagctgctcgacacatttgcatgtggagcattagatctggacagctgggagattgatgcaattgtgagatctggtttctgctaggtgaattttgatgcatgttgctgtgatcagttttggtgcttagatggagtttttttgtattatatgtggttatatggtgcttactgaactttggtgaatgcaaaataaatagtttagtgcttgctagatagcaagttaagttaaaaaatatagttacttatattatttatatatgtaagttggtattgtaaggtacaatcaacaaccttgaagaattttgtccataaattttaagtatatatacatgcaggttgaagatatgaaacacactgtctatgatgagttgacactatatataggatgaattcagtgtaataatgggtctatttggtgtactaacaaacgaatgatgatgcacataagaccatctctcttgacccatgtatagtacaaggaacaagtagccatgcatggcaacgaaaatgaaaaaatatgtttgtgtttgacataatgtcaaaacaggcatgatttacctaaccctttttaacttgtgcgacttgtgtcagtaatatttttttaattatttctgacttttcgaaatggtctcatatgtatcagtagtgattgcttcctatatgtcatataagagtgcgttctatcctacatgttcccaacttttactcactcgttttttacatgcacgctttctgaacttataaacaatacattttttaaaaaatattcctatagaaaagttgtcttataaaatcatataatctatttttcaagtttttttatagctaatacttaattaatcatccgttaatagccaccccattttgcgtgtgtaggagagaagttcccaaccttctgtcatgaacacacctaagtagacagtaacacattaacttattactagttatcacccttacatttgttggtatatacatatttatttccatatgatgcatgctaatttctttttttttatttgtataatgacaaaatctattctataccattgagtttgttcgagttcaacgatttaccattgacattgtctctttctataatataccggcgactttatcgattgttctacaatacgccattaggctggacatttttttcaaaaatacccaaaatacccttatggatatacaaggttaacaattgatttatcatattagaagtttcaaaaaaaaattgaaaacttttatgtgacctccttacacaatatggaagttcgaatagaagtttcaagttttttttacatttatatttttttaaaaaatataacttatttgttatatgctatataaaatacttttttattgatgtttttaatataaatcatttttcatacactacataagatattatttgctagagagaatttattctataccattgagtttgtacgagttcaacaatatgtcatcgatattgtctctttctataatataccgacaaatttattaattgttctataatacactattggactgggccttcttttcaaaaacaccaaaatacctttagagacataaaagattaacaattgatttatatcattagaagtttcaaaaaagtatgaaaattgttatgtgaccttgttacacaacatggaagtttgtatatatgtttcaagttttttctggtatatttagtctttagaaaaaaatatttttatgtggtatatgagagaaaatttgcttatacgtacgatagataatagcaaaatttgcttatacgttcaattaaatccttgttctctccaagggagtcaaaattcgtgcatcaagcatgtcccaacattttctactagtatatatgttttcctccttccaacacctatacataaagcataatcaattaatatagattatttaattggtgttaattatatcgcacgactagaatgatcatatccactgaattgtcttatttttgttctcttcacgtgcataaaacctataaaaagtacactatgctaaataatagcagatacaacaatcaaacgtataataatgcatttctaaagatagaaataaacgataccacttccacagagtagagttgcacacactaatcagcatgcaggctgctactactacggtatcttttatggatattttttttgctcttaacctactttttttatatgaaatttggatatatgttttccttgattagattcaatcaccaaactagtccttcttatcaatattcccacatggatccactcttttcaattgcatcatttagctagtgtattctggttatttccttttttttttactttagcatattatggatatttttcatattctatataatatttgtgtggtactatatacctgtctggtatacacattgcgttgatttgaattattacatcatcttaaaaattgtatcctagtacagctacattacaactacttgatgagtgattgtgctttctgtttaaaataggacacacatgcaaaaatatggtcttggaccgttcatattttctaatctagtagtattcaattaggaatactagaatattttcttcactgttagttgaaatcacaaatcaacggcagatcacttctaccggtaatagtactagccatcgaatattaccggtattgccattggtggatatgaaggttttgtaaggcacatatttggtgcagaagctataatatatatatttcgtccattttaaaatataaaacgtccttgttatttattttcgactgatatttgaactaaatgttttgtgtcgtatatatagtatcattttatatttgtgttttagaatatcttcatatgaggttattaattagttctcgtacttgttgataatatattataaaaaatcaatgatcaaaggataataatgctgaagaccttgtaaaatgttaatatactcattatattttattttagaatggagagagtagttgcaagaagttaaatatgggtacaacactactactgtacaggttattttgccagaagcatgtcctgcacaccaaacagaggtgatgctgatggcgtcctaggaagactattttgtttcgattgggattaatttgtttgtccacttgctaaacaaatcatttgggtcttgtgctggcaacacaccatagtttactttatgaacaaattaaatataatccactgaaagttcgatatgaactacaatataagaaaaagaaatgtgagatggacctgagtagaaagaaacgtactcaaatgcgcacatgtgcaagcatgcatcaacacagaaagacgattggacaaactgataggagttagatatagagagatgctcttttaaatatatcgacatgcctgctccatctggcaatattaaatacaatgataatatttggttaaaatttttaaacttcgatcattttgtatgagactaagtttataaatctaataagtttgtgatattacgatagtatttttaaatacacataccatttttaaactaaacatttgagaaattataattttatcaaaaaaatattttctaaattttatcatagctgtcaaatacgtatgaccagagagatctagtaactatttatggatttagatctaaaagtagcgaacggttttaaactagctaatctcttgccgacgtcagttacattatggatctggtgagacgtagtgtattgttctgataaagttcttcacaagggttgcaaaatataatgtcgacctggccatgcacaatataatatggcctcttgcaattaatgaatgatgacataatcaagatagataggtgaaacacgatcacatagttcatgaggtgacattcatttatcttgaagtcttgaacgcttagacacttagtacaagatcgtacacggatatcagggattcgtttttaacacagcttagaatatttgataaaaagtttactattgactatggctgtgtttgaatgtgcaaattactacttttactaattcatttttttgcgcacgtttcccgagctactaaatggtatttttttaaaaaaaagactttctaaaagaaagttgttttaaaacaatcatattaatctattttttaagtttttagctaataattaattaattatgtgctaatgaattttttattttacgtgtgtggggataagttcctaaaccgaacttccaaatgcagcctaaggaatacacctaaagaaacgcgttcctagcatgcatctcaggataatttagtatggaggagaaagatcaaaatacaccttattattggaaaagtagtattggtcggtggtaagtaatgagtattgaagggataattttctttaatttgctgaccacgagtacataggagggtagagctgaacttattttggggcaatatttaaactctataattaaacttattttgggactagagggaatacactagaagagacctttaattcttcctctgtttatatgtagtggtagtttttaatattttagttttatcatctgtaaatttttttcaacatgatttgaatgttatgtattttatgagtttttaatttatcataaaaaaatgtcataacaaacagattgtgaagatgagaagggaacaaatccccctcccacccccccccccccaaaaaaaaaggaacaaatggagtgatagaaaatagataatatatatggactctttcagtggtgagagaggacattttatcttaattaattaaatttctttactttatttacggtttttgacagtcctctcttatctgacagctggaacctttttattttcgagaaacagagcaggttaaaattacatgtcctaatacaagaacagaaagaaaacaactatcagtcggcatctaaatgttgtacatctcacacaggttaattctcgtcggcagagataggcaactccatctgtgcggtacgtgtcttgaattaccatgaatcacacaggttaatcggaacttctgtttgctgctgaaatattcttctcttcctctccagccagatattcatattccatcacattgtgagaaaatgtttcatcaccatttctcattttctctaaattcctttggccgattaattgcaagcagggctccgcctttgaattttgaaagccttagtacaaagactacagatctgaattatggaacattaatagttactccatgtccccctcattccgatgaaaactagatcaacgcgccattgagttgagagaagttccgattgaatccattgcgttgagagaagttccgattgaatttcaatatgaatctttgggacttctcttgatatttatatccactatctatgtagcagttggagagataaaacttaaaagaagtttccaacgattaaagattatatttaatttcatttttttttttggaaaggatatcaattgctagaatgtgatgcatagagatctagctaccgatcatgcaaattaattaaaagcgattatattcacaactccattattgatgtgtgaaacatcaccatttgtttcagtaaagatatgggacgaattaaaggtagtacatggcaactagctagctcgatctataagcggccgccacaacattgtcctgaatggagttattataatctcggaattagcggatagataaccatagagactttattttagtttgtagtagtttattgtgcgagttggcgcttaactaatacacagcgatttaattaagaaatgtaccgtgccaagctagctagatgcatgcattaatagggtaccctgcagagtattaattaactgaaatactatcccttttgtttatccatctgacaattcaactaatatctgatgggaatctaagagggacagtgaccgggcacgcgttaattacgccaatttgcactgcaattgttctagtaatttgtctgtttttaattagtttatatatttgatggtgtggcgccagcctgaggttacttgtgacgttttgagctaggccactgatccagaaggttcaaatgatcaaatcatgcgaacgacatatatatctatatatcattctcgattgtggccctgtttagatccactgctaaaattttacaccctatcacatcgaatgtttagacacatgtatagagtattaaatatatatgaaaaaataactaattacacagattgtgtgtaagttacgagacgaatcttttaaacctacttgcgtcatgatttgacaatatgatgctacggtaaacatttgctaatgacgaattaattaggcttaataaattcatcttgcagtttacagatggattatataatttgttttattattagactatgtttaatactttaaatatgcattcgtatatcctatatgacacgctaaaactttacatcggatttaaacacagcctgaatcaacagatggcctatgcatgcagcaatcaatcatgcagttttgtatatatattcttaattattccgtacaattgagcaatgtgcatgcccggaattgcatgcagtgtacagccagctaaatcctaaaaacgtttaattttgtgtgtacggcatcgaggactggttcacttaatcaaaagaactaattaattggttctgaagagactattatgccatcgatcagctagctggcatgtgatatatatatataattaattgcattaacaccttcacttgcaatagaagttagtcgtgatgcagttcgacaggatcaggtgcatgcatatgtcagtcaggtcagcctgacggaattcagttcaacggggggattgagttgttgaaagatgatgaacaacgctgaaggatcgtatccggcgttacctacgcctgatggaccataatcttttcatttatatttatacttatacttataagctataattcgaatctttaaagctaaatttaaagttgattttaaatgttttttcattatagtttatttttttaacctttgcttttagatcgctaagaacacatataaaagttttattaagaaatcatttttcatttgtaaataagccaaacgatggagtctttagtgtactaaaatttgaattttacccttattaatttcaaagttaactttgtagttttagtttattttataacatttatttttttattgctaaggacacgtgtaaaaaattttacccataaattattttttggttactaataaatgatatataagtataaatgatgtggtactaatgtatggctgcatgtgcctaaggtctgtttgggccaccgaattgaggattgttgtcgagtcaaattatttagggaaatcaaaagcttttgcacaggtaggacaattggtctgctatcacgaatgttcttcgcttggatcattgtggaaacaaaatctttagggtggataacctagccatctaggttggtcccatctcagcttgttgatcgtatagggctacagttccaaattggcaaatcctgtcgcaatttccaggggatccaatccctttcatacagtgtttggagagctaatgacagtatgaaggaaaaggatcaaataaactttgttggaaaaacggtacggcgccgtatttctagacagggctagtgtgaattttgggagctagggtttttgtttgcaagtgttgtgtacaatgcaaaatggacattttatccaaattggtaattaaactattagtatgtgagtcgttggtctgtgtatgacaatataaaccagggtttgaactaatgtactaatggtcttggtaaacctaaatatgtacgtgtgtggtcttggacaagatatatatatatatatatatatatatatatgtgtgtgtgtgtgtgtatgtgtaagcggtcagaagaaaagtcaaatgagtatttgagactgagcaacatggttacgacttggataacactataaaaaacgatttagtacaccgttaaagacgaacaataattggtcgcatatgtaaaaatcgacctctattttcacacctatatacaaaaatctatttttgaaggcgagcatcttaagaggccgcatataaaattgagcttattttcacgggcagtcgtcttaagggactgtatacaaaaatatattttcgcatacgggccttaagtggtccgcatgcgaaaatacccccctcttctccacagttttttctcccctcccctcatgatattttcctcaccttcctctctttatctcctctcctctcctctcctttaagtgggagctggcggcggtgggcagcggcgccaatgaggaggtggccgggagcggacggtgggcggtgcccccgccgccggcgccatccccgtccccacctggcgccagcgacgaggaggcgggcggctctatccctagcaccatcgctgcagacgacggcgaggcagctcgctgtaaaaaccggatcctcgccgccgcctccattagaagctagggtttcaatttttctttttttgagatttttattttttatgcggccgacataagcactcacatgcaaaaacaacgattttccatgtggtttcgccacccgtatacgaaccacacaaaaaaaataggtttttgtcgcatggaaaaaaaagcttttttatatagtgtaaagagggtaattatagggttcagcaagatactgataaatatttaatcactcttgaaaacaagcctatttgaatagagccagaattgaggcggataggaacaatgccttaattataagggagaaattgaatgcatctgtttttattccagaatctctaatagtctactccacataagggttaacttggagataatatggctagagtgtcaacttataagctgactttcaccaaaccaagggaagggagaaattgaatacattttttttactccacagaaggttgtactctacacaggtagcccaatgagctctgcccttccccgatgctcacctctcttcctctccccatcccctccctctctatacgctttgacggcgacatgatggctgtagctgcgtgcaggcttgtcttgctctgctccggtggagagaggaggcctcgtcggcggccgagacgagagggacaagaaggaaattaaaatggaggaaggaggtggatgggaccatgaactgtggctcaggaaaaaggagtggaggtgcgtgttcccctccagggggtcacgcctccctccaaggatgctgctcggggacgggagatcgacggtgtgagtgaaggcatgagccagggctacctgttgtacatggcctaacagttagacagttcttgggctagcccatacagagtgaagcctctatcaccaatgtgttggccctcattgtgagtaaaacctacatgctcactaaattcaaatgctccccaaaagaacaaggtctaaacaaaaaagcaaaaatgttaatattctttggtaagatctgttaagtatgtaggaaagaaatctatagctagtctgtatattcttccaaggatatgcacatcatgtcatttttttttacagttgcaacgtaaacacaatttgctagttatataaaaaatacattagttctatgaatttatggctattatttgtctatcattgaaggcctcatgcataatcgataatttaggaaacatatataatcctatatacctgtacaaatcatccccactactacaattctctgcttcctggtgcttccatgtcaccctttttatccccaccgttggataagcatcgagcgcttccttccatccgcatcgctcctctcctcccctctcccgcatcgctactcgccggccccacctcctctcccgcatcgctcccctcctctcctctcccgcatcgcgctgctccgccggcccacacgcatcgactcccctctcttgcatcgctcctcccctctctcgcatctcacgccgccgcacccccccccgcatccccgccgcaccgcatccacgccacatcccgcttcgcctcctcctcttgcgccactctacaccacggttccgcttcacctccccttctatgccttgccacgtcgcacgcgaggtccgcttccccccttcccccctcagcgccacccagccctcgcttctgcgacccacaccgccccaacgacagttgcctctccttctcccgcgccgttccgattccatatccgagagaagcgaaacgaccgccgcccactaaaaccagacttcatcagcgtcatcaagacattaattttgtttgctcataatgccatggcgatatcgttgcggcccttcgcttatattgccaatgaaattctgcaatctacctccaccaactgcttcgtttcatctgaatctccattgcataggtacatattattggatttattcggagtacaatgatcttctgataggttttttcatcagtttgaatctttcatgtctacagaagggcatttgtttatgtggtaccgacggccttccttttgaatttgttctgtggctcctgtggattttcattcaggaaagataaatctggtacgtgccttttctcccttatgctttcacccggcttttgtttctttctactcttgatgatgaatgctcaatttgacctattatctttttgtaagttcaacaattgtttacaagataagttcagtttgattttattcggttatagacacctatttatttcgacttataggattcgttggtttatgctctcgggtagaatggataatacgataggttcttctcaaccaattatacgtcgtcgtggtcgaccacgccggcagccttctaatatcccgatcccacatcctaatcaaactgttgctgctgaatctcgacgtaggcgtaggcaagttatcgatgcaaataggaacagaggtttgttagaagattaacattcctacaagttgtcagtattttatgcagacaaaaaaaatgactcacattatcaatttcatcatttttccctagcatcaacctctgcagatcaacgaatattatgcccacggttaattggtgaatcttctaattctaatcatatagcacaaaatgaaccccctattcatattggttcatctacatccaatcaatcattcaatcacaggcgtaagttgtcttttctactcctaggatctaaccactttaaggtatccatttgctgtaaagattccttcacatataccatgacacacctttcaggcactatatttgaaccattgaatcttggtggtccacatcattcttgcagccactgtggtgcttttttttggtatgaggagtgaacacgtagagagagacatacttcaaatccatcaaataatttgtgttgcaaaggtgggagaatatggctgccaccctatcaacctcctccacagccattgttggatttattgacctcacaaaacagcactctttctaaccacttctttgatcatattcggcaatacaatagcatgtttgtaattacttcaatgggagctaaaattaatgagtccataaatgatggaagagcaccatatgttttcaaaattagtggtcaagtctgtcatcgaattggttctctgctcccaccacaaggtcatcgtccagaatatgcgcaattatatatttttgatacagaacatgagatctcaaaccggatcaatgttgcttcatcttcccgtgtcactttccatgctaatgaacaaattgttgcatccttgatagaaatgttgaatacaaataatcccattgttcaactattcagaacagcacatgaaagaatatccctagacgcatctgatcagttttgcataaggttatttggtaagctggatgcaaatggagatatttatagtgctccagtcgcttctgaagttgttggcctgattgttggtgatgttggatcagctgatgtagggcgagatattataatccaagatcgtgcatcacgtttgcagcgaatcaatgaaaatcactgcaagtttatggccatgcaatatccacttttgttcccatatggagaggatggttatcatgaaaacctcacatatcgtacaacagcatgcactcaatccatgcaacagaataaagttacaatgctagagtgctatgcatataggttgcatgataggccaggagacttcaatacaccgttacggtgtaaaagggtaacacaatcttatgaagtagattcttattgttgtgtcgaggggagccggatagcacattattgcacaccagccttccaaagtaaatatagatcatcaccattcaactcattgattaattctgtctcaagaggtattacatctggatcttctgttgggcaaaggataatattgccagcttcatttaccggaggacctcggtatttgtatcaaaattatcaagattctattgctatttgtagaaaatatggttgtcctgatctttttttgacattcacatcgaattctgcttagcctgaaattagagaagctttagcatcaattcctggccaacaattagcctgaaattagagaagctttagcatcaattcctggccaacaaccttccgatcgtcctgatattgtcaatagggttttcaaaatgaagctcaatattttaatggatgatataaagaagcacaatttttttggccctataaatgcaggtatcaaattttacattggtttccaaaagataaattttcctttctcttccttttgtagggttaaacatgcatgttaccaccatgcaacccttaaaacatatctttttaatgcagttatctatacaatcgaatttcagaaacgtggtttacctcatgttcacatcatcatatggttggccaaaacagaacccttagattccaagaagattgatcattatatttcagctcaattaccagatcctgcaattgaccaaataggatttgaggctgtatcttcttttatagtgcatggaccttgcggtcctcacaacacttcttcaatctgcatgtctgattgagccctgaaaaattattgtgcaacaattgatatggctagtattaagtatagcaaagaagtagaatctagtattaatatttggtggaacacataagagaatgacatacatgttcatccaataggatgccgtcaatgctgatgaggggatctgcagattttgatctcatgtttatagcatcccataatcttattagacgtccaaaaaccttgcagttttgctggccaacagatatatctttcaatgatgtagctaggttagccattgaggtaaatatgaaaaaacataataaagaaaaaatgaaacttaagtgaatatatgtactgagcaaaatatggaaattgaagtatagtaaaacattatatttacaaaactaacaacgaaaccaacctatgcatcacaatataccttatcagttcctgtttctatttattaggttgaataccttggaatatactacattgtgtgtgcaatttttataagaagtagggctgttctctattagaactttcaaaccattaggtgaagtcactctcgagaatgcatcatataattgaccatgggagaacacaggtgaaggtagatagactccaactctgctcaaggtctgtccttggctcttatttattgtcatagcatatgaaagacgtattggaaattgtcgacgccgcaatttgaagggccacttggattgagttgatgttgtaacaatgcgaggaatatatgcttttgtacctttcgcttttcctgtgattatttctccctctatcacacggcttgttagttgtgtgacaatgagcctagtcccattgcagagtcctcttgatggatctagattacacaaaagcattataggaacaccaattttcaagtgcagcacatgttctggaattccatttatagaaattgtgtttagaaactctgttggatatagtgcctctatagcagtacagttagtagaactgtcatcaattgaatctgagctataatatgacatctcactcgcttctaactgagcaatcattctattgtttatttctgaaaccacctcatttgtaggtgctaaaattgcacgctcacacatatatgatgtaagatttgatggttgacatcgtaagttgtagacaaaagaaatcaatccatctagattcctacagtctggtgatagaagaagggactgaggcatctctatgaacatgttcgttagttgctctgggacatcaacaaaaggttctgtgccatttcctattttcaaaagccaattagaaaattttcttaactcttctctatcttatgcagaaatagatgcagaggtaagcctcatattttcagttaactcaagaagtatgtgttgattccacaaataagagttaacaatgcatgatctcaaaatctgttgctttgtagcattttggatgactggtagtgtctgcttgaaatctccaccaagaactactgttataccaccaaattgtttgtctaatgaatttgggtttgtttcagacaatatatctcatagagttcgatccaatgactcaaatcaatatttatgattaacaggagcttcatcccacacaatgagagatgtttttttggatcagttcagctaaatttgtatttttctttatactgcacattgaatttttagagatttccaataggattttgaaacgggaatgaggtgttctcccacctggaagcagcaaggatgcaattcccgatgatgcaacagctaatgctatctttccctggcttcttatagaattaagcaaagttgtccataagaatgtttttttggttcctccatatccataaacaaagaaaatccgtccttcattattgatggcagaattataaatagcattaaaaacttccttctggctgttattcaaacctgaaatagcttcatctatagtggatggcatgttataaacatcgtagctgagctcatctagtataagtctattctgtgctgaaacacttccaatatcatctggtagtggcaaactaaaatgggataagtcatagccagcatctcttagcagtttatctaacttaatgagaagaacagatctaacataaggattggtgcagctgttggcctaagaagtgttgcggggcattcgatatgatatatcttcgctcatatatgattcatgttcactgaaaagtcttgtaggatttgttacctcacaaaagagtaacattgtaacaaaaagttgtcacagttgggatggtaaggcccattgagctgcatctttcaaagcatttgaccactcttggtcatcaccaaggagacctaatgcttcacatgctgcccgaaatgtaggatattcatgacctgatatagttctgatttcagcaaaggatctagggcccttaacgatgtgcagtagcattcgcagatagtaagcttctccttgtgaagggtttacataagcaatgcagccaattctacgttgagaaccacgacgatcatcccaatatttgccttgattgtgccacgtccaatgttcagggaattctatatatgtaagttgcctagcacattgatgcaaaaagaaagacctatatctaccagtgccagaactacattctccagtttaaacatgacacaagaattcaacccctggaatctagaggattaaccataccaaagttcttttttgacttctgcccatttgatgaagtcctagggaaaaatatcagttccaaacctctcataggtaatgctatctttaattccacattgaatcatacttattacacttcacattcttttggcttattcctccagattttttttgaatgaatattcctccagatttgattggagtaatcaatcatattggtccgtatgattttgcgagaattaaaattcaaaacttagagtacgtaccttttccaaacctgatcgttaaaatcaatgctctcattaattacttttgtgtaatctcagcaattgtttatatgcaacatttttgcagggaacagactcaagatgtcctactctggggacaatatggagaatcattcaacgaagatgcaacactccataaatcaaaggatggaattgtaatagccatctttgttggccttactgcaggaaaattttcaggttcattctttcacccaaacaaatgccctctcatacaaagaatgcagaacatttcaacttcactttcacctgcagctataacagaagcatcttcaagctctgctactgaaatatatattgacctggacacacctcaagttagagagtttcgcactaggtaattctctttaacccattcaaaccatttgcacttgaatattcctgttcaatatgtattatatttcacgtcaaaaaatgccaacctatctctttgcaatttgaagctactaatgggaacgtccaactcttgagcaacaactccctaaggttatacgtttaaccccgatccaagcagcaggaaaaatgtacaccttaagtgagatatcagctatgcctatttctgcctttcaggtacaactcaatacaaaagaaaaaaaaactatattgttattaccatgccatggattcctttcgccaagatttaatactttttattacataagggtggagctacatacagtgctactgcaaaaataactgccatactgtcatcaattaaatggtattacataggatgccatcgttgtgataaagggtacaacaataattctgattcaccaagatgtgcttgcgaagtttcattccgcaaaccaatgtacaatctcctactcttatacattcattcgaagaactaaaatagtttactgtaacgctaaccactctagatgtatctaactaatgtacaatgcttcaggtacaaactccttgtcacgattacagataaatcagggagtttagatgcagtagcattttcttttgttgctgaagatttggtagagcttgatgcagcccaagcttcccaaaacatgaagatagacccggccgatcatccaacagcactcaataatgccattggtaaaacaaaaatttttgctatagggatgaatactgatacatcttctaagttccctatcagctatgtgcttaagaagagtttcacaattgagcctactatgtcggtccctatgctcacagatagagaggttagtaaatactactgttccatattacttcagatatcctgttccatattacttcaaatatttcaaactaattaaattaaaatataaaactaatcaagcctttgaagaacaaagaggtactacagcttccaccacctgcaccacatacagataacccaaggtttgttgttctatcaaatgttctattcattacatttgtacaacaccataatttttttagataaaggattttcattaaaacccagcctctacatcacattggatatatagtactaactgctgatgccaaataaatttcagcacaactattcataatacaggagcatcaagcaaaagtacacctcctgaaatatctttggctgataaaactccaactgaaaaaaccaggtaaatatacaaaaaaaattatgcttaataaaatcattcatatgattattatccattactgcagctcaaccagaaagagagccattgatttcactaaagactccattgaggaaaccagaaggtatattttataaccccatttatattgccttttctgattaacaaatatcaactcacaaccaaccttggaacatttttccttttacactaccaaaaaactagatctccctgttctcaaacattacaaagaagggcatgtactactttggaaaaaacatagaataacataactcaactataatactgactacaatatttttggaactatttcatgcagcaaaaaactacaacatacagagggaaaagctgattttcctgaagactcctttgagggaaccaaaggttatacattattttataacaccacacatttcattatttttatattgatttttgtgatagataaatccactcatgacttacaatacttttgcctttaacactaactgcaatatcttatgaaccactccaaacagcatagagctacaaactgcattgcataccaatctgcctgaccaatctacataataaaaatggtacttattcttcacattcctaaagatttacttcattatcttacaagcacatccctgttgtactactaatatattctccaacacaaaatacaggtgaacacatgctgtctgacctacggtgatttcactatggggaagacttattatattttccttccatatgaagacttcattatgtcatatgcataagacttgctatattttattagggtcccattctgttctccatcttgcagctatagcattatctgtactacaattctataatatcagtactcctcgattacaaaaacatataagagatttcccatattttcagaatgtgtttgttcatattatcacccttttcgaaattacatagttcggtattactttttgcactcatatcccgtagcaacgcgcggggtatcttctagttatgaagtgttttttgctatgatgtatcaattgaaggacaaactatttttatgaaataaaagaaggcctgaatagtaggatggaacacagtaaaatgcctcattttcacccacaaggacatatcgggttctgaactgaaacatagtgtgatctctaagcagtgttgtgatggaaacaatagactataccagctatagcaacaaaaaccctacagtcacttgatgtacacaggaggttcaacgtccgatggaatggttactgacagggcctgattttagcacgatctctaacatttatatatatatatatatatatatatatatatatatatatatatatatatatatatatatatatatatatatacactagaatttatgttcaagaaggaggcagcaagcattatccatgggtatctctcaaatatcaaaaagcagaataaatattactgaaaagctaaccaattgaactactattggacttatatttccttgagcacatggcactcttcttctgaattatgtaaaaacaaaggaaaaaaatattctgccaatgagatgaaatataaccccacacaaaaggttcaatgtcttgccccttgatcttcctttaaaatggagtcttaagttcttcgttatggcaaaagatggtaccttaagttgtagaagtaaatgttaagggctaaaaacaatgactcagtccttgtccagttcatgttgattgccgagtatttatacatatggaccatatatatggtcattgacagagagtaaccaacactgcctgaattccatgttatttggtgattcttatgggaatggcagaaggagaaagtgaggaacagagtacctttttaattcacttcttttacctctctgccttcctttctcgattgaaatagacataggaggtatcagagaacatgttctgccggcagggacaatgtcaggatcagcgattgcttcgcttcatgcatgattcgcttcagtcttctcttggcatgtcagtatgactagtcctgacttaggctccgcgctgtttcagaagacggcaaaaccagattgagcaatccttgttagctttggccaaggatgcaaagaactcgcggagcagcaaacttacgcgagcagcgaactcaagcgatggcacacacgcacaagtggcaaattgtagtggacacgacaatggcgacgcacgcgcactcagcttttctctctatggctcaatggagataaacacaaagaagtgcacacacacaggtttttgtagcaattaacaaatgactgaaaccttttctctgttattacaaactgatgattacacggcttatgtagccttgcagacatgcatacacagctaacagcccggctgggtcgcccgcacgaccatgcatgagccactcattcatccgatcggcgcgtctcacgcgcaagaatcgctcctctgagctgactgaaccacgccacaacgtgctccactaatcttgcatgcaactatctaacttgccactaagacccggtttaaatgggactaaaacttttaagtccctgtcacatcggatgtttggacactaattataaatattaaacgtagactattaataaaacccatccataatcttggactaattcgcgagacgaattattgagtctaattaatccatgattagcctatgtgatgctaggctaatcatggattaattaggcttaaaaaatttgtctcgcaaattacctttcatttatataattagttttgtaagtagtctatatttaatgctctaaattagtgtctaaatacagagactaaagttaagtccgtggatacaaacaccacctaatcctcttattccctagactttcagttgctagttgtgctgcaacacatatacannnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32386 - DNA, 12586 bp, Oryza sativa
  unsure (1)..(12586): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagttcctatggattcattcactgtagcagcctttgatttgtaggaattggtcataggaaaactgaaggaaatattccttcgttgctgattctatgggagaaacacaggaaacttcctatctagtctgagctcatttttcacttgctttgcgtaggatcgaggcaatcaagctcctaatctctttcttcagagcaggagaacaagcaatgaatggataaaatttgtgttggatgcagtgtatttattagaaatggaaaatgggcctaagttcttaagtaaatatttctgtgtttttcctatacccaattcaaacgcattgtttacattcctctattttacacgtgaattcctattctatttttgtgttttttctattcctgtattttttcaatccaatgtttcaaagagaccctaaattaattaacagatggattctccagactaattaagcttctcctcaacgaaatatacaaattcactagggtggaatttagtatatctgggcctttcgtgttaactagattaaaggtcaaattacactagtccatttttgttaacaacctccttcactgaattcaaaacaatgatagttctcaatacaacttggaagtgtttaggcctgtttggggagtttctaatagctgcagcttctcctagaatctccagttgccagaagctcccccaaacagttcaagtttttactcagattctgagaatctgtagttgtaaaatctggaaaatgaactagaagtcacctaacttctcagtagctacttctcagaatcttaagttctcccaaacaggccttttagctaggacgaggtagaataaaggtgtggatacaagctactaaaaagagactagagtgttctgaaagctccagtagaggaactagcaagagaggaagatcgacgaggttcagactgaaccaggtcaccactacccactgctgccgtggccgaagccgccgatgcttgtttgattcgttcgatgccttccaatcaacgttgctgctattttttatctcccttcaaggatttttgggccgggcttggaatatggctaacatagcccatgtgtggttcaattgagtttctaacaatcctctctttttaaaatttggcttgtccacaagccgatgcaaataattgccaatgccatcaggatcccatgctatttgaagttatttggtagaagtagtgaacctgtcatcagtaataagattcaaagtctagggcatcattgcatggagtagattcactgcactatttctcttcttgtagtcactcagaccctctgtaataccccgtatattaaaagatattttgaatttttttagtttgggttgacttgttaaaatagagatgttaacataaataaataaaagaaaaatatctttagaagtgggccaacatgagaaggcccataaacccaacccattagttctctcctacaacctagagagaggggaaccgaatcccacctcccctcttggtgccaccatccctctccttggccggcctccaaggacgcctccttcctcccctcctcctatgtttgcatctctcccctctacagcaaattgccctcatagatctccaacctaagaacctggatcaagaagcgaagtgtaaaaacggaacgaggagaatagatctccagcccaagaacctggatcaagaagtgaagtgtaaaaacggaacgaggagaaggagaggagtaggaggggttagatcagagtctcccctattgtctcctcacaagttctctaacgaaaccctaggtgaggcttttctccttgttgtatagttgttctagcatggctttagtgttttaatttgtggttagagaaggctagagaaggagtttgggttgttgcagtttggtttgttacagttctgcatgtgggcagatttgcagtgcttcagttttttgatgtttcggggctctaaatgttatttcctgcaaaagtgtataactagaaagttgtagataatatttggatttatcttctaaccaaagggcgcgattttatctcaagtggtttaggagatataatatttttagtatgactattgtttttatgtcataatctggatagtagtagattgaactgtttatggaggggttaaacagcaaaatcagtcaggctgcctatagacaaagctgtagagttttccccaagctttccatattggtaaaatacacttttatcggatgattagaactccagatatagtttgttttgtatgtaccctctgaaattttggacagattctgaagcttgctttcaagcgcaaattagaccatttaaatggcagaataaaaatatgctttctacataaaagttgtaggtattgttccgtagattttcaaaatgtatatattttcagtcatagtcttttcatatttcaagatataaaggtttaaagcagcaatcttgtgtacagtccaagcggcgttccttgtattgcgttttaacgggatggggcagtaggttcacctttttattgttttatatgcatgtttgaatgtgtttgcttaggttttgtttgtgattaggttgtgatccttcagatcgtgtatgataccaacccttcattggaggtaagtgcatgacgaactaattgtgtgattcttggagtgattgctctatctatttattttcattatatttatgtgtgatatgtgattacatatgttcagattgttcatgctatttagatttcgagttcatcttatgtttacgatgttattcttgtttgatagtccggattctggttctgattaaataattcaagttccatgtttgccatggatgtgtaatatggtttcaatttggttctttgtttccggtttcaattattcatgtttcatgcgagccatgtgctatctagttttgtattcatgttcatgtgggtaagcgctgatcacgcttacttggctttgtcggcaaatgctaggatgtattcactattgtccgggatggaaactactatttcaattcatgcctacccgggatgggaactactatcttctttgacttggtgtttgaaaatgtgtttcctatcaaagaaagaaagcattctgttcatgctttattgccaatgatgtgtatatgtgttttctagtttcatattgtacttgctgagtatttttatactcactcttgtgttttatttggttttaggtacgcattgagaccgacatgcatgggcgggaagtagctcccttatatatacatttatctgcacactatcaacctatattgcctaggtccataatgacacttaaactatatcatggtccagtcttataataatcttttagatatcttttagtttctttccatggattatatgcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccagttcaaatgagtacattacaagttcataggagtacattacatcacaggctaagtggttaacagaatactgaaacatcagtttcacaaaagtacagcattctggaataaagacaacagtacaacacaaaggtcatcaagaattctggatagtggatactaaattactaatatgaggcaatattgcaatcttcatttcttctagtcatcaatcatcggtctaagagacaaagggagagggagagggtgacttatcagaatcagaagtctgcattggaataccatcatcacaatcttctgagtcggatgatggagcttcaggatgcactggggcattgcgcatcaaagactgtaggcttctgactttcctcttcttagcgtgcacaggccttttccttttagctggtgctggtgcttgtggtgttgtgtgctgctgtgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaacgctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgctgcataaacattacacaaattacaacaaaaatgatattcagcaataaaattaagttcacatgttgagatctgaacctggattgaaatttttgttctttcgctgccttacggcaatttcgtgtccaaaactcccatgctgatcttgatacaagttgagttcttcaattattttgtcttggatatcttcatcatcaatcaacttgtcaatacaggaaatcacacctgctctaaatgatccatcactctcgatctcttgcttatttgggaagtagtagtaggggttcaaatagtacccagccaggtgtagtggagccttgatcttgttgtcccatcttttatcaatgatatcccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatctgatcactttgctggctttcttccccttggcctgcttcaagtaacccaattgctccatctcatctgatttaaatagtcttactaactcttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcatatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgccatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccattgacatatgtactcacaagttctattcctcctctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttccttttcactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcgaaacaagcaaacgagagatctcagggagtaagaaaataattcacatatagtaagatctacatcataaggcaagtatctgaaattagaggtaacaaatatggacaacttgttcacatattgtaagatctgcaacatacaagcaaaaaagagaggaggatgtgagaactgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgcttgaagcagcagccggcgccggtcgcctccacgagccgcttgcgttggtcgatccgcttgaagccaccgccgccgccggacgcctctgcgccactgccgccggccgcctccacttgtcttgcagctggagagtgagcgcttcgaagttggaatggatagtgtgctgctgggagcttacgagctagggtttgcagcactttacccacctctcgactctggtctagttgggccggtttcctcttgggccagaccggccgcgttttacaatttagctacgctaaattacggccagtttagcggctattgccggctaaattgcgctattagcgtcccgctattcttagcgctaaaaactgcatctcttagctccgtccgttcccagcagctatctccggctatagcggcagctatagccggagatttaaaactttgattatatggatggatagcgctatgggaatgatgttattattagtttaatctataattgcatgtcgtggatgttcgtatttataagagagactctttcaaaatttttaatgagtttaggacttagtggtttctgtaccgtagtgtgtagcattctaggggcctgtttggtagggctccaactacaaactcctagctctgaactccaactccagttggagctagcccctattggagctggaggtacccctgaaagtgataattaccttggggaggatggggaaagatatttatatcggttcgcaatgcattaaataacacggttgtgtcatgcattgatccaggttgtccaatagatgcatagataaatctcatatcatgatcacaaatagccatcacattttgagtggttgatttagatctaccaatatatctgatcttctcttcatctggaacaactgcaaggatatgagtaccatcaactgtcccaatgcaatctttgaaatgtggccacatacgacgatccttcctaattctatcatggacagtaggaaagtttggatcctttggatgcacaatatcatgtcccaactccacaacagcaaacaatacttcttcaaattttcttgatattgtctcaccagaatgcttaaaacgattttgtgccctttggtttgatgaaccgtcacctagaatgtacagaaaaattgcaagtgcctccattgtgtgcatgtgtacagtaggtgccctttgcagcaaattgctcaataacttcgtcatacctagaattggataaatgggtatttggacgattacccacaactacttgatcagcaaaaatctcacacacaactctagtgttgtagtcattccaatcaacagagtcaattggcattttaacactcttcgatagcacattttgagccatgcctgccatccattcacaccatagtttcaaaaatttaggtcaatgttcagaattactagtatagtttcacataatatgttcaagccaggttatactacatttatacaccaagaacttttggccaaattatatatgaatgaaccctgaagtggacaccttttttcccttagtacaattatatgcatcaatctgaaagtcatagaaccaaggaacagcttgtaataaatcaagcatacaaaccaatataggtacctacattatcctctcacactgcaagagaaatatagaacatatgaacatatttatccagtagatcagagtctacaagtccatgtaacacaagattgagcggttacgaagcaatcatcaacccaaaagataaatccatctcacaaaaattatgcataaaactgtctcacagaaaacatgcataaatccatctcacagaaaacatgcacatttgaaggaaaggtttggaaaggatttctagggtttgaggaggggataccgtgtggggctgaggtgtcaggactcagcctggaaatgagatgcaacaaactgaaactctgaatactctgaactttttgaatgtttgagttatctgaagatttgaggaggagatgtagactttcgggaggattatgaagatccaacaacaaacaaaccaagcgaagcgatatcacgaaatcctagccattaatcgatgtcggggaccactgttctggtcattcttttgtctttttcctacttttgagctgtctgatgcttgagagctaagactacctcactttgtataaaaacgaattgcatctgagaatgaaagagatatcaaaactcgcaattatcttatcttaggaagtaatctagatttaggaaccctagtttaggtccttgcggcgcacaccaaatacgttttattctctaaaattgggttccatttctagtaaaatctgtctccgatcttgacaaaggtatcagagctcagctctttccctggctctcaaatttggaaggcgcaggttggtggcgatctgtggatttgctgccgtaaaatcccgacgccggaagaattcgatctggaggcgaagaagggtctcgatctttggagaagggttggcaggaggctgtaaaatccccggatccaaatcctcgagacgggcggcggtagaccagttctatgaggcaatacagggagggagaaatcctgagctgtcctcacagatcgaaggaaactttatgtatggtaaacaagactcgatcgcacgggtcgctggtaggtatggaggagatgaacgaagtgaggttggagctggctgggatgaaggacattgctgatctgaagaatctcaagtcagaggtaagggaggtcaagaaattgttgcaggaactttgcaagcagaagggaactgatgcagggaattcagagacagaaggaggcactgttggtggaaatcctgaagcaagtgcaggtgatgctgcaggaaccagtgaactgtgagatagaggtatacccaggtccaccttcaccacttctgccgtgtttgagatagtacctcccacttcttctgtgccacagtggagccaatctataccctgttctatgcctgatccacagttggggcagcatttttctaccacacgtcccacagtgcccccacacatgtttccacagtttagtactgcaaaccatgagtcccaacaggtaaacaatcagtttttccatactaggatcccacagtttcagcctagagcagaaatgtatcatgaacagatgtaggggaaccatagagtaaggatgtttgatgagcagaggaatcagtatgtagggcaacatggagaagcaaatcattatgctgaagctatactaaaaggacccaggttggaaataccttttttcaatggtgatgaccctattgactggttgaagcagtgtgagaagttctttgagttgactggaactccaatagaccaatgggtcaatatgtctctagcacattttcagggaagagctgcaatgtggtttaggggagttggattaccttggcaagtcatatcttggccacaatggtgtgccatgatttgtacgcggttttctgcagctaatgttcatgaagcggtggagttattccaaaatgtcaagcaatatggaatgaccgtggagcagtatatagacaaatttgaggagtatgtggacttggtgaggagagatcacccttacctgcaagaacagtatatcacaagctgttttattgggggtcttagaaatgacattaagcatgatgtgtgtgggcagaagccacaggttttgcttgagtcttacaggtatgcgaaaacatatgagaaagctgctcttgctaagaaagctacttatggggttaacagaaatatgagtaaaggatttaatgctggagggcagggcagaaatcagactaacaggaatcagcccagaaatgaaggggaaagaaaggaggagaaaaactattggttctgtaaagaaccttggttgccaaaacatcaatgcaaagtaaaacaagcactacatgctttgttagttgaggggaatgaagaggaaggcaccactgaagaaactactgaacatgaatccaatgaggaagatgaagggaaaaaccaaactgatgataaaggaaaaactaaagaggtgatgtgtgtatcactgaatgctatccatggtacaactagacctgacactttttcagtgatgattcagattaatgggagtaaaatagttggtttaattgatagtgggagcaccagtactttcatggatctagatttgctattaagaaccactgtccattgataacttcagaagtcaaaagagtggtagtagcaggagggggtgagttgaaatcttaagttcaggttctagacatattgtatgagatatagggaaggcaattctgcaactctttcaacttaatttcactcaaggggtatgatatcatattaggagcagattggatttatcaacacagtcccataatacttgatctgaagcaaaggatgcttgaaattaccattggaaccaataaggtcattttacaggactttactaaacctggaaaacatctcctaattaacagcaaaaagatggagaaaacagtgagaaaaggggcagtgggatgtgtattccaactctgtgaagtcatagaggaagaagcagggccaatacctttggagattcaaaaggtcatttaccagttcccttaagtactgcaagaaccaaagggactaccacctaacaggccttgtggtcatgtcatcactttgaaggctggtgccataccaccaaatttgagaccatacagagtccctcattaccaaaaataagctatggaaaatatcatcacagagctggtggaatctaaagagatacatgagagtgatagtccatatgcctcacctgctgtaatggttaggaagaaggatggctcttggagattgggtgttgattatagagaattaaactcccaaacagtcaagaacaaatttccaatgccaatcattgaagatctgttggatgaacttcatggtgctaaaatattttcaaaactttgacttaaggtcggggtatcatcaaattaggatgaatgagaaagatgtgcacaaaactgctttcaggacgcatatgggacactatgaatatcaagttatgccttttgggttaactaatgcccctgcaacctttcaatctcttatgaaccaagtactccggccatttttgaggaaatttgtgctcgtgttcttcgatgacattctaatttacagtcagaaccaggaagaacaccttgaacacttgaaattggtgatgcaagtgttggaagaaaataacctagtaatcaggttgaagaagtgtgcttttggactgtctgaagtagcttatctagtacatattatttcaaagaaaggggtggctacagatcccaggaaggtggataaaattacagggtggtctattcctactgatgtcactgaactcagaaagtttttggggatgacagggtactataggaggtttattaaaggctatgggttgatttgtaggccaatgcatgatatgctcaagaaacagggacttcagtggggacctgagcaaactgctgcttttaatgagctgaagaacaagatggtgtccagtccagttctggctatgcctgactttaataaggagtttgttatcgaagctgatgcttgtggcacaggcataggagctgtg

SEQ ID NO: 32387 - DNA, 286 bp, Oryza sativa
gtttgcaagtgttgtgtacaatgcaaaatggacattttatccaaattggtaattaaactattagtatgtgagtcgttggtctgtgtatgacaatataaaccagggtttgaactaatgtactaatggtcttggtaaacctaaatatgtacgtgtgtggtcttggacaagatatatatatatatatatatatatatatatatatatatatatatatatatatatatatatatatatatatatatatatatatatatatatatatatatatatgtgtgtgtgtgtgtgt

SEQ ID NO: 32388 - DNA, 6199 bp, Oryza sativa
  unsure (1)..(6199): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttactgaagaggggaaggattgagcaagaatgagtacaaccacagtactcagcaagccacaccggcagatgcatgattaatgcaaaggggtacaaggggtaataatataggggttaagttttgcagaaaagcagcatttaaaagtcacttagttgcccaaagccattttataaagacgatcctagagctacacagtattattaaacaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcttagccataaacaagagtaccgacccaacccccctacggccggaacctccgggacaggtaggcaggatcgagccccctagcagcagggcaccaaccctctgcaatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaatcagcgaagcatctacctaaattcatactagtggaaccatgaatagaatacccactagttggggttttgtttaatctagggtgaacaaggtaataatatcaataacaataatattaaggtcataacaaaggtaaataggcatggctaaataaaacagtgatcacgcgggaatttaaataaagcgataatgcaataatttaaatcaaaataattttataaactgggattcaacatgttcaaggatgatgtgacttgccttgctcgctttcccaaccgacggcttcgacttccacgaagagcggatcttccgaagctgcagcgtctacacgaccaacggaaaagaaaaaggcttttactctaatgaactccacataacagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggccccacctggcagccgcggggcgcgcccgaaggcggcctcgccggcacggccgacgggaggcggcgcacccgcgccccgatggtcgccgccggcgaccaacggcgcggcggagcggcacccgagagagaggagggaagggggaagcgaacggagcggtccacggctcaccccggtcgacggcgacgacgggaacggcgaccgaaacggaggaaggcggcggcgcggctcgggacgacgaggacgacggcgttccggcggtcggcgagcgaaatggaggagcggacggggtcggcgacgacgcggcgaagccgaaggaggcgacgccgagtcgggaggaagtccggagcgacgacggcggcgaaccggagctcggcggtgacggcggagagagaggaggacggcgcgagcacgaatccgacggcgagagcgagcggcgagcggcggaaacggaagagcggagctcggggaacgaatatatagcaacgggagggggagaacacggccggagagagaggaatcggccgcggagatctcggccgccattgatgacgccggcgacgattacgggaacgatttcaaacggatccgagggagagagagagggaaaagcgggggaaagcggagagggaatcacggggaatattttccccctctttatggcgcgcggggacggcgggaggcggcgagattcgcggcggcggcggcgctagggcatgggcgagcggcgggagcggcgggaggaaggcgatgacaggtgggccccacccgtcagcgagggtggcgggcgggcccgcctgtcagcggcgcgcgcgcagggaggagccgatgggccgcgggggagaggagagagagggagggagagttgggccgagccggcccaagaaggaaaaaggggggggaaaaagacttcttttagggtttttctttttataaaccttttcaactttgtttatttcttttcaattattatttgtgctctgaaaattccactaaaatttgagggctcctttttgaccaaggggaatttaacaaaaattctccgggccacatttgaatttttcttgtatgtattttagtgttttccaatttcttttcgaattttaattaattctattattccttttagcgaatgatttttatttcgggatgaatttatcaggacgtgacagcggcggcatcgggatcggcatcggaggagagggcagcgacggcggcagaatagagagcggtggcggcggcggtgacggagagcgtgagagggcagggcggggcgagcccacgttgaaggtgtaaagaagtgaggagaagagggcgaggagagctggagagaggagaggaacagagcggaggaggccaaggcgaaggagccaccacttttgtcatgtggcatcgggagcaagtgcggcggccgcagagggacacggcagcggccggagcagcacggtagaggagaagggaggctgcggcggtgacggcgatggcgcttgcgagcggaggaggtgggcgtctgggcgccggatccgccagcgaggagaccggggtcaccggatccggcggccccggcctcctcactgggagatccggcggctcattgggatggagcggcggcggcagcacggtagaggagagggagctgcggcggcgacggcgcacgcgagaggaggaagcggcgacggcgcacgcgaggggagaggcggacgaaccgacgcgcgtggggagaggagaggacgggcggctagggtttgtaccggttcgcgaaatccaggccgtccgtccacaatccaacgatcgcacgggcgtggaagggccggcatagcgggacacgtggacggccagatcgaccctacggcgagatcggacggtggatagcagcggggaccggtgcataattaaccgaatggggaagggtttttttgcaaaaatcgatgacgtggcgcccctaatcttctagcgttcccacgacgtttaagtaaacctatatgctatgaccatatatgattgtttatttataatagcatgaagatccacgccaagaatttgtcacaattcacaagacactacgtgtaacacgctagttggttcccctggatatatagcctcaaggtcatcctcacttcataagaaacggcaaaaagtaaaccgccactaattaatttcttcaactaattagataattaattaagtttgtaaagctattaggtgtctaacagtaactgtatagagtaatagtaatgtgtacaacaatttaaataataaaaatatggtttggcatttgattttcaatgagatgttttctatttcctttaattctgcggaggctatgactggtgggtccaacatgtaataactttatacaatatttctatttttttaattgtatacatgttttcagaagaattgcaaaaatatacccttacatgttttttaattatatacatgccgtaggctaaaaacgtgtggtcgagtgtttgacgcggtggaaatatgtgggaccgatggcactaagtcggtcctgcgggctggctacgcggtaccgcacaattccgcgggctggcaatgcgacactggccaagatgcaaagaaatacaacgtgcatgcatgaggctcggtcgcgtgcagccgtctcgcggtgccgcttggctgacccgtgggaccgacgcggtactattcatccacaatgcaggattattccgcctaatagtcccgcaccttcgcgctgtgccaaacaaccagtcccgcatttccattccacggcacacgtatatttttgcaattttttttcaaaagcatgtatataactgtaaaaacgctaaagttaatgtatattttcaattttttcttgaaaatagtcaatatgaatgaatttgattttcttaaaatatacaatggtttaaacagatcatatattggatatataatatataatcatttaaagtttgcttatttatttataaagactacaaagatcaattcgtatttgagaatgtgtgtatggaacatgcaaaaaattctttattaccataaaagtgcactaaatatcttctaactacaaaataaaaaaaagcaggggaaggaaaggtgcatgtgtacatgcgggagcccagggagaggatttcggatttttgtttttggttagatctagtggtctagatgaatcagttttgttagaaactatcttaccatcggtgtatcttttaacttttttttagataaagagagttttattgatcttaaacaattacatcgagaggatacaatttttctaagaccaccctcggcctctgcatagctaggatgcacatagactatcaatatttgttgtgccacatggccacttgtaactaccgtaggaaaaaaaaacatgcacttgtgggtcctcgtcttcttttgttgtgccacatggcagcttgagaacattttagaaagccacgtggcggcttgagagcgtttttaggaagtttaatggacttttagtatataatagatagatataagtttttgatcctttacattttcctgtaattatttgagcctcaattataggatgagtcagttgtgtaacaatgaggcgggttccattacataagccctttggtggatctagattcctaagaagcatcatggagacactaatcttaagttgtaaatgatgatccggcaaaccactcatgtgtactgtattaaggaattctggaggataaagagactacacattgcagtagtttggtgtggcatcatcaatgctatcaaagctatagtaggacatttcttaagtggctatctggttaataatttgtgcatttatagcagcagcaatctcatttgttggtgccaaaatcgcacgctcacataagtagcttggtagctacgatacatgtggtattgaaccatacacaaaagaaatcaaacctgcaaagttcctttcttcagccggtagtaagagatatgatggaatttccacctagctggtgtccggtcgatcagcgggtgcactatcatggacagcaccatcacccaaagatagaagccatgttgcaaacaactcaagctcagacctgtcttgatgagaaaaggttggacaagaaaaggttggacaattgagcctcatgttttcagttaattgaagcaccacacaattttccataagtgggagcgagtgatcgaggcattcaggatttgttgctttcttgcattaggaataattggtagagggctgcaggaa

SEQ ID NO: 32389 - DNA, 8585 bp, Oryza sativa
gatgggtgttcttcttaatacgcacacatagaatcatcttggatgtgtagaggaattctaaagcatgaatgtggtgtacggcctcctggaagtaataaagctgctataccagaggatgccactgccaaggctattttccctttgtttctaatgctgcccaacagagcattccatagaaatgtcttccctgttccaccatatccataaataaaaaaaatatttgtccagaattattcaaaactgagcattctatggcattgcaaacacgcatctgattgggatttaattaattgagctgttcattcacctcagttgttccataagcaagttcatccattataagcctactctccaatggtggaaaagcaagatggcttagccgcggtaactgaaagtgatccaagctgtatcctacatctcttagtaatctatccaattcagctagggtggataatctgatatgctcttgaaggatattttgatgtatcctaggtgtctgctggcacacacgatacgcaaaatcctcacccattagttgaacattattgtcaaacaacttggctgggtctgatacttggtaaaatagaagcatcatgacaaataattgtcgaagttgatatggaagcgcccactgtgctgcatcagtgatagcatgagaccattcacgatcatcgccaagtaaccccatttcttcacatgcagattgaaaagttgggtattgaatgccactaacagtgcgtacatcagaaaaggattgagcgcctttgacaacatgcagtaatatacgcaagtaaaactgctcaccttggttaggtccaacattggcaatgcgaccaaccttgcccttatggctctgagagcgttgtttccaatatttaccatcaccatgccatgtccaaaactcaggaaattccacatacatgtgttggcgagcttgtgggtatatcctattagcatcaaaccatgcagtcaatttggtgatggtgctacgtggattttcaatgacctggtccagatggtcatcttcagaaaataccacactattttcgagtgggagatgcacaggtaagcgctccatagatggatcagtgtggtggatgtcaaattgcagtaggcgccatgcagcttcacaaggtgttacacacctacaatcaagatattgttgtatttcattgcctccatcccgtatcccaaccttagcacaatcaggacctttggttgtgtatttgaataggtacttctccattccatcacgattaacaatctcaacattgatgtgtgcttggtacttaaccaagagatcaacattatgggccacaacatacctgttatcgacatctacaccacctttctctgtggtaatattgttttttggccgagcatatataacacgcccgacaacaccatagtttttttctgtaaattctttaggataaaacttactgcattttccatcattcatgcaagtagacgatttgtttgaactgccacaagggccatgtatcataaacttggagacagcttcataaccaatatgatcaacagatgggtccggtagctatgcaggtacaaaggcatcaatccaatcaacatcaagaggtccattattttcaagccatatgattacatggacatgggataatccacgtttttggaactcaattgtctagagaactacaaaaaggaaaaaaaggagaagcaaataagaagcagtgaaggggaaaactgggcaaataaaataaatcttaaaaaactggcatgttaaatgagaaattgtggacaaaattaaggatttatggaaattacttccagatataggactgaaaaactggtattttgttatgtcatccataaatattcttagcttcatttggaaaacacggtcaacaatatcaggtcaatcagaggagtgctgccttggaatgagtgctaaagcttgtgttatttctggccatgaagcgttgcatgtgaaagtggtgaaaagatgtgggcacccaaaccctacgacaaagtgcaacacaatcttggtagttttgataataataacgtgggcttccagtaaatgaagctggcaaaacaattttttgttctgctgctgatccttctgtaatgccaatgctaacagcatgaaccaaataattgtatgggctagctctaaatttcttctgaaatgactcattcctgtaatggctcaagcaaccatcctcgacgcaacaaaaccatcaacaacataggcttgagtcagtatcttgcaccgtaaaggagtattaaagtcatcagctctatcatgtagtctatatgcaatatactctaccttggtgacatttttcctcttaatagcccctgatcattggcattgacggtacttgagatctttgtagaagccatcttccccatacggaaacaacagagggtattgcatagccataaacttgcaatgagattcttttatcctttgtagatgagaaatattattaaatcatggccttcattaaatcattaaccaccaacccaacaaccttagatggaacaggggcactatacacaccaccatgttgattgggcacaacaaatagcttgacataatacttgtcttcagattggttagccaatctatcccgagcagttcggaacactcacaatcgggttgtgattatcaaatatcctcatcaaagatgaaatgacattttcatttggtttaaaaccaccacttatgcatggaaccgacatcctattctggatctcattttcagtatcaaaaatgtatagcggacaatattttggcctagcaccatctcttgagatcaaatccaatgacatagctgcccactaatcttgaaaacataaggtcctcctccatcattaatagaccgtatgatgttcacgtccatagttgtcatagcaaaaatagagttataacgcctaatattatcaaagaagtgggtagaaaatgcagggttttgtccagtcaacaaactaagcaatggttctggaggcggtatatgtatggcgataagtgaacacttcctcccctacagcatttgttgtacacacgtgaagctgcctatccttgaccacacacatgctccttataccaaaagagagcaccacaatacttgcatgtctggttaggtcctccaaggtgtaaaggtgaaaaaatagtgcctgagtggaaaatgcataaataaaaaagtaagatagataaaaatatgtggcaacctaatgaacaatatggtatgttctcatcaccatacataggcgatcattggcatgaatcagctgagccgtggcaattatcattatgacgaaacctctttctcaagcactagagtgatcatagagcaaacatcaagagagaaccgcggagttgaaaagcatgacgtctgtaggtgaatgctggcgagtaaaaccaactatgagtttgaggcaaaatgaggagatatatcccctagacatattagaaacacacatatcatgtatgttcctcatgtgctaaaaaaaataatggatattacaacataaagattgataaaataataaaacttacggtggtgtcgaccgggaaatggttgcctaagatctggtggcaagaaaaagacacccagaagaattgaggaaacagttctatgtcatcggagtggatcacagaaaactgaaaataaatcaattagttaccatcgtcaccttggtgagaagccgatgacagattctgttgtggtagttgtgtatgacattgttgcattggtgtacagcattatcatttgggattatgcgacgccgaacagatcgagatgaaggggagtaaatagcagcatatagctctgcaacaccaacaaaagctgtacaaaatcaacaaaaaggaagttgctataaaagtctgtcaatgtagaataatctatcttactttcttctctcttgcgaatcatatatagttgccttgcgttttttacgtgactcagcagcaacatatggttgtggccatggcaaacctaagaacaatagaatataacatatgtatgtatatctgggagtaacttagagtgtgtgagcataacgcggagcaagggatgagcatgttaattgaattgagcttaatatgaacatatatatctatatctatactaatataaaaaggagaagttgcacccctccaatcctacagaccaaatcatcctaactcatctcattcgtccatttgcctggtcatctcatctcatccgtgcatcccatcccaacgcaatgacccacagtcccacctaagccgcacgatgactccaccgtattcctcctcgcccccgcgcaatgactcccgccgtggcctgcccccgatggagccgactccgccacgcactccacggctccacgcgcgctcctcgctactcctcgctcctcacctccctgccgcgatgccgccgccgaacaccacctcggaggaaaaaagaaaaactttcccaatcctcccacgccgcgaaccctaatgaatcggaggcggaggcggccaccacctggccctgcgccggcacggcggcggcgatgacggagtcctccccttctccacgtggactgccgccacatcctcgctagagccgctgcccacgccgacatcttcttctgccgccgccggagcctgcttcttccccaccgccgcggttggagctgacctcggccccatccgccgctgtcgccgccgatggggctggtcgatctctcctctctctcagcagtgaaggtacaaaatcaatttatcccctttcctgaagtcaatttctgaatgtggagtgcaaataatgtggatctgttttgtccctttttgtttcgtagtttcatcctgatccagaacagaagcaagacatcgagttacgagccgatcaatttacatgcctagtgcctcccagtcaatctattttgaggattactagggacaaaatgatcattaatactccggtccaagagggtgtttgatgcaatgctggttagtcattcttattccccaagaagatttgtctttgcaagtggatttcttatgtgcactcaatttttcttgatgctgaattaccaacatttgttatggggtttagatatttagatgtctaatatttacattgatatatatgctgtgattattctgacactcacttgatagctgtttttgtttcaacgtgtgcatttctgtgattttcccaagcaccctttactacccctttcccacctctattttcttgagcacgatcatcttaattgcaatttaggtcaatcttctgttctctgcatcgcggacgtttttttttcgcgaacgagttctctgcatcctaattcaatggatgacacagggagcttctttggtatagacagggagcatcagtactgtctaatattgcaccactgttgtcattgaagcaacatcagttttatgtgttttagtgcttcaatcgatctaaagcaataccttgaagtacattttgtatattttctaatgcctctccccggacataatgggatgaacttcgtaaacatttgcagtaacaaggtgagcaagcagctaaccatttcattaaaattgcgatctttgttgtttgcatggatatgaactgaagaattgagatctttgttgtttgcatggatatgaattgaggaaggataatattatactcttggagttcccaaaaggtcgacagtccaatggccgatgaatgcatgctttgatgctctgcctactgagttaataagttaataaggtgtagtctcctgcttagtctccctgttcttcgccgagttcgtcgccgtccttcgccggaggagaggagagctggtgccggcggagggaggaggggagccagcgcctgcggacagaagaggggagagagccggcgtgaccgtgagggaggagtagttgggggatttgggtaaagtagtatgggtggagatttatattcttctctcgattttagggtggttactataaaatttggatttctttgtaaattgataaacacgtgagggctgaaatggaaagttacaagggttgaaagaagaagtaagtcactcgtgaggctatttgcactgtgggaataaaaaacttgatccagatcttcatcctgtatgaaatagaatgatggtaagctgcactgtgagaggcctaagtttcctgtatatacattctactgtatcaacgatggctgtactacataccagatcccgtaagaaaagtagcatatactggttcaacaagggattcagtgtactggatatatacttgtaaaaacagtacatactactccctaaccgatcgatttaatatatactgcatacttgaaaattcagtatataatccttaaccgatcgatttaatacacactggatacttgaaaaatcagtacatactctttaaccgatcgatttagtatatactgaaaacttaaaaaatcatgtacgatggattaagtatatacagctagagaaaaagtagtaaatacctgaagaagagcatacaaattaagtagtacatacttctacgagataaagtagtatgtatttctacaagaaagaaaaaaaagtagtatatacttctacaagataaaaaaacatataccattccctagcaaaaaatattatatactccaatggaacatatactattaaaaagacacaaagtcatacccaaaggatattacctcttttcaaaataaacatatattttgaaatgttatcacaaagctatggatctagttaacaagggtccaaaactacatgtttgtattgattcaatcactacggggctgtttagatttatgctatttttagttataccattttttataaaaattatcaaaaaaaattatctacgcttaattttttttttccaaatttagtaaatacataacaaattctactagatatttggcaatattgccaacttgctaaaattttggcattgccagaatttggtaaggtttattttggctataatctggataggccctacgtgtataaactgatttgacacctattttatgaagaaaactacagcttggcatcaccgtcttctccaagcaattcaacgtcttcaaattggcagaagataacaccataaatagtgtagcttggctgataaatgcaactagattacgactcagttgcaaaaatggaaaaaaaccaacgttactataaagcatcttctacgtatatatgggtgaataaaactcacgataaataggcggcgattccgagtcatctactagaagttgagatccatcacccaccttctcaacaataacgacaccacaatagatttggaggatcacctctcccacccacgttgtctttctccgctagcggagcctctaactattgaaaccacaacaggctcgggggaatatatttgttgctatagggaggtgggtggtgatgatatgtatgccgggaataaatgcactttttttttacggaggcttcggagggggccgaatgcaaaattttagttagattggatagtcatgtcgtagttccataccaagtgaaaatagtttcgattataggtgacaagttaaactaatattatgtacctagatacgtggtttatgatattatggatctaaataataacgcgttctaaagtttaagaaccagcagtcatgtattttaccttttaaaactcctcattaggataacgctgcaaattatattacctctaactctttttaccataagtttatagttatatgattgatttataattttctaataattataccaaacatttatcgttttataaaattttctctcgtatatattccgtgtaaaagtgagtcgattttagccactactaggggcctgtttagatcccatggcaaaattttacatcctgtcacatcgaatgtttggatatatgtatgaagtattaaatataaaccaaaaagataactaattacatagattgtatgtaaattacgagacgaatcatttaaacctaattgcgccatgatttgacaatgtagtgctacagtaaacatttgacaaatttgctaataatggattaattaggcttaataaatttgtctcgcagtttacagacggattctgtaatttattttatttttagactacgtttaatactttaaatatgtgtatgtatattcgatgtgacacgctgaaacttcacacccagataaatacagcctactagaccaatagccattagccagtgcgttaaaccctcgcagtccccctctcgccgctccccgtcttatccccgctccgctccacctgcgccccacacgcacagagccacgctactctccccacccagattccaccatttcacgcccccgcctccacttcgccttcgcctcgccgcgccgccgccgtctagcccttccgcgtaggcccaggcggccgggccggcgggaagcggcggcgagctcctcccctctgatggcgccgcagctgcagggctgctacgcggtctcgtcctggccccggctcccgcggctgcccccgtggccctgcgcctcccacgcgcagcggcggcgggtgctgcgcctcctgccgccgcggcgccgctgcgccggtgcggtccgggtggtcgc

SEQ ID NO: 32390 - DNA, 11140 bp, Oryza sativa
accttcttttgtgagaaatgcttgattcaattgttgatgagctgagaacggactagttggaatctgtatattagccgcatgatgtcttaaacgtccttcatggctgagtatctcaggattcactatcgtagaaagaaaactaaataactgcaaggatgaagactcacaatgacactccttttcgaaaaagaaagaaaactaaataactgcaaggacaatgattcacaactgaagaaattatactgggttattgaattcaatttcgtatacagagacgctgcagaggattcgggagagaaccaggattgcgatgcaggatcccaaggtgaagtcatgtaagatttttattgttgttatttagtagtgtcatgcatttactggatagttgacttgccttagaaattgtgcaaagttccatagatctaggagtcctgatgataatattaaaaaagagtctgcctgaacaagactagatttctataagcacatagtattagcatcatatgatcaaatatggggacataattccatccgaaagaaagttaggtctctagctgtaagtttgcatctctcagtgttgttggcagggccaaattttagtgactaatgtagtctaccatgttatttgttagataagcatagcatctctactcttatcatcttatggttgagtttatctcacattgtggtgtaacaagtgttgctgctggacttgtgtatagctattaggcttgtggtgcaaaagcaccactaaatttctgatggcttagtggaatatatcatatctgaaagttataattccatctgttaaaattttcaaatgctttggttttgcattgctattggtgattttatataaatgctgccaaaactgtacatgactaccatacttacacttcaatattatagtagtaacatttcatttcatcatgtttattacaatcaagacgaaggcagtttaaattagactattcatgtccccatctctttccgccatccgttgtcccatgttttacaaccatgctaagcgacttatgttgcataaaattaagatacaatgccacattaagggcatgtggtaattaacatatcagaccaacagtttaagcacaatggttattgtgctgcagttatttttatagttcatgtgaaaagtaggaaatagtctcttatttggtttagttaatcagagcaaagttagttagattatattttattatgaagattgccataccacaatttgcatcatagttttttaatgtaaaaagacaatcatttccaatttcttaagaaagtgtagctagttgagtacccagacagaatatatcgaaatgtgatccacccaattgaggttattataagcaacttcaatcccaaaagtaacttaaatattccaactgcaaaggatcacaccaaactagttcccagtggtgcaatgcatgagtgcaccagcaacagtcctgtgttcagttttgaaccatgcttatctatatgattatttgttgggatcgctgttatcatttttttcatatctattatatttgactatagttcatatgataaactatttaatcaatggtgtagcttgcctaaagtgttttttgtgcaggttaagaaaaagttgatgcatctgggacatgcacagaggtaggatactatttgctcttaagttatatgcgtgcattttaatttgaaaagctatgattacagttgaactgaagaaggtattttatacacatccacgtacaaatgtaaaggattcactattcttctctaagtatgactgcattacttggcacgtgttctacttggtagcaactcccagtggtgaacccagcactaggttttaggtatggctgatttgccagcataaacaaagcaattgttatcaaatcagacgattagtcataaagtcggtttaggtgggcaatgtgttcgcagatagagtgttgggccttgggttaggtcggcagtgaaaacatggatgggcctaggcggctagtccattattgctttacgggaagggatactatagcaactgggaggtaaaccctagcctccacttcccctagccaacatcaagcagagaggagtgcaccaggggtgagaggagcgtcaccaaccaacctcctcctcccctgctctcagcctctcctccaatgctggtgctctgatctcctctgctcttccatctccctggctcccacttcttccaaattgctggtgctgcaagcctggaactagcctttccccaaaacaccaattcaccatgctaattggcctattgtgtttagtactttaggacttatgttattgctggctattccatattccatagtttctatcatatattgggctagcacagttgtaaagactatatagtccatcctctgttttcgcacgaccaaatcatggactagttgtgtacttgtcgactcagtagccaagtcggtgtagggggtacctcgactcaactttacgacttgacaacaatgaaacaaagtgtattacccacaatccaccaccataaaagcatctgaaaatgaacatgtatttgtattacaagcacattaccacatggaactaattgggatgaacaactgtagtctgtatgcaaacatgtgctgaaggcagtatgtagaagaattcctcactattgaagctttcaccacacttcaacagaagttaaacattaattacaattgataatttgatatttccattaccgttatgccttggctacattgtaatcagacataatcaaatttatttgacagttacttatagatcatgaccaacacatttttgagattctttaaaactgtctagcctttgacgactctattggcagcatataacatgcaaagagaaaatagagcacatgtcaaattgcactaatgtgatgcatccagataactcacgttaaatgctaggatctcattggtgtagacaacaatgaggaatatacccatcatggcttcacatgcactcatgtatggatctggcctcctgtctccgctggtcactgccgtaccagtgctagcgccacctgctacattgcttgcttgtgattcattaaccaaaatctgatgtgccatttttacagtctgctgatgagtgtgtgtgtgcgtgtttgggggggggggggtaggttaaaaaccaactaagagcaagtttaataagaaaggaagtttctagttccaattatatctacgtcatctattgatcacatagtagatagctggtgcaatagatgagctctattctacagccacattctttattttattgatcaatttaggcccaccatgaccttgtttcagctatcgattggggaggaggaaggtggggtcgaccaggggcgggcccaggattttcaacttgggtattcgaaattggaagagataattttttccaacacaaagtctaatagttgtataatatataacggtataagcatgacgtcgtaaagtcatagattcatagaattgaccataaattaaatatgttaagcatattttaaagtacagtactaaagtattaattgacaaaacatgtcagatttataaagcatagaaaatggaaaaaatgataagaaatcttacaatttagagagaaacttttcgtttcttgatattttgaaaataagtgacgatgtctttatccttcactttcctcttcatgtttcaaacctacaaaacaacactatggtcttctaatttaagtattaaccatgctaactctgctaaatatgtgcactgactctgctacaaagcttcacaaatcagtgaatcacaagtttcaaagttcaattgttcatccataaaccatgaaccatccctgtatggctggattcaaatcctaaataaaatgaaccatcctggattcaactaggaactataaatccgaaattcctaaatcctattcgaacctaattaccaaaatgttcctaaccagttttaccttcgtctgggtcctgccgtctgggcgtttggcgcggtggagtggtggagacgacagaggaggccggagcacaagcgtggctgcgcgggcacctgggcgccacagtccacaggggcggcggcgcgtgggcgccataggggatgggcggatggcgcccttcgcggcaagcggcagcccgggggcgcaggcgtggccactgggtagccgtgaagctgcagcagcttggcagccagctgggaaccaccgccgtcggggttgggaggcgatgctgcgaccccgatgcgcctccgctagtccgctgtcgctgtgcccgtgcgccgtcaggagtcgggaatcagggtcgggaggccgccagggagaagatcgattgggaaggagaggttagggtttcattattcccttttgctgatatgggctattgggccaatgggccgaccagccgaggagaggacggaggtgggatgggatggtgctaagtcgggcttctctgaagaaacaagtctattttacatatttttttcatatacatatgaaatatatattacatatatgaatttttttgtcaaaaatcttgggtattcaactgaatacccatgaatcatggtgggcccgcccctggggcgcaggcgtggccactgggtagccgtgaagctgcagcagcttggcagccagctgggcaccgccgccgtcggggttgggaggcgatgctgcgaccccgacgcgcctccgctagtccgctgtcgctgtgcccgtgcgccgtcgggagtcgggaatcagggtcgggaggccgccagggagaagatcgattgggaaggagaggttagggtttcattattcccttttgctgatatgggctattgggccaatgggccgaccagccgaggagaggacggaggtgggataggatggtgctaagtcgggcctctctgaagaaacaagtctattttacatatttttttcatatacatatgaaatatatattacatatatgaatttttttgtcaaaaatcttgggtattcaactgaatacccatgaatcatggtgggcccgcccctggggtctaccccttcatcgtagcttagcttgtgctgcagttcatgctaatttagtcacccagtcctattctctttcctctcctctctcttccagctcacgcaaaaatctgatgtggcatttgtatagcttgctgatatagtactattgtacctgctttaacaggtaccttctcccaccgaataactcagttatactcttatcttttattcggcctcctaaacttggtgctgggtcctggaggctgcacctcctgcttcttgtttgtagtgtcgcctctgtgtaattactttggcctgcaactcagctcatattctagagcatagctcaggtggagttctccttcatcttacgcaacagaatcccactctcgaggtccatgctgcatggtggaggccattaatccactatggaggtggttcccgctttcggtgagtaactaccctagcctgccataatgggatgtccacccttggcaatgccttatagtctagttttgatactttagagttccagataaaccttggtggccatagaagctaattttactcttatgcaagctaagggaggaagcctaagtattattgtatgctggacatgcctaggtggttgacagtgttttggcgattggtatggttctttggtgcatattggcatgtattcatccttggtggagaacctacattagcattccaataggttattgaacgtgcacagtgttaagttagaaacatattacatgggaactggattggtctaagatttttcatggtgcataaggtcatgtatagcacgactctttgccgggcgcatggatgaagtttatttttctttttttgccaccatggagattaggggcgattcccaagggtgtgtgtgttgctgcttgagcatgcattggatgcatcaccgtccggccaaatgcatggaaagcaaacctgaggaggcaggcgcctaaagaatagctgcctctgttccagattaaggctcctacggagagatctttctctcattaggcagctacataaatctgtcccattttacatgccctaaggaggtttcgaaaggtacctcgctaatattggcgtaacaggagctaatattgtgttttgttataggaggtaccaggttgcattcaaatagtgttaatgctacctccagtaccttatcaaggactgtaaaatcactcgttctaaaatattaaatgtgtgacctactcaccttatagatgatatgtattcttcgaaatgatccaaaagcagctccacacgtgcatattggtcacaccaaaatcatatcagatgaaccttggcatttaggtactggtcactttgccataaggtacataaaatttaaaggagatatgcatcactatgtgaatattaatcattatcttaatactctaatgggttaccttcaaccacattcagaggtctagagatatccctccgattatatgggagggacaaattttgatctcaactgagcttttagtaaatctgcttgctcattatggtttgattaacccaaaacttgttggtccatttgcgtatgtcaagctgtaaatgtgatagctccagggggtcatagaaccaatcctaatgataggtatttcttcttaatatagcgaagagacaagaataaagatatccatgggagtgaggcgaggatggaacttgcgtttacagaaattaatgatccaggatggttgctttgtggagtggagagacatgatagcagatgctgctaggaagggctttgctggtggaatatccctacaatggaattcatataaaatcttgactgagcagatgcggcaggagtggttggaaaaagtccagaaaagaagatcaatgcctcggccaacaggtaatcgacgagcaccaaaatctccagagcagcggagaaaaattgcagaagccattgctgcgaagtggctagataaggtaaagagaatagcaataccttcctcttacatgtttctcattttcatttgaatattatacccaagctctgaactgatcttacaccattccttgtagctttgttacatggattaaatagtcttaactccaatactccatatagctaggagtatatggatcacacaccagcaatctatatggaaattggcataaaggagaaatatctagttttatgagtgccttatctgttttcttgtaggaataccgtgaacgtgtatgcagtggaattgctagctaccatggaacatcttctggaactaaagtaccacgaaagccaagatctgccagagaacctggttcaaagagagatactgtgaaaaagaaacctattcaatccagatcagctggattggaggatgcatgtggaacgactcccacagttaagagaaagaaaagtgcaactccttacaaagatccaatggctggtgaaaaactagagatgataacaaagattcgagctcaaagggcagccctagaaatagaaaagaaagaagctattaaaagggctaggtatgtctgcttattccatagttcaattgggtgggatcaacatttttccactactggtgattttttggcaacatatttttttttatattgcaaattttctcctcgcgcttacaagttcttctaactggattggattgttcttaataattttgtgaaatgtcagtcaaaaggcatatttccctgaaaattgatgcttactattctcacgtaaaaagttgttcataccaagggtattttcttttgtttgttcatcttgttcgatacattgactattatagttttgcagatgaaaaacagagatgtacacgcataataagtacttatgggaaaaaaaattcaaaagctctaatatgaacacctaaatatcttaaaacatgtaaaactacagatcattatgacttgaatatattttagtgcactatgcacttgatttcctgtttcagttatttggtactgtttgctgagcagaaaaactatacatgctatctgtacatccagggatatgttttttaagaaataatgcctgaagtttgcacttgttgggttgcacttaaaacatttaattctgtcactcaagtggcttctgattatattccttgtcattaggtcactgattgcagaagctgagaaggctgcaaatgctctggagactgttgcttccacaagcccttttgctcaagcatcacttatagaagctagaaagcttgttacagaggctagattatcacttcaacacgttgatgatgaagggcctgcagatagtgcttctgatgatgcatcacaagactcaggtgcgtctgatttgcacaatcacgacatggcaaatcaaaatgacgtgatcaagcaagagaataaaccagtcaatgggatggagcttcctccaagcaatgttaatggcagagatttctattttgacgtgtcgactctcactgaaacagatcaccttagagattatcagagaatagaaaattctatggaaagagcctatctgcttccttccgcttcttcagctattcaagacgtgaacgaaaatcacaggatgaaagattttaacgcacatcaattaatggttaatgatgaatcaataacaattgaccaaattgcatctgaagtagcagaaatttatcctgacgagccacaggaggatgacacgctacctgtgcagaagtctaaaatgaggtgggtacgtgggcgactagttgaagtggaagaataaacagttaccagaattatattggttgactaaactgttcaagatatcattatcttgcattccgcttctgctttgattactgttggtatggaccaaaatgggaaatgattgctgatcttggcacgtattcatggtgcattcaaccatgggaattagtcgggaatacgccatgacagagcctattatattctgaggtgagatgcttgtaattagtagttgccaactttagatattttcctcttcttgaatgtagtcaggttagccaaactgaaatcctaaaatcacggtgtggtggatgcatttatcttgtattagaacattttgtagctgtcagattgaggtcctacggatagccctaacacagatttcattaagtcaaatcatacgaggttgtcttgtaagataagtcaaatcatacgaggtcgtcttgtaagatattctgtagctatcattttttttctaggttatcttgtacctgagttcatttgtgaacttgtatcgagagaactactgtttctggctttctgctttgtgccatcggcaacacatctactcaatgtctgtgctaatttgagcctaacttaggccctgtttaattcagcttagcattattataatctgaattattagaagcaagctgaaataaataaacagatagcttattatgataagattattataatctataagctatattactctaatctggtaatccacgtgcttttttttaaggagctgtttgggaaacagggacttactttaagtctctatcacatcggatgtttgaattagtattaaatatagactaattacaaaacccattccatattcttggactaattcacgagacgaatcttttgagcctaattacgttatgatttgataatgtgatgttgcagtaaacttttgataattatagattaattaggcttaaaaaattcgtctcgcggattagctctcatttatgaaattagtttttttattagtctatgtttaatactccaaattagcatccaaacatccaatgtgatagggactaaacagttttagccccatctaaacaacctcctagattattgagtggctaacagctagcaaataactaatcttaatccaatttattgtaatctgacttaataatctatattataataattttaagctgaaacaaatcgagcccgagttctacagtatcaactcacgtatatgacatgctccttccacaaccaaagaatcaaagcccggcctaaaggaagtagataagcaaaatgtcttgctcttatcgtttccccttcagtttaagcagccgtgaaaatttaaattttaagacttaattttagagttattttggtattgttgtatcatagtttatttctcatcatttgcctttaaatcgtaaggatatgtatacaaattttatttacaaattatttattaatcactcataagccgttcagcttataacaagtataatctaaatgacaaggcggaagtctgtcctgttccactacacatctaccatcacatcacatgggggaggatgtatttggggggctcgttggcaccagaggagctggctcgccagcatcggaagcggcaggctcaccctggcacggtggcatcgacaggttgagaacctagcgtaggctttgtttgataaatgagataagaaaataatatcctacttttcaaagggtaatattgtatcataattatgtatttttcacacctcatttaatcctagctatttatctattttcttttttcaatttcacctctcataacctatttgccaaacacatgcttttccatgcgttgcactaaacgtagattaccattttttttccttgaagagtggactgaattttgaacagatcggtggactgaattttgaacagatcggtggactgtattgagtaactatctggttatctattgatatgggtagcggttattccgaaaccacggtgagaactgacgctactggagaaaccatctttggtcggtcggccaaatttcacaatagtcaaagttctattaaaaaccgggactaaaaaaatatctttagtcctagtttaaaagcttaggggtactttttgatctttagtcccggttgatgttattaactgagactaaagatcatttttaattccaattaaaaaagggtaggcagtgtcagacccctatattttctttagtctcggttggtaacaccaaccgggaaaaaagatcggcatacacggagatcgaggcgtgcgcgcggatcggatcgagattcctcctccctcccggttctatctcctcctcctctcctcactcatgctatctcttcctctccttctccccctccccccttatccccacttctcccacttctctgcacgcggcggcggcacgcggtggcggctagcggcc

SEQ ID NO: 32391 - DNA, 9703 bp, Oryza sativa
ccgggcgcggccggcggaaggcggcggtctgcgcggcggtatggccgcacggtaggtggcggcctcgtgcgtcgggggcgcacggcggagggccgggtgcccggcgcgacggcggctggcggctggcggcctcgcgacggcgaagcggcggccggcgcgacaggtggcggcctcacgcggcggcggctggcgcggcagtgggcggcacggcggctgctggatttgggttaattttttttgagaatttttgattcggatctgatatgtatttgatttgatttgtgtgtgacgtgaatatgtgatgtatttgtgatgaatttcgtagaacttgtgatgtaatttcttttttaagattttgtgatgtatttagagatgatcgatttgaggatttggaggagataatcgatttgggatttcatgattcggggatgggggatgaagtgaaatcaatatattaaaaacaataaaaaaataaaggagcaaccgtggcctaccctggctccatctttggtcgcggtttgtgttaccaatcgggactaaaaaggcttcatctttagtccaaccgggacttaaaatggatttttactcccggttatttcacccgggactaaaaatagcgatctttaatcccggattagtagtcccggttggaaaaccgggactacagggggttaccaaccgggagttaaaacgatttctccaccagtgtgaaggacggtaaaatatgtgttcctaatcactctattgtgagatagctcctgcgcacattcctgaactacttataccgtgtgattttctccactattataaaaattaaagatatttttgccaatcctttcgtacatcgcgctgtgcttgatacatagtattttcttcgctatgtttctgccgaattttttcatccatcacctccgtgatcgattcggtctcatacctaggtcacacgaagagcttcacttgatatgctcacagttctagtttgcccgatctttcggtaagttgatgataactacgatttgagagaaacgttgatgatgcgactacaaccgtacgagacagtgttgtgttgtaccttagcgatcgatacacctctgcataggttattgatctttctggtgcaaattatccttattcctacaagcaaatagaagaaacaagtaaaaataagataaaaacaatatgatattacaaataggaattgactacaaatggtaaattggggttctcgaagacaagtaattacacggtctagccgacacgcgtaagtacgtagcaatgtctaaactttaatctaaacaaaattcgagaaaccctaaaggggtacctaactatttaaggagatgggagaatgacctagggcctttaggatcatgctccactaggatggggcgccagatgaagttacaatcccataagtccattataggtgatgcaacattttgtttatgtgattgcggtcaaccgagatggaatttcgagatgaagttggaaccgttggaaagaagactccgagagctttccattaagtactcatggacccaaaacatatctcgtatgcatatttggtgaccgtttgacgtcagcactgctgctagtggctgaattggatttcataacttgatcttaatgtctcccagttaagttatgatataaacaatggttatatcaatagtagccatggtcacatattgctccttccttaaccggctcggccttcattcagctcatcgccaccaattgggcttgcttctctagctaggccacttactatctcactggtcatgccccatggggccaccttggctggatagccctggcgctctgaagcatgcagtttcctcgtgaaaaagaaaattcacggtgacatctataattttaattcgatctcctctcctctttataattttcttgttgcgatttgtaggactcatgcatatattgacttacatactcatacatcaattctttcatgcaatgcacgtgtgccacgtctctgctctttacatacccaatccttgctgtattgatcaatgttagcttcgaatctctacacaaatagaacaaataaccatagtaagaaaagttttttcgttacaagacctgatgaggacatcccagctacacttgacgtaaacaagggtgatggtttacgtcatacatcacatgaagaaaatgaagatgacgtaaaccaagttgatggatcacatctccgcaagaacgatcaagcatatcatggtccaatcatgcgcagctgtactaggataatacaacaagagttgaactcgctctttgctcaacttaacccaaattttagtgagaattttatactacctaaatgctctatctttgtattaccaaggtttacgcccaaggacatcatcactatgccaagaaggatgagttacgttgaggacgacaagggtaacatcgaggaggaatcaacccatgcccaaccagcagctgtttacgccaacaagaagatggtttatggtgcaaaggctcaaatttcaaggcttgtacgacccagccagtcgagagaccgggtgcatggcatacatggttggaaagagggaaaagtctagtttccaatgcatcaaatatcacctcaatatcattttccaataagaatttatgccatttttactgaagaccgcgcaggagctgaagggctgtgcacgaacccaagaaaactctttgcattctcatttatgttagccttgatgaccagaacgtgtcttcttatgttcacactcagttaggagggatgttcctagtataaatactcctctactccatccattagacaacttttgttcaactgaaaatctcatatataagagattgctgaagattgcataaatgccttacccctttgttcttgtgagttcttttggacttgtaagaaggctcctctggtgccccctagtttgtgctctacggcttccagttcagcttgcaccgtattgtgtggattagtcccggattgcggttctatgattgctcaatttgacaagtcggagtccaagaggcttcggatcgtgctcaccctcaccacttggtcgcatccaaccttggcaggtttaaagctagttatttcggatcgtggttctgtgattgctcagtgtgacgggtcggaatccaggaggcttcagatcgttctcaccctcaccacttggtcgtatccgaccttggcaggtataaagctagttatcttcttgctgctcacagctagttaccctcttgtgtttcggtttacactggcactctctatcttgaacctactgccgtgaagatcaagccacccctcgcgagtgtgttcgcatcaagacccatgttattcaatacaagcgcacacactattgtatgaaagaatctatttcgtaactagtactacagatttggttttcccatgtggccaaaatcaatttttgcttgcggacggatagcctgcatgcatccaaacgtatgttaaagatgatttgtgcatgcggacggcgcaaccgcatgccaatgatctgattttcgcatgtgggcgcttaagccgaccgcatgcggaaacaaaaaaaatcacgaaaaaaataaaattccagaaaaaaagccccaccatggctcgagctcgccgcagccgccaccgatgttcctgtcgtcagtcgaatccatggctgacatatccaccatcccgcaaccttcggccactgggatagaagaagacgagggagagagagtgaggagaggcggtgaggtttgtggggttggaggccgagcccgtcgacaccggatctggacctcccgagggcggcgctacccgatccactgccctcgctgcccgccgtcgctgcctatcgtcaccacaactgcaaccggttccgagggcggcgccaccggatccgccgccagccatcgcggtcgctccctaccgccacccgcctcctcgtcagcgtccactcatgcttggagatgaagagagagagagagtgagaggagagagtgagagaggagactaggggagagaatgagagagagagaggagagaataataagaggagaggaagagagagagaggggatagagaatgagagagagagaggagagaataataagaggagaggaagagagagaggggataggagttgaaaaaaaatttgaattggtgagagggaaaggacagtggaggggagaaaaaaaatctatgtataagaggggtatttttgcatgcggaccacttaagaggcccacttgcgaaaatgctccttaagatgcccggctgcgaaaatagactcatttttgcatacctgcgaaaatagtttttgcttgcgctcctcttaaggaacggtatgggaaaatggatggttgatttttgtagatgcgattagttacggtcatcttgttgatgatggtttgtcttttgcaatatgctgatgataccatcatctttttggagcatgacttgcaacaggcaaagaatctgaaattgactttacctgtatttgaaaagttatctagcttaaaaataaatttttacaagagtaaattattttgttttggtcaggcgaaggaatgttatgatcaatattctaatatctttggctgtctgataggttcttttcctattaaatatctaggaattccaatgcattttaggaagctttctaataaagattggaaagttattgaagaaagaattgagaaaaaaagtttaatagttggaaaggcaagcatatgtctattggtggtagattggttttgattaatgctgtacttttgagtttagccatgtttatgattttttttagataccgaaaggggttcttcgaaaaattgattattatacatcgtggttcttttggcaagggatgatcataagaaaaagtattgactcactaggactaggtgggatattgtttgccaacccaatgacccggggggtcttgggatacataatttggaaatacataataaatgtcttttaagtaaatggttgattaagctaattaatgaggaatgagtttggcaagacttattgaagataaaatatctttataatgagtctataacccaagttggcaagaaacggtaactcccatttttggttggacctatgaatgtaaaaagtactttcttaaatatggattcttggattgtcaacaatgggaaataaattagattttgagaagataaatggttaggcaacttggccttcaaggataaatatccatctttatacgctattgtccgaaggaaatcgttttctattgccactgtcatgggttctgttctgcttaatgcttcttttagaagatctttagttggtcagaatcttgtttattggcatgagtcgtgtgcttctattgtacatatctagttgaatatttcttctgatatctttagatggaattttcatcagaatggtatgttctcggtaaggccaatgtacctagctttaatcaataatggctgtatcgagaggaataggtgcatttggaagcttaagatgccacttaagattaagatattcatgtgttacttgcttaaaggggttgtgttaactaaggataatttggcgaggcggaattggaatggcagcttgaggtgctgttttttaatgaaaaatgagtctattcaacatcttttatagattgttattttgcgtagttcatatagagagcagttcagttctcttttggttttaacctctctactaatatgtcatattttttatgcatggcttttagtaatgaactgaacaacatgtacaaatgatgctaactttccttcacaattctcgactatacacacaaggtctcatagttcagttggtgatggacacatagcgatagtagcttgtgtcaatgacgaattctttcacatttagaccaagattcggtcaaacttttaagttatcaccagtgacctgttgttgtgttttaaagtaagtattccagaaattacagatggatagaatcttaaaaatttgactcagtcatatcgtatataaaatttcaaatatttgtattcacccgttgtaatgcacgggcatttagctagttagaaaaatttctaaagttaagatgctttaagaatcatattaattcagttgcacaagtttaaaataattaatactcaattaattatagctagtggctcatctcgttttaggtatcttctcaatcttctctaatctttttctctcaaacatagccttaggctgagtttgtttctctcctttcacaacttctactccctcgttttttacgcacacgcttcctggactgttaaatggattgttttacggttctgctaaatttgtggcgccacaattttaccttgatttcagtcgattctttgaccgacacgattgacgccgagattcgtgctcttgtacataaccaccagaaatacgataacttcaccgagcagatgtgttacattgggtactgctacatgctcgtacacagttgcacattggtcaaagtaagagaccgtataaatgagaacacgtaacgagagagggataaaatagttagtgttatataattactccctacttacactataattacatactatttacatatgtaattttagaacttacatatgtaattttgagacttacaatgtaaatacattaaaattacatatgtaattttagggacttacaatggaaatacattctgactattttttgatgaaaaatatggcgccatatagatacatagtgccttgtttattgcaaaaattttctatgtgaaggttgtttggaaaaaaatcatattaatatattttcaagatttttttagctaatacttaattagtcacgctttaatgagtcaccatgttctctgtacgaagggagagaagttcccaacacgtactaccgaacacgtctctagttaccccagttttgcattcatcaaagtagtactccattcgtttcatattataagttgactttttttagttaaatatttttaaatttgactaagtttatagaaaaatataacaatattttaatacaaaatagacatattatcaaaatatattaaaatttagttgtaacaaaactaatttggtattttaaatgttgctatttttttaataaacttagttaaacttacaaaaagttgagtaagaaaaagtttaaagctacttataatatgaaacagatggagcagttgctaagtcaattaaattgtcttgtagatgattgaagtaggagaaaataaaggtaccagagagagtttagaaacctagctatgactgtgaaggtcaaaagaagctagagagcaaagcagtagcacgacatgtggagactagagaaggaagatcacgtgaaaataagaagagttaagtaaaggaaagcttttgcatcaatatgtctggatgagctacataataaatacaatgtcgttaatccttttgctgaagaaaagttaatagaggattgatcttccttttgctgccttttggcacgtttcatcgttgatacttgtagtcgtagagcacgaataaaaagcatgatgaaatgtgggcaagcgttggccataaactttctaaacccttgaagttcaaacaagaaaaaaaatgagcttattctctactattattcgtggaaggattttttgaagttccaagatcaaaatttcaactgataattaattaaatgatgactagaatgtatgttgctaaaggacttttgggagcccttcctactacctctatgtacgtactccatatgaaagcactgcatgtgtctctctttccttctcatatattaaccatcttattgtcaaacattaaactatttttttcttaaattattattcgatttacgatcgattactccgttatatttgattatatactgatcacagaaaaaatgtgtttcaaccgttaaaatttaatgtttcatatgtgatagcaaaatatttcagcatatatttcactgtgtttaaaaaaataatgtttcaattgcttttttttaccatgtacgaattaacgtttcacctgtggttaactgaaccagcctttttttttgggaaattatgtgtatttgtagtagcctccggatttttcttgcatactttcagatgattaaggaaattgtactttacatgtacaaccccttttaattggtagtacttgtagagctttgacatccttcttctgctctccctagctactactactgatctatatccctcctgaaatcttgctaatgcttggttgtatattgtgtatctcaactgcttctgagacagttttttaaacctccggttgttttcttctacttcagtcatgtacaaattaaagatgtctatcaaaataaagatttttatatgatatttgcttaaaggggtagtgttaaccaaatataatttaataaaaggaattagaataatagtagtacaaagtgttgcttttgtttgcatgaagagactgtccaatatctattatttgaaagccatgttgctaaatttgtttggagaatcgtctttatttctcttgggttgaaaaagagtaatctctgtgtacccctgaaaactcactcaatttttttcatatccctgaaatttacccgatcccttctatgcccctgaaatttcaacttgatcccttccatgcccctatcgttacatttaccttcatttcactattatattatattatattatgtttggttgcaaatatcttttttgctcttgatgctctaggtttgaatataagcttaaaaaatgattgaaaattttgtttaagtgcacaatatgtgcattttatgaaactaatgagactaattataattagtgcagaaaattttgacataaatttacaaaataaaacaaatgtaataaattaaattttttatttgaaattttaataggacaatggatatttttgattgggagtattcataaaaaaattattgtgagcattggtagtcctatctttgtatgaatgctcatcatttttatgacgtttttaaaaaataaatacattttttatttctttatctaaaaaataattttatgataaataatgcagcgcacaacaaactgataactataataatctcctacgacaaacttttacatttttaataatgcaattcatgaatttctatgttcatccaaagggtaaatggtcatttttatagaaattagacggtcaactaacggtcaacagatgtgatggatatggaagggatcaaaactcaaattttggaggtatacaagaaagtaagcaaaattcaggggcatagaaggtattagcttaaatttcaggggtatagaagtgattttctcttgcaaaaaccacataatttttctcaaatgtttggggattggctgatagtcatgaattttaaagctaagaaatttatttggcaaaatttgctacaggacactcaaaagttatgtaattagctgggggacacccgaaaaacgtgaatttgcctgaggacactctaaaagtgtggtaatttgccacaggacactgggcgcattaaaatataatatccactgaattgatgagagagaaaccgcgtaaaatgacagttttgccccttcttttcttccccttccgcttggcgcttccattgacggcacgcccgccgccgccaccgccaccagcgcaagcaccaacaccacccgcggctccatcctgcgccgcaccgtcgccgtctccgccgccggcgaggcaagccacc

SEQ ID NO: 32392 - DNA, 26144 bp, Oryza sativa
cgggcgtgccgtcgatggaagcgccgagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgcctttcgggtgtcccccagccaattacacaatttctaggtgtcccagggcaaattttgccaatatattttgatatattttgatagaagcatctactctatattggatagaaatgatatggtttttgataagactccaaataaatcttatgtacaggtattatttagagcaacttattggctttggttctggggccagctttcactactacaaaatcgatatgcataagtacctctttcgcgtctgtgaaaatcatcctccattttcgtgtgcagcttcttgagaggaccgcatggaaaaatcgatttccgtgcgggccttttaagtggaccgcactccaaaatgagcctattttcgcaggcagagctcttaagtggaccacacgcaaaaatacctctctcttttttccctctcactcgctcgcttcaaatttttcacctcatctctcttcctttccttttattttcgctcccctctctctctttctctcctttcctctcctctcctccgatcgggcaggcgggctggcgcggtggccggtgggcggtggggaggcgtggcggcggcggatccggcgacggtgacgggagagggtagacccggcgacggtgacaggagcgggtagacccggcgacagcgaagacgaggatgacagcgaccactagggcggcagcggcggcttcttgggttagggttttttattttttggatttatttttttccttttttatttttgcgtgcgggcgacataagcacccgcacgtgaaaattagatttttcgcgtgcgggtgtgccaccagcatgaaaaatagcgattttcgcagaccatttggcgcgtgcgggttgccatgccgcacgcgaaaacctcttttggactgcacggcagaatggttttcgtagtagtgtttaaaggtgtaaagagtaaatggaagtcatatgtgccgcatgccagaatttagagtcattagtcatgctagttttcgttaacttatggatgaagatttagtaatagacttgaactttgaataagttgctatttttctttggctggtgtggttgtgtctgcttttcatcttccttttttttatttttgttgtatttgggcttcgtgctaataacttagtaataagtggctgtagcttcaattgaagcaaagcccgggtttaatatctattattaaaaaagcaagattatttaagtgactcgattgttaactatatattagatgaatggaaactgaaactgagataacaactgagtgattagtgtagagtaccatacatacactactggaaaaccgatctttcctcggtcgccccaaaaccacaatagtcgcggttataaaaagaacccggactacagatgatttttagtcccggtttaaaaccccatagccattctacgatctttagtcccagttggtaacaccaaccgggactaaagatcatctttagtcccggttcatcccctgtcagtcccttgtcagaggggcgaggatctttagtcccggttggtgtcacaaaccagactaaagatcaccactttagtcccggttggtattaccaaccgggactaaaatcacgcgtagtagtatataatccctattacctattctctcccccactaccggcctcaatctcctcaacaaccggcctctcctctcgtcagatccatctccctctcctcctccccttcctccccttcctcctcccatcccggccctctctcctccccctcctcccttcccatccgatgcccagcgagggccgcctcctccccctcctcccttcccgcacgcatcaggcagggccgcgcccggcggggccgcacgcaggccgagtagcgaacggcggcaagcggcgctaccgcatccattcttttttttttttttacaatttgtgattcacttagatgtataattttgtgatttattgtatggatctgagatgtataatatgtgatgcatttggtttgtgtgtaatttttttaagatttgtgatgtatttgatttgtgtgtacaggtaatttaagatttgtgatgtgaatgttttggatgttactttgatttggggtttgatttgggaatatgcatcccacttgatttgggagaaaatatagggattaaactctggctaaaaaataatgaaaaaaaaagaaaaggagacctaatgagactgccgctaccctctctttagtcccggttggtgttaccaaccgagactaaagatcatctctagtcccggttatttcatccgggactaaagatagtggtgatctttagtcccggattcgtagttccggttggataaccgggactaaaggggggttacgaaccgggagtataaaggatttctccaccagtgatatttcatggtccttcagttatcaccgtcatctcagaaattaccacaacccggaatcaataaagagtaaatttcacgaaactacagatacttgtgtcaaattattacaaaactacagatttaagaatgtatatcacaaaactacagatttagtgttaaacttttcatggaactatagatttaatgcaccatatcataaaactacagatttagtgattaagttattaaagaactacatattctagagtttagatcatagcactattatttatttaaagttataaaatttgtagttttgtgataaaaaatagtttttaaatgtgtagttttgtaataaaatagttgttaaatcaatagttttgtgatataataccttaaatctgtagttccataataaatttaactctaaatctgtagttttgtagttttgtgaaatacattcttaaatctgtagttttgtgataatttgatcaaagtatctatagttttgtgaaatttactcatcaataaatcaccggaattgtaggtagtccacgcgtatgttcaacatattctgttcaatcttcataaaagaacacgtaaccaacaaagtcccaactcatggaaaccaatccttacgtacgtgagtatgtgagatggctgttctctgccatcctttaagtcacacacgcatgtttttctcatagacacctaataaaaatacggttataaaaagaacacctaacaaaaagagcacacgtctgggcaaagaagaaacaagtctttgcggcacacgtgtgatcaattagatccatatggatacaatattttttccgagcgagaaccgtatcactatacacgcagctgtattttggccacgaatatccgcttgcgtagtcctgcttaagccttactacttcttacttttagatgtgtgcaataatgactcagctaacaaccacctggccagttgtcgagtaggaatcctaattagcgtgctcgtgttagggagagaagtcgtgtgcggttcccggccgcgcggtgataagttagggttaatggtttttgggcagggtcgggggagggtggcaccaggagggggaatgggggatcgggtttaaagggatagcctgagaggtggtggactaacggtgggtggcatacaagggcaagcgacgaggcggcggaggtgtcatcagtgccgtggtgtcggtagcaggcggtgggtctcgtgatggtggcggagtgataacaatccggtccaggtggagttggccgaggcctaacaaattaaagttgtccggactccaacagttcttaggtacacccattcggggaaaggcccaatcggagaccctaacagttcttaggcacacccactagggggcctagctctgataccaaatgatacatccggcctaggtggggttggtcgaggcccaacaaattaaggttgcgttgcccggcacacccactagggggcccagctatggtaccaaatgatacatccggcctaggtggggttggtcgaggcccaacaaattaaggttgcattgcccggaccccaacagttcttaggcacacccactcggggaaaggcccaatctctctaaaagactggtccaataggggaagggtggatctcccttttaaggtggcttcctcctcccaaactaagcaaggtgggattattcagaggcacacatggtccccgcccgtctataactggaccacttggcccttgttgcgtctttcccaacgggtaatagtggaggatgtccttatcacggagacaaagcgatgcaaatgggagagggaggaggtcgcctggcggggctgcgctgacaagttgacacctttctatgctggcgaggttggggcagtggcacgatggagtggaggggaagcgggtgttgcgggtggcggtatggaaagaacttacctattaccagagggaggaggcggggactcgctagagagcctctagccggcgctagtgctctactcgcgtcatcgttgccggagtgaggaggggctcgctagagggaggaggtgcgggctcgttggtgccgtcgtcattatcgccgctttgctcactttgactcgcgtctaggatgagagaaacatataagggagggagagatagagagagagaggagcggtccatgcgtgccacgtggagatagaggacaacaagggtggacgcgcgcaacttcgcctccttgcacgtacacgagatagcagccccaaggtggtgagagcggcgttggattagctgttcaattatagcgagtgtgcgtggcagcattccatatatgtgggatggatgggcggctggcctgctattgatttgggcttaaattgttgactaaacttcccatacggtattctttactggagctagctaactatatttatgagaggattgcgataaaaacaattgattaccttcttggaacctgagagaggcagaaacgtagagaagtaccaattacatacgaaaatttgattaaaacaaagcaaaaatatatgccgccacaaattttagcaaaacaaccctttctttggtttacatacaatagaatctggatcgaatcctgaacaccaaattacaaaaagatggagcatcaaattagaaaaaaatattttatttggttttaatgaaatttgtatctgctacctaattggacttggtgagcaggctaggaggtaagttcttttgggtgaggtgcgtaagagtccaaatagggccacaacacgttttacatgaacatccatataccaatgacgaagaatgaaagaaccacctatatcgtccaaaggggtttttaaagtccttttcttgttttgtgtggatgtgtgcgttgacgtgagggtagtagcaggtactaatctaggggtaaggttggtaagaaccgatgtccgatgcaccgcttcaaaccgtgacagtggagggtatgattaaatgttggaggaggtgggaacgtcgaatgtggtgctagagaaggtggaggtggcagaggtggcatacctaacgccctgggagtcggcgagggtagatgtggatcaagcatcgtaggaagctagaacgactgaggcatcacaaatgttattgagatgggtcggcgcggggcaaaaacctttatgggcagggcacccacaggaataccggatgccttgggtgcggtaggcggctgtgaagacctcacgagcaactcgcttattccatctactctccagctagctcctctactaatgagatcctccatcccctcgccttttggcgtcaaaccaatgaagagagagataggacagggaagagatattttacatgaaaaattacctatttacccttaaagctccataaactgttattcagcacgtgatttataccacgggtataataatttctctcagattatcggtatcgtcaagtaccaaggtacctcaaggatgggaaaatagctatcgtccaaaaggaaagctgccttgcgtgcgtatggtaggaaagggaaagcgtttgcttgcagggcatggtgattgctatgttggcagaagaaataaagattaaagcaaacaagaagtttatatactggagttgcggatttccctatcatgcaagtttttttttttaatttttttgtcaagctagagtcatgcaagttttggatacatgtagtgtaaccaacagagagaaaaacgaaaaaggccactaatgaagagcagaagaagaaatgttgatagtacttttgggtatcgattacgacagaattagcccacgtgacagggcataattaatatatacctaccaaagcagtaacttcagcctctaattgaatatcacaccaaaaatcaagccctgaatcgggtacacctttttaattttttgtgctggaaaaaacacgtgtcttttgatccatcatgtacacgaaaaactaattaatgaaactccttctatccttctaaccatcaaggaaaaacacacacagctcctatatataaggctacaagagatcgtggctgtaggtcgagcaaagccgaaattttattaagtgcacgagtcgacggtgtccgaaagagacagatctagctagttcacaactcttgagcaatctagctagttcatgcacgtaacgttagcaccaccggccggccggatcgatcaggttgtagggattacggcggcgatcgatggacatcgtcggcgcgggcacttcgccggcagcgaggtggaaggcaccggcgtccatggtgttggtgcagctcttcaactcggggatgattctgctatcgaaggtgtccatcaacggtggcatgttcgtgttcgcgctgctctcgtaccgcagcgtattcggtgccatcttcatccttccctttgcactcatcttcgagcggtatgttttagtttttttaattgttcttagctacaaccggttaaatttatgcttaacaacaagctcttatgaaacatatctgaaaatctaatatttggaccacgcaacaataaatggccaaacaatgacgtacggaaaaaaagtggatttgaaaatatgttttgctgggtttaattgtaaattaatttagtaaaaatatttgaataataaaatatcttccaatttatgggtttttagatgaaatgtatgggtatatatttgtgggcatactcttttttacttaaaaaaaagtgtttttttattatcaataaaaaatttaataagctgtaaatcgatggactcattgacaacaccacatgtaaaacttgtgactgaatggatgatcatgtgtcgatcttgtaagaggaaaatgcattgtaaaatcgggtgtcatgatgaaaatataatctgcttttgctaatttggttttgtgtatatctttcaaaaatatttcgttttgggtagaggcaagtggagggacattgattggagcgcaaccggatggattttttttaatgcgttcatcgggtacgtgtttctctgaagcttcaaatgcagtaaagtactgcctacaattaaacttatgattattgcattatagaattttttgattcgatcgacaatacgtacatgaaatttccatatttgtacatgtctctaacctgcatatatttaattaccttcgtatcattttacccaaaaaaagtgcagatgatttcaaacttacaattatactaacagatatttcatcgtgtttaattatggtatatggtatttgtatagcgctagtttttaagctgcagtaaatacattaccctagtagaaaattaagaagaacttcagaaagcttgattttataaattaaaattgttgaaaatataccggcattgtcacaaagtatttatacatcaataaagttcacttcattctaaaaatctcgtattaaaaactggcaattctatacccaaaactaaataatcactgattgatattggccgaacaattgcaatctaaaatccttcctctattctaaaataagttggttattagtatttataatttatcccaaaataagttgattcttaccattgtatccttaaatatctcttttatatacaccaactagtattagttttctattaatgggaggtattttagtctttttcgctcgcgatgtcttggatgcgaggaattcattaattttgagacaatgagtttacattagtgagccaagctttgacaaggacggccaaattaatgatctgattccgagcaaaaaaattcttgatcaaattggtgcaagaggggatatttcatgaaattaatttgatcaaataacacaaaagcatttcgctaaatcatttgatatgccaatttgctttttatactttctgtatctctattacatttgtaaaaaatatttcaccattctgcttagggaatcttttcaggctattagccaaaaaatggcctatttataacaaaatcaaagttttcacttcatttgtatttgcttatactccctccgtcccaaaatataagtatttttagactctgacacggtctccgagatgccactttgacgaacaatatctataaaagtaaggtgttttaaataaaaagtgttgcatattatgataatttgttgaatgataaatctagtaacatcaattttatatgattgatcttttttatatttttgctattaatagtcaaagtttagaatgtttgacttgtcactaaactaaaaatgcttatattttgggatggagggagtaattttttgtgggtcgagtgcatcttagttatgtacggtctagaaactgatttaaagatggttgtatccaattatcttgatttcagtaaaaagctcgccagtcatgtttttctttcattcatagatacaaatgggtgtgtttgcaagagcaagttcccaacactcatctctcgttttccacgcacacgcttttcaaacggctaaatggtgtgttttttgcaaaatgtttcgtgtttaaaaaatcatattgatatatttttgaaaaaaaagtaatacttaattaatcacgcgctaatggaccgtttcgttttccatgcatgggaaatggttcccaacacccacctccgaacacggcggctgtgttcttaccccacgtttcccagcctttctccctcgttttccacgcgcacacttttcaaactataaaatagtgtgtttttagtttctatatgaaagttgcttaaaaaaatcatattgatccattttgaaaatctttttaagctaatacttaattaatcaggcactaatggaccgttccattttccgtgcgcttccggttgggaactccatccagcgaacacagccaacccctctgtacgaaacggctctctcgcgaacgtgcgccaacttttgatctggcgaatgtgtcggcccgcattctttcccttttttatttgtttccctttccttttttgttgcgtgggtcgtttgctctcggaggcttttctatccacttcgctaggcgagaaggcgaatctgtcggagtgaggaggacgaaagacgcacgacgtacggagaaggggagcagggggagcgatattgttctttcctttccaattttcagttttcttcttttacgtgatccattttctttttcttttttttttcactaccgtttttctttttcagatttctatttttgttaattatttttattgtttctttaacagaaacatttttatatgaattatttcatgaaaactttctacatatacatatagattttatgtatgtaaagtttttatatgtagattttatatatgtaaagtttctatatgtagactttatgtatgtaaagtttttatatgtagactttatatatgtaaactttctatatgtagattttatatatataaactttatatataatttatatctctgtaattagaaagtttagtgtatcaattttaatagaaatagaaaaatgctgatcatcaccggatatttttcttttaaaaaaagagtacaatccaaacaaaacaaacgttgtaccaagaaaacataaagcatgcgtatacttcgtattttaaccgaagaaacaaactaccggctcgttagtcattactaatcacgattaagcatgtaatttggcatgtaattagccatgaggaagaagagatgaaacggcagtcggaacattcgtgcgatactactagatgctaatcacgtgcatgcatatatatgcagcggagaagcgataagagtccgttcgcttgtcgcgaacgctcgcgaatcagactcacccgaaaattaatgcattttgtatcatcttgcaagaaaccgataccataatgaaatacattacatattgtttcgtacagtacacactctacgtactcgtccatgtatagaaactaattggactgcgatgagttcccacgataattaaagaagaaaaatatcaattgggatgggactgaaatataatattttggattaaaagtagaagagttcacattgggcacaacttttgtaaaactaattttgaatttaaaactgttaaatcaagaagaaactaataaaattaagacatgaagataaatatctatcggtacttttcatttaagattttcaaaattatttgatagaaaaaaatggttatatgttgagaaaagcaattttactgtactaacaactgaatcaaaaataaatttactgaccaaccaaatatatgccaaattaaactctgagattatatatatcttattttcttttttctatgaaggaggtgggtttctgttgttccgaactaaaaaaaaataaccaccaagatatgttgtagcattaaagaacgtgacgatagcaatagtagtgcaacttgtatttcgcttgcatgtacatacgaaaagtatacgtaacaaaaggctgcgagcctatctctctttgttagaacaaggtttaatattttataatttattttaatttccatcttcaatattttttatatctatctctcctttcctagtctgttggacttgagattgccctttgctatttacttctacgtgcataggtagccttttgcacatccggtacatttttttttaacaaagattaagttttaaaccagattgatggcactcttgatttaatatgctctgataattctctcaaaatagtttgggcaaaacatagaaaatttaactacacatatattaactctaaaatgttctgactatatgtacatcttcttattttcatgttcgtattacttgcaagagagaattcattctatgctactgagtttaatttagttcaacgatttgtaatcgttattgattttgtctcactctataatatgctactaactttgtcaattttttctacaatatgctatttatttggttggatactttttaaaaaatgcctataaaatatccttcaaaacttactagagttgataattgattgatctactggaagtttcaaaaacatatgaaattttttatatagccaccttatataatatagaagtgtgtatatttgaagaatttcattttgcatgcattaactttttatgaaaatataatttatgttatatatcctataggatactcttatgttaatgctctttcatgtaaatcatcattcatgtgctatatagttattttttttatgcggctatctttcatgtatgtgattcctcttttatatgctacacaaaaatagtttttttaaaaaaaccatgaaaaaaacccttgaaatatacaaacaaacatctacattttataagaatgcaatgtaaaaaaaatactttcatattttatttgaaacatctcgtgggtcaatcaattgccaactctggtatgacttgaagggcattttatgtattttttgaaaagtatccatctcaatggtatattgtaggaaaaaatgataaagtcagtagtatattccagagggagacagccgatgacaaatcgtcgaactagagtacatttagtgccatataatagaaagcataacaagttaagttaatgtatatatgtactaaagcaattaatttgttaaaaggatctgttgagcaaagtggcaaactccagttatatatgtccttgaacaacaaaaatgagctgataagtcggtcatgaactatacgctagaaggatctgctgcacaaagttcggtcaaatgcttgaccagaaacaatgaactcgtgataagtccaactactatataactgtaagttagtatttttttttttgcataatgaaaaaatagttccaaactttgctgaaaaaaagttataaatcaattaatacaaagtttgtagtaaaatgactgcaaattaaaaacacaatttgatgaaagaaaagagaactaactggaacatcagcctaaagacagacataacaacctattgagtaaacttccatctctaattggtatagttgtatgtaaaccacatacggttattgcccttctcaaacctttgcatataataagatgtatagtgagtgatgcatattggtttgaaggtaagatgcaagtatacaatcatacaacttgcttgctcatggctaccgtgataaagaaacttagcctccaataagatattaattgctgatggcagtatcaattcggtgaaaacctaattagtaatcaatttcttgatgaacaaatattactaatcatccgaggcatattacattaagcttttctttactgtatgccaaattatgcagatatgccgtaccaatgagcctctactactatggcctcaaggataccacaccatcctactccgtcatctttacaaacataattcccttattcacctttgttctttcacttgtgtttaggtaaatgttccattcacaatatttgttgtgtacaatatatatacatggcaataactatgggttccaacaataattattccatggcatgagaaaaaaaaggccatataggtaaaacttaaattgtgttgcaactatgttccatctcaccgaaacatggatatgtatgaacatgatagactagagacattcaaattaagaagcaaggctggcctactgaagatagtgggtgttctggtctctgttggaggcacaatgcttgtcagcctttacaaggggaagtcactgcatctctggaattccatcttgcagcaccaaaaggaacaacaaacgaagtctgcaaccaatcagctaagagggacaattttcttggcaggcagcagcctcacctttgcttgctggtaccttgttcaggtaatcatatataagcattgtttctaacaagtacatacatatcagagtaaattctttttctttttttaataattataggttgtgtggatcatcttgttgtaattgtttgagatcaataaagcttcatttgtctaaaaaatcagagtatattaactttatctagaccatgtcatcttataactgttgtggcagtcaaaggttctcaaagtgtacccgtataaatattggtcttccatggtgacatgcttggtcggaggatttcagacagcatttgttggaatcatattaaggagagacaagaatgcttggatgctaggatgggatctcaaccttgttactgtagtgtactcggtatgccttcgaactttcttaagcattgaaattaactgaacagaaagctacacaaagaattatctttctacaaaattattgttcctatatttcgtagtatccactgaagcttatattcagaaatatgtttgtaaaaaacattctgttatgtgttttcacgatggtccactgaagcttgaattgtattactcaacaatccaggatttataagatgattttagagcaatgatgacgaattttcaggaagtgtaatgaacctaattaactgctgtgatgaaattgacatgaaactattttggtgcagggggcacttgcaacagctggaaaatatagcctaaattcatgggcagttgctaagcgaggcccagcatatcctccaatgtttaacccactatcagtcatcttcactgttgtttttgactctatccttatgggcgatgatcttacagtaggaaggtcagtagccttctttggtgtctatgatgcatgttcagtgttaccaatcaaaatggattatgccagttcatgtgccaaatgcttccctatgccaaaaactaattgacactcattttttgcacagcaaaaaaaaagaagcaaactttgtaaattgtctattattattgtgcataatcatcaatgaacaacaacaaaaggaggaactgaataagttggtaatgtgatatgtcaacatgagcttgttctttttttattacaaaagataaaagtacaacatggatgacatagaataagagatttgctccggttcaaaaaaagtacctcgaagtatccgtacctcacggtaccaaattatttccggttgttgattttaaaatgcccatcgtgcgcagctagatccaatgatcaaaaacgatttggtatcgtaaggtatcggtacctcgaggtactttttgctagactggagcaaatctccatagaataaatttcagaaataggttacagagaaccacaaaagttttagcacttggcatataagcacaataattatggtactccctctgtcctaaaatataataacttttagtacttaggatttgccccaaaatataacaacttctccaccaacattccctttccaaccaatcataaccctccactattcaccttttccacctacctccacttctcaaccaataacaacccctgcctatttaattctacctactttcttaataaccgtgtccaactctaaaactctctatattctgggacagagggagtactaaagttttacgaagtcaggatcctacaacaatcaagctatatattattagactccgcttggcattgaagtggattacgataatcacgtttgccgcaataactttaggatattttggtgtttgataaattatttttcttatactttgtgtttgcatctgcgaatattgttatggtctaaaactatcaaataattgcgagagacaacgtcggataggatattgtatctaattgtaatatgatatatatgtaaaacaaacaatatcaattattgttccaattttcatagcaacttaaataagcacggtgaaggacaaaacaccacaacaactactagaacccaaataggtactgcctaatatgtgccggttattgtcaacaatacacactgaggcttactccaggagttgatctacaaatggacgtggacattccaggcagggtgccctgacgtaacaatagcttaatattcatatggacactgtgcataaggatggctaaatttgttgatagcgttttatgaaaatgttataccatattgttatggttaagtgccaagtgataaaataccaatggtttcctctaacttaaaccatatggcatgtgtatttgtgaaatttactactgtactttgtgatccttgaatcgttatgaagtgcatttgcgttacagtttaaattttagtcaacaattgtttgaattgttctcttgttttgaatgtgcagtctcataggcacggcaatggtgattgttgggctctacctttttctctcagtgaaagcatgagaaggtccatggatgtaaacatgtagattctacaaaggttctcgaagctatagaatagagttgtatatgcagacagtgaaatgtatgtaattcaataattaaatgtgaaacaatatactcgaggaggtgagcatgcacttacactgtttgtttattaatattttgctcaacaatactacaatatttcattgcaccactaaaacaaaatattggtccatgaatataatgctgcttgttattttaatttgaatggatatcgcgtataagtaataccttggaataaatcaagctaataggaataaatatgaaaaatgcacggacaacgatttccatatgatgaaatttaaaatagatccgtcataaatagagtagttaatataatatgtgtaacttctaacttgttaggatataagcaacgattgaaataaatgaaacaattgactggcatgtatatatcagttatataaggtataaggtgtacatgggtatatgtattgattggggcctccaagtacattgtgccctagtctgctgccccatcgcccaacctcaggaacgtccctgattggtggaaagtcctatgtcctctcattactactttcttaacgcacctaaaagaacatggtggtggacatgaattttcttctatttccttcatcctatatggtccctctggaacgcatgaattgcaaaacacgattaataagctaacaccatcccggtattaagcatatgtgtggttgtcttgtttatattagttgggttattaatcgtctcaaatgaacactttccctataggcacataactatcatcatatgcgcatcgcttatcgctcgagtctagaaaaggttttcatcatttttcctttgcaaaaaaatctacacctgtgtggctcgactgctcaggttgaactaccgaagcactagcttgcttagaaggactttgggtggagacagaatggattcccatgcctataatcttggagacggataatttagatgtcactcaagcagtaacaaaggaagctcagatggagtaatgatcacggaagcaaaaaagttgatgcaatgtctttaaagcgtgcaagtgtaagataaacaaagaagcgaatagggtagctcatactcttgctcaaactgggcatgagttcaaggtcaagtggaaagtagagattgtgtgcacttgcgtgtatcttggacttattgaatcatgaatgtaatccatattttgataactaataaagctctctgtttctgctaaaaagacaaaggttccactcagtccagaaataatagcatagtttctaggcatggctaagtaaggccattatatagatctaaacaataggaatcaatatcaaagcaggatcatgcaaaaagtaggtcgtagataccaataatgcacatttcaaataggagcaattatgttcttacccttactttgggttgaaattatgattttatctctgtttcgttttgactctgtcctcactttttttattgaagttacgggttgcccctaatttgttagtttgtcaattgtaaaaagacatatgtacccttgtatcttattgcaattttgcccctacttttgtaccaatattaattgttttccccatctttgaattatgacataaattttgctcatgtttttaacataattcaaatataacctgaatattgacatatttttatgaagatttgacaaatacaacaacatttccatagaatttaacaatgttggctcttggctccacacatgcgttgttgatgatatgggcttcactagtgctcattgtagacacatcatcgttgttggtatttcttagtgacattactagaaatataattctcagcaatgacgcccaaatattctcgatatatttatggttacagatatgatccgcaagcgcacggatataccattgcattatttcacccggaagtaattcaaggtatcatatttatttaattccaaaggtagatatgataagagaatactatgctaataatttatatattgcctatatacaccaatgtctatgcaggggttaatcaattcaagggtaggataaggttgacacatagaagaaaggactaaggtactcttcactaaaatataatctaggctaagtggagaaagaataagaaaagaatcattcatatacttcttgtatatagttaatatatttaatatattttgcacttgctagtatacaatcatgcaaccaataccccctagctataccctcctggtgtttcgagagaccacccctggttgccgatttccttaggacaacatgtcatggccatccgactggtaatgaatacagagcagtacccataccaggaaagtgtcttagtattatatacgaacgtgaaggaatatccgtactgagctgtcaccatcagcggcccacctcgactgacccgcagtatataaccccaattaatggtacctaataatctaagcaccatgctcacattactaaataatactccacatcgctgcagcagacatagagcaatcatagaaatgaacattaaacccacaccaaagcatatatctggtaagctagttacacaattatatcgagacaagtacgaactaaagttggtacccgaataatatgaatgaagtagaagaccaaagctatataaagaagaatatttcattaatactataagtcttacaaaagaaggaagagctagtagagacatacccaaaatcttctgaagactcgaggactaagagatctactctattcctactccactagcactagaacaaaaaaactaaacttgagagagcttcttgatcttcttcttgagtgtgtgatggagtggagtgatgtgtggtccttaaataagctaccaatgacgattgtggcggttggcattatccgaaataccacacaaccatcattgggtagcaatcatggatgtccacgtggaaggaggccatcaacggtggagctgggggttcggctgaacccagggttcagccgaaccatagactagcctaaacgggccacactttggcaggtgcgtctcctgatgactcctttgtccagtgatatggtggttgggcccatttgatgctatttgactagatttataagcccatccacccataagtctacctctcgacggatttcgattgatggttccgttaattcccatcaattctcctgcaattatgtaaagttctctgcaaacaaataaaattccaagtacatgtggagatagattattcttaaacaaaatatgcatgcaagcatagcttgttctcctttattttggatatattgacggttgaaatgggtcaataacaaccgccaatagtcatacagttgctcaatgctgacaatgcagtacatcgatctctctgtcaatgcctattcttgagcctatcacatggctatcccttgtcctccccatatctggcggctgcttcatcatcggctcatcgtcgagggtagctaatgctagggagaacccatcacttgctcgcccgctcagatgggggaacaatattactagaaagttcttcttccatttcatgaataatttttgcttttatttttccatcttaacctcaccaattgtaccaattctaggcctgccgaacatatgattaaagcaggggcaaatggtacattaagtttaaaataatgaaattaaaatcacaagcctaaatgtgggcccccagttttggaaaccagaaaccccatgtgtttacaataccaataccattccctagatcatcaatggtataaccatgacatagatgtatatcacattgcctccattgtcataaatgtcttaaaatacatataagggttacctgagtgggacccaaatggaccaaacatggtcttttacaaatacaattaccaaaagatgtagataagatagcgaaaccaaagttgcggcggtccacctctactccacatgcaacaactggagaacctaggtttgtactgtgtcttcttcgactcctccttctcactggtataactctgttgctatgggattactagaacacttggcattacctttaagtagtatgcattggtatcatgaaaacaaaacagggaaatcagttcatgtactctgttgccctgatccttgcaattgcagaatgactgcatttgaagctaataacttcaccacatattggtaatttttcttgtggaactgataagggaaattacataaatacaaaaaagaacatcacacagataaaccaattgcagtatgtgttgaacgttcctgttcctaaaaaaaaattcagttatggatgtgggagaatactgaaacccaagaaattgtgaatgcttacaaacatagaaagagttaaggaaggaatgtcagtaatgatgatagaaataaatgaactcactgaatttagtttagaggtttgaccttttcctctctctttttttaattagatcagatacaaagaaagcaatcatgtacgataatcttctcttccacattattcatatagctaattttagaatgagaaacatgggaacataatatatttatatcagggccagtactagtattgtggttagagggccatgcatgaagccactatcgcttgcagttcaacgatggtaatctgaaatcacatacatgatgattggaaatagacaaagtccaaaactgagcaaaatatgacaggaaacataatgcaggaataagatattccaaaagcaaaaagtagagcggtaataaaataataaaatggcataccaagctttccagcaattcctatttactaaatgttcgtctagcaaacattattggcatttgtgcaggtgtaaatatataatcacaatcagggtttgcaggcaagatgaataaataatttagtaatctcctgagaaccctgattcagctgagaattgggttacatataagttgagtggaacatgtccaaatatataaggattttttcttcatttgattacaacaaattgtacgtaggtagtagtaatgtaaacttccaccaaaattattctaaaattaagacctacccaatggcaccgggtttgcatttttatccatttcttaggattttcccttttgcgttagattagaaaggttgatcgttaactcgacgtttgttgaacaggttacgtttgcgaagacaaagccacaatagtcgacgaggagccgttgatcaaggcaagccactacgctcccctccttgtgcatgtgagtacctaaacttgtttgtgagccatccttaaaatttttatctatattccttgctgcctgagtctattatttatgcgtgaccaattattgatactgcttagtattgcttgtgtagacgaatatacactccgtgcttatattatggatgtggttgtggcgatcactcagtgggagtgattgtcggaagacgggtggagacatgagcgccacccgtaactaagaaccttttgcgaaaactaaaaactaaatgatgactaaatattttcgactaggtggcacatatagaatatgggtggctccacaaaatggcaagccgccaaccctggccatttaaggactgagtcaagaagctatatgcacgaaacgaacctagtatgaccgcacttcttgtatgggtaaagacccagcagactaagaaacccaagtggggtggcaccccagtcattgtagttatgcagttgtgacgattgtgacagaagatgtgatggattgactggatcaattgcttgaacaccacggcaaaaacctaaaatgcacctaagtatattattatatatttgtataacccccctagtatctcgggagctccaggactcccctcactaccgtctcgaggtagggttggtgtgccggggtgcaatgggtatccatagtccttggagcgagtgctgccaagcgagggtgaccgaaaaaccgagctgggacaaatctaatgtgttaggtgcatcacagagtgcgggaataaaagcgtacatccattgcagcgtgagtaaatcaatctatttgaatagtcattctcacggttaattaagcgccgggacttgtactactcttacttagaatagggttttgaagtgtgaccttgcccaatgtgcgggaaggtcggaatggtgaagatggtatgaaactaatgtgagggtaaaccagacaaagcgaggcttggggaaggtggatgaacccttgttgataaaggacaacaacaacttaacattgttttcagttaaagctactaagtcataggtttacgaaaagaattgcgaactctagctttatgcaaatgaaccaagccatccttgaacccctatgtgcactaaatgcattctgtattagtggcttgctgagtacggttagtactcacccttgcttaattaaatcttttagaaggagaggttggagctgacacgtacgtgtgcaatgatgataaagaggtgctgaagacggtggattagggacctaggttcaccagtcactgcctgtggaataagatgaactgtcactgcttcgcttccactaccttatctattcctttggacatttggtattgtaagtccaagagccgaacctccgactacaataattcctcatcgtctttgttaggaggcggttctcgcaagttgcgaggatgccgtccatctattactctggattcacttcaggtggtcgaggtatgactacgactggtcctcgaccagcagcgtagcggtcctcgtaccacgacttccaatggacgaggtatgactacgactggtcctcgaccagcagcgtagcggtcctcgtaccacgactttcaatggtcgaggtacgactatgagtggtcctcaaccagcggcgtagcggtcctcgtaccacgactttcaatggtcgaggtaggactatgattggtcctcgaccaccggcgtagcggtcctcgtactacgacttccaatagttgagttacggttacgactggtactcgaccagcaacatagcggtcctcgtacctcaatttcgagtggtcgagtgatgactacaactggcctttgaccaacagtgtagcgatgcccccactatttctgtgatttgttgagtacaactacatacctagtcttcacccagtgtggtggtcgtctcatcatcttatgtatgacaaacttctgtaagtttttatatgtgcaatatttatccattgatcgctttttcttatatcgctttcgtcttgaagttggtcctatcgtccctttacgctaatcagacaaagcctccgagagacctaagggaatttcagcaggggacaccaagagcggataaggatttgttagatgctgagagccagacgaccatgtcagatctggtcatgtaagagtgctcaatggacgcgtattaactaagccatgcaatcgggaattggtttttccaacttcactgctgggggctaggatttgttagcttcagcatggtttgctataagatttaagctgcctttgtggaaaatggcttttccataaaaacggttgggggctaggaagagtaccaaactccatttgctgagggcaattctagcgagcgtactcttttattgtcacacgcaaattcaattcattttcaatttttccatacatattataacatgttaccctttgctgcatctttgtataagtctgattcagtcaaggccatgtgttcaataccccaagaagactcttttgctctacccctatcagatgaggcttattcagaattcttgcaacttcaggggaatctggacaacttaaacttgcaaccagggatgggggatgcttggatttttatctggggcacagataagtacactgctaagaaattctataagctaaattatgctgggatgcaaccccctaggcctatgatatggctatggaaaacaaaatgtgtaatgaagatcaaggtctttgcctggctaatgttctgtgatagacttaatacaagagatatgttggatatgagacattgtgccaaagaagatgattatctcacatgtgttttgtgcaatgctaactgtagagagataaggctgcacctcttctttttatgccctttcagcaccaggtgttggcaatacctgggaattgagtggaatagcaattgtgaatttttccaaatgatctcttttgcaagaatcaagttcgcttagaagggtttcctggaaattttctttttggcagcttggcacatctggaaacaaagaaatggcttcatatttcagaacgtacaacccacttttcaggcatggagatctctcttcgttaaagaagttcttctgcatatgtgcagaatgaatgagcctttaaagcaaattgtttctaattgggtacaaaccttatagtatctttgtgtgaaccacatgtaatttttgtaaccttgtaaatattttcttgctctataaaattacactgctaggcaaagccctggcagttttcctggtcaaaaaaaaaagatgttaccctttgagcattcgcacgggggctatttctatttaatattctgtccggagtattgattttaggaaagttctattcaacgctgttgaggactccatgtctctacggtcttacagtacgacaaatgttgacaagagaaatcgcggatgacaacatgagttcatttaagttgaaggctctatcgtagactctacaccctcttgataaggaacgtggaatgaagcgatggtgtacccaccgagatggaatttattgacttcaatccaaattctcgattacggcaagatgggagacttagtcgcatgttccgtaccttgtcggtcgacatcggagattaacctagacaaacccaatatagtgtttgcggtagtcgataaggggaatctagcgctatctctgatctcaccaagaacggtcaagtgagcacgacaacagtttttcaaagggcttcagtcgagaacatgaactcgttcatttgcattgaagtcgggggctactgtcatgggttatggataccacatacctaatagtagttgactaagctcgacagggcccaccaggtactaagtattatacggaatcatacctcatatatagaaggagttccggataaggaaggacgaatagagttctatatggaaacgataaggactacccgaattgtatccatattggtctccattattatacttggacaaggggacatctatgggtataaatagaagacaacctagggggagaggggaaaacaacaacaataacagatagacacacaatacacaagctaacacacgccgccggatatcgacatcagagataagcctagacaaacccaatatggtgtctgcggaggccaagaagagggatctagcactacctctgatctcaccgagtgcggattcgaggaggaagactacccagttgtcgactacatgttggttatctatgccgccaagttgacgacagctagatgggttatcccaaatattgtacttgtgtgattaagatgaataagagcaacaacggctttggccaacaggagtagggctattatctatcagataaggggccggaacctgtataaaaattcttgtctctatctcttttacttcaatcttgcatatacctgagtaccaacgatccccatactatccaaaatacggtctatttggatctatttgggtcccatcgggaaacccttgtattattaatgtaatgaaaaacctgtgtaacgatgtcagctttgtgacctacaacttaccatgtgtgtatcatctactgatctagggaatgatattgtacacacatggggtttccggtgtacaaaaccacgcggggggcccacaatatcaaatataagtcaaatttatcacaaaatctaaaacctattagagtgtagggtcaaataaacagggacaaaaatgtcattttgaccgtgagttaacaccgtgaggttggtttcgtagaacaaggtgagctcatgaccgtttttgaattagagggtcaatgtaaatctgaaaaaatagggctaaattggtagttagctttcaaaatgagttcaatatgcaatttcctcaacaagttttgtagatgtgtatgtcagattgagggtagaaggcaatgcgcggtttctatatagcacaaggtaatatattaggttgatactagcatgatatttggataactacgtttatctaacttgtgcagattgctcaggcaattgctttatctaaggccttaaagcaagtttaatagtatagccaactgcgggctccaaatcatctatagtcaacttaacagccaattcatacaatagttacctatcaatatatactacataattaatatatggtcccatctgtcctacacacatataccttggagtccgtgctgcagctggctacaaatctatagcccactgtccttctctctcctcttttatctcctcgaaatatgtttatatagcttgctgataacctactatcactagtacatatgtgattatgctggacggcggctcattttggttccaggcgggccataagtggctctgcctggaaccaggcgaatgctggggtagggtagtg

SEQ ID NO: 32393 - DNA, 27893 bp, Oryza sativa
  unsure (1)..(27893): unsure at all n locations
gcccactgtaggcgaccgcttgcgatggtcggggggcatataagcccccagcccgaccgaccgttgctaagaatttctagcggtttctctctcctaaacatccacaaattagtggggaaggttttcgacctcaaatctttgattgggttccatataaaaggtgtagagctcgttctcctccttcatttgcttccatttttttcagttttcatcggtggaatacgaagaaacttgcacttttataaatggagaatagtgtaggcacctttttgtttttttattttttaagcaaatacatattgcaatcttttacatgtttataaaagtaattagcacctaagtttaaacgttgggtttgcctctattaatttattttcattcggatgaaaaaggacgaatatttttattttttagaaatggatagacagtattctattaatgcttaaaattgatgtgcggttgtttaaatagtctgttcaactttaaattactacgtgattagttccctccaatttaaatacgttcgtgtttgaatcggtcatggatgtattaatggcaagctttattataggtcatggatcggacatggatgtacaacacgaaaagagctcatccaacgttcttgaaggaagcagccaaatttgttgagctcgcaaaggcacatgctgcgagcgagaatttgaggagcattttttgcccatgcaaagtttgtaagaacgagatcttgctgcaagatctgaatgaagtattgtcgcacatcgtagaacgaggatttaagaagggatacaagatatggacttttcatggggaagccggtggtcgtaacgaagagttagatgatttctgttttgatgatgcagaaaattttataatcgaagacatgtctcagtgaaacatccgggaatacggtggctcaggtatagagaatgaaggtattgatttcgatctggaagatatgttgcggcacgttgaaccagagatcctaactggtacaagacgagggttggacaattgggaagcgttggaaaaagcagcgaaggagcttttgtatgacgaagccaaaggatgcgacaaggactatttagtactgcgctcggtgcttgaacttcttagattgaaggccagacatggatggtcggacacgagcttcaatgatttgatggatcttttgggagtaatgcttcctaagccgaacctgctactgacgaacacatatcaagcgaagaaattgatatgtccattgtctctaggtgttcagaagatccatgcatgtgaaaatcattgcgtactgtaccgcaaggaattcgcagatttagactcttgcccaacatgtgggacgagtcggtacaagacgggcaacggagcctccgatggagaggtggtcgacaaagatgatgcaccggtggatgagaacaaaaagattcctaggaaggtgatgtggtacctgccagttaaagatcgcctgaagcggctatattacaaccgagacgacgccgagttgatgagatggcaccaagagggtaggaatattgacggtaagatccgacaccccgtcgatgctcgacagtgttaaaactttgatgcactacacccggaatttgcaaaggacccgagaaatgtcaggtttgcattgagcacggacggaatgaacccattcggtgacctaagcagcacacacagcacctggccagttcttctaacgatgtacaacttgcctacatggatttgccagaagcgaaagtacattcttttgtctataattatacaaggtccaagacagcctgggattaacatagatgtgtttctggaaccattgatggaggatatgcaagaactgtgggaggaagggttacgaatgtgggatgagtaccgtagggaacatttcactctgcatgccatcatagtcgtgacgatcaacgacttaccggcaaacttttcattctcgggccagtttaaggggaagttcggatgcctcatatgtatcgacaagacgtcgtacaagtacctcacctcgtcaagcaagggtgtttacatgcatcatcgtcagttcttacctcaaaggcataggtggtgtgcgaaggctagattattcgacaatacagtagagaactttctagctcctaaaacacgtacaggtcgttctgtcttcaagttgacaaagaacattaaggttgtgttcggcaagccaaagaagaagcccgtcaagagttagaaacgtacggatcaggacacaactgatgcacctgtagaggaaagtaaccagtccttcaagaagcactcaatttttttcaggtatcttgattactggaaagacatggaggttcggcatgccatcgacgtaatgcacctggagaagaatgtgtttgatagcaccattggcactttactggacatcccgagtatgacgaaagatgggttcaagtcccggaccgacctcatcaatttggacataaggcatgagcttcacccaaaagagctgccaaatgggaagatcgaaattcctccggcttgctactcactaacacctgacgagaaaaaaatctttatgtacatgcttgcatagtgtgaaagttccgaccggtttctcagcgaacgtcagaaaactcgtatctctaaaagatttgaccatctgtgggtaccatgctcatgattgtcacaagatgttaacagtcttcctacccattgccataagagtggtcaagccagttcacactcggttagtgataacaaagttgtgctactttttcaatcgagtatcacagaaggtttttgatcctaaagagttaggcccccttcaaacttttgcaatcgagacaacatgccagcttgagatgtttttccccctagcatactttaacatgatggagcatcttattgtccacatcgtacctcagattatcgagattggtccactatacctacacgagatgtgggcgtacgagaggtacatgtccgtgctgaaagggtatgtttgtaaccgagctcatccggaaggatcaatgatagaggagtacacaactgaggaggtggtcgaatgctgcatagattacatgaaggacgccgaacccatcggtgtgaccccctgtcacaccctgaagttctttcccaagcctaaattgaatttataatccacccgagaaaatattggtgtaaaagcaagagaaaccctaataaattaatgcaaataataatcggatttggcatgtggaatttttcttgagttctacatgtcgaaatacgctaacaagatttttagtggaattttcagagctctattaataattttaaccaattaaaatggagcacaagcaatattaaatccctagaaaattcattttcctttttctttctttttcctttctctttttcctccgaataggccgaggcccatacgcgccgagccggccacccgcctcctctcccctggggtcgtcgacaggtggggcccacctgtcgggcccgtccccttcctcgcgcccgcgccgccgcgcccgcaaccgccgccgcgcccctctcccgcgcctcccgggccacgtcgccctcgcgcccgcgctccccgcacccacttccctctctctcccgctcgcgcctgcgcccgagatggccgggattcgaattacgaatcccgcctctctctcctcccccactccccacgtcggccagcgattcccgcctctaccggccacgtccgagctccccctcccctattaaagctccaccgccaccccctctctctttttccccatctcgccgagctctctcgtgccctctaacgccctagcgccgtcgccctcctctctgccgcggtcgtcgccgctagccgccgtgccgagccacgccgtcgacaccgtcgtgttcaccgtcgtgcgggccgttccgtccaccccttccccgccgaaattcgccgtcggcctccactccgcgccgtgcgccggtgagcatcgccatggccgccgccttctgccggcgtcctcgccctctccgttttgcctctctccctctaatcctttcctttcgattccttaggtggttccgcagatcgtctcgccgtcgccgccgccctccgttgctcgccgtcgtcggtcgccatcggtgaggcttccccttcgtctctctctctcgcgccgctagtcgccgcgctgccgcctagccgccggtcagtcgctgcctaactgccgcttagccgcccgcgccaccgctctccgccgccggtcggtcgccgccggtcgccgtcccgcaccaccgccgcatgcgcgtcgcgccgccgtgcgccatggtcgccgggccggcttgagccgtgcccgcgcgcgccggccgcgagccacccccgccgtccgatctacccttgggtagatcgggaccgcccgttcggccgcccacgtggctgccgcgtggccgccgcgtcggcgcaacgtcagcgccacgtggtgcgccgtccttccccggtccgtggacccgatccaccatggaccagcgcccgcagccgctgacatgtggggcctgcatgtcggcgccgccctctctctcctcgggatttatttattgcgcaataattcaattaaggatttttctgtttatagtaaaaacacagtgaatcatctaaaattcataactaattcatccgagctccgtttaagcccattcaagtctcagtaaatcaagaaaaatgtgtagaattcattaaaaatggttttgttctctgtttcagtagtcttatagcctgtttgtattgtttgctttgtttgtcgcatagattccggctctcccgacgctccagtttaccttgaaatagtcgtcgaagttcctccagctgcatagcaaggcaagtcatgcttgtcgcttgatcatgttgatcctatattgcaaatgctctattgttttccttcaaattctgcattgttttacaataatcctatgggatgcttacctactgttatagccatgctatttacttgatatccgttcctttgttaacttgggttataacatgactagaggttggattagggattgcttagccatgcttagttcaactagcacacaatgggggaaataatattaatgtatagacttcaggttctagtgttgatgttggattagtatcaccgttctggtgttgcttaattaaaataaaccttatggtgggctgtgggtgcatggttttgctagttgtgtcacgcccggaatttctatccaaaattccaaacgcttacatgtgtgtgaaccctcgtccaggaatcagccgaggcacacaataacaaattgataatagagtacagttattactctaattaataagcgaataaaatgtcattacagaggtagatagttcctctcaatcaataaagatctaagcagcggaaaataaaataaacggcgcagacggctccactccacaggcagcttgaccaaggctacacctaatcctccacaccatcagcctcattgtagaactcttcctctgatgaatgattgcaagttgagtatatgacatactcagcaagccacgcagcaaatatgcaagtgcacaggataacaaaggatggcataatagggttccatttgcaaaagcagcatttagcaaacatttcagaatttaataaaacagttatgtaataattaaacaatattaatccaacactatacaacataccctgttgtataggcccaaccattctgaacaaccaccccggctgcacagttctatctccaaaccaggaatataccattccaaaccaggagctaaacaaattattaccagtttaagcatcttttactataatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcgggaaggagttgtgacaatacccctcatacaacacaatccactgcagcgcaccttcctggttcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgtccatcgtgaactatcattaagccatcattaaataatagtgagtcataagttatcccaatagtgtgctaatgtttctaagcagggctaagcaattatttctaatatctagttgaaccaatataaataaagttcaaccagtcaaattattataacccaaggtatcaaggaataaagtaatcaagaacaaaagggctatagcaaacaataggttaattccacccaatgacattcgaaaataaatgcaatagttgaaaagaaataatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtatagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggcccagatcgatccaatccaagacggacggccgagatcgaacggtccacgaccggctcacggcggacgaccccgatgacgtcggcaatgacgtcaccgacagcggcggcggctcggcggagcggacggctcgggcggcgcacgctcgccggcgaacggcggcacttcggcacaaacggagggcaccagcacgtagaggacgacgcggcgaactcaccggtgaccaaaacggcggcggaagaacaacggacgatgacggcgacgaggaggaagcggcggcaaccttcgggtcgacggtgacggcgatgctccggcggtcttcggcggtggcgaaggcccacggcggtcggcgacgaggaaggaaagatcgggaagaacgaatccgagacaaactcgaatccaacgctttccaaaacgatttagccaaagattccaaaggagaaaaggtagaggagatcccgaggatcatttcccctctatcaattcggccggaaacggaaagggacggccggattggaaagcggcggcggcggcggcgcgctagggtttcggccggaggaagacgacgggcctgacaggtgggccccacctgtcagcggtagcgagggcgcgcacgcgggcggctgcggactgggccggactgggccgaggagagagagagcggttttgggccgactttcggcccaaagccaaaagaagattttttaaaacctttttcaatttaaattatttcttaaatgcaattccatttattaaaaatactttcttagctcaaataaatcccagaaaaaatctaggaattatagaattaagcaaagtatttaatgaaattttatctggcccctttttatattggaatttattaattaaaattagatcttctcttcaagacttttaaaataaattctaaaaattaaaattaaacaacaatttatatattttgaattttcagggtgtgacaagttgcgcccatggcacttaaggaccagatcgcgggaaaccctagaagaattcctcgtacttaccacaagccagcatgggcaacggctgggcttgtagtgtagctttcctctagctgacgcatccaggcaagggtgagcgtgatggagcggggcgggccctgtgacggcctctgtcgcttccggattcacctaggcacgagaggggactgcccgttgcccgctggggacgggggtgaaacctgaggtgtggtgtgcttggctagaggggttatgcgaagggtcctatcacggcctctttccggtatgtcatggtggcatgtcggcgcacggaaacgtgtcgtggggctgtgtcttgtgggtacagttgtacacctctgatcagagtaaaactattcgaatagccgtgcccacggttatgggcgatcaaccggattcaccgtgattagactcactctagattagtctaatggaattgaataatataggtggatggttgggcctgttgcaacgtggtatagcgttggacagtggatgattaatattgattaattgttacaactgctttattgctttcacttctgtttataaatgctcgctttatgcaaatgaaccattatagctgtcccttgataattccctgcaccatgcccctattccggtatgacttgctgagtacagtgggtagtactcggccttgctctattttccccaaaccccaaagttcgagtatgcgtcagatgacggtttctccgaggagtaggcttcgtccgtgccgtcgagtgtgcctgtggaatggtattcccgctgcagtccaagtccagacttagctccagttatcctttatgttttccgctgcatttatgtaagacttttataatgtttgtaagacatggatctatatgtcaactttgtcgtttgtgtacctcggccggtcctggacggggactttaatgcacattctgcttggaattctagttgggaatttctgggcgtgacaccccccctttacacgagggccagttggctgggacggggatcgtaggcaagaaaaggttctacgatgacgacttcaaagatgtagcggaagcacatagcagtgttttgcaacaactcaccatcttagagccgtacattcaggaacacatgaacgagataagagcccgcaaccctagaagaacggacatttggatttgtaaagaacagaaacggaagtttcctaaatggttgaaggagaaagatctgtcgttgggtgattcgctggaggaaaaaactttgcgcaggctagcaaatggcccaactagccttgtgacctcatggcaagggtacgacatcggcggatatggattttacatgatattcaaggacaggaaaagcacaactcagaacagcggagttcgggtggaggtgtttgacgcattaggtgagaagaagtcttactacgggatcatacacgacatttgggagctggactatggccttaacatactgatcccagtgctatgatgccaatggatcagagaacagaacaggcgtattcatcgatgactacggcctgatggttgtggatcgtagcatgctaggacacaaggatgatccgtgggttcttgctgagcgggttgctcaggttttctatgtcagtgacccttccgacgataagatggccattgctgtactgggaaagcaaaacatcgttggcattgatagcattcaagacgcatcagattacaaccaatacgacgacgtccctttgttcacaggttttcctaaccggatcaaggaagttgagacaagccttgatggagatctgtttttgtctgcgcggaaggatggtgtttccaaaattgtcaaacattagtgagatgtcgatcctgtgtactacctattttgtaaacgattaccggatgaaacttatattgcaaatgagatagggtatccatgtttatccgtactatatgtcgttttgaatttattttatggtccaatattttatttatattaatcatatcgatgaataattagatgcgaagaaaattcatgtctgttttaattctatgttaatctatatttgtattttgaataattcgtggtttaataattatacttattaattaactataatttacatgggactataacaaataattaactatttttcaatgtgttatagtcaatataataattaatacaatcctaggcaaataaagatatttttttaataaattgggctttttttcttcccgtgcgggctcgaatcgattattccgtgcggcggcctaagcctcctccccagcatccaccgccgcctcctccactcatcggcttcctccaccgccgctgcttgcatcctctcccccccagcccaccaccgtccgccgcctccgtcccctcgctcgacatcgccgccaccgctgcctccctctcctccatccccctcactgcctccctcccctccatccccctcgttccacatcaccgacgccgaccacctcatccccgtcgacgtcgacgctgacgccgaccacctcatccccaccgacgccgacgccgaccacctcatccccatcgacgccaccgccgattgcctcctcgaccgacgctgccgacgtcgccgaggccaccgacggcggacctcctccccaagccgacgacgccaccgaccgacgacgccgccgacgccaccgaccacttcctccgcaagccgatggccacctcctccccaagcagcggccacctcgcccccaagcagcggccggccacctcgcccccaagccgccggccgcatcctacctcctccccaagcctcctccaggtacccctctcttcgccgctttcttttttttggatgatgcagtggtaatggatggaatgatgcagtggaatggatgattgaatgatgaagtggatgatgcatgcagtagatgcaatgttggatgaattttttgaatgaatgaatgattttaggttgaatggatgaatgaatgttgatttgtgatgttgagatgatgatgatatttgtgatagatagatggctgtttgtgatagatagatgatatttgagatgatgatgatatttgtgatagataggacttgtgctctttgtgatagatagatgtatgtctatatgggatatatggctgttttatgtcactgtgggtttttttttttctacacatgatgaaatatatgcccctgctgaaatataatactaatttgcaaatgatgctgttatgcccctgctgctgttgtgcatatacatgatgaattatattttgcttctatatgtttatatatatgtgatgtacatatatgctgtttatttttgctgtttatacttgtttatactgtatatgctgttccgcacaggttttatatatgctgttttatacatgtttattttgggtgatatatgtgggctgttttgggtttattttgggtttattttgggctgttttatgcctcactgtggttgatacatgtgggtgattgttgtgggtgatatatgtgggctgatttatatgtgggtgatatgtgggctgttttatacttgtgggtgatatatgtgggctgttttatgttggtgataaatggccaatgatgaatgctcaaagaacagatcatctacacttgtcttctgaatttttttgggggcaatccacttgtttttttctcaagaacagaacaactacacttgtgaaatattttggggggcacatcacttgtttatttttgcttgagaacagacaactacacttgtgaatttttttgggggggcacttcacttgttttttttcccacataagaacagaccatctacacttgtggccatatgctttcatagtgtgcatggtgatgaatatccttaccaatcttgctatcgttacccatcttacgttccttaccgatcttgctttccttaccaatctcctaaaattagatataggaggtgtagttcgtacgttatcatgccgctataatatgaagtgttctggttgccaagttggcttggtcggtttagttcctggacggaaccgactagtacaaattggaaaaacagaacatttcgtcaacatatgacatgcgttggtcattcgtaaaatgtgctggcacgtctgttgaaagatagacctctgactcgtacatgcgtcggcctcgtggatggaccaggagctcgacattccttaaggtcgttctttccgacccatacaaggttccgctgcctgcattgttccaagagtgtcttggacaaaagcaggaagtggaaccttgttaaggtcggaacgaactgccttaaggaagtcgatgctccaggtccgtccacgaggacgacgcagctaggagttagaggtttatatttgaacacacgagctagccatgtgatcaaaacatgtttttactttgctgttaatatgatagtttagtttagtggttatgatagttcagtggatttgaacgaatataaaattgagttttaaattattccattgtaagaacgcgaatcgaagatgtcaggcaagacagctccggcgggcacagaaccgacggtcaataaacctaatgggcaggacagcttcgtcggacacagaaccgacgtcactaacaatccccaacacaaagaagatgccgggaaggtaccggcgtcgagcgaggaattgtggcgcacaccgagcgacccgtttgagctagaactagcgcaattgcagtatgaaagacctgaggatgaccccgattatattcctatcaagcaggcggtaataacttaatcctatcgaaatatatattttgaattgaactttccccgacgtagcggtctaatgacttaaccgtgcagatggcaacccgtcgtcggtcaaaacgaagtgccgtcagggttgaacctgattcggacacagcgacctcgggatcaccgcaaacggacacgacgacgagtggtgaagcttgtccaaagaaaaaacgtggcgagaagggcaggaacctcttgccgaaggagacgtactacattgctgctctcgacgatgacggcaaacccgtcgagccggaacatgtaagggcgaagtttagcaccgcatgtggcgcgctggcaaggcttcatgggcctctcaacgtggacgaatggaagcacgttagcattcacatcaagaacttaatgtgggaaggtctgcaggagcaccttatttatccgcctgggtcggagtcaattggccggaaatttgcactgcaaacaattgcccatcggtggcgacagtggaagtcggacatggacaccaattatattcagaagaataagactccatttgaagaatgtggcaacatttcagcagctgagtgggacaagttcgtggccaagatgacaacgcctcaagctctagaaaggaggaagaagttgttggacctggcgaagaagaaacatatatccacacaggttagggtcaagtggatacgccggtcacgagaagaaatggcgagctatggaggaaaagtttgtggccgaaggcaaacctttgattgtgcagcccataaataagagaactagaaattgggtgtgggcaagaacttcggggcaagtgacagaagagggtgagatgctgttggactgtccggacatccagaacgtgaccacgtctctccagtagatcgtccagaaggagaagaccggtgagttcgtccctcgacggcagcatgatgagctgaccgaagctttgggaactgtagaacactccggtagggtcagaggacagttgtgcaggacgaattggaaggtagggtttccacagtgtcggtgacatgggaccgggagtatcatgactagaggtttgggcaggagcaatcacccacgtggcctgaccccctcgggggggtcgggcccgagggtgatgaggccgcccctctctttgtctccccgagggatcggaccactcccgtttcggccccgagggctgaggcgcccctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctgtagagccagagagctcttactctagaaaccctcttctcccttttttcctctcgtcggatctactctccagatcctctctctctctcctttcgtcgtccctcctttccgtccccccttaagtgggcaaggtccttttacattcgtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaatggagttcgggtgtcaggtttcgggctcgggccaaccccgcacccccttcaggcgtgcagggttggccgggggctaccacatatgcatattttttcttctatctgtatttcaataaaagcattttcgattttctaaaggttgtatctgtgctgttgtttccttttgaagaatcttgacttgaaataggtcactcgtgctcaatcctgccctcgggggctcgggtcggctaaaatcgccaaaaggggccagaaccgagccgtgccccggggcgtggtgaactccgggggggaatcggcaaaaacccacaatcgggtcacccataaccctcggtcaccacgctcccggcctggccagtctcgacatgtggatctccccaggcaccagccccgacccgagccatttgaggactgggacctgggcacgagcccttgttcaagctaagacacaaaaggaccacggcacagatcatcctcgttctcaaacacacagcaaaatgaaattgacacagaaatttctttattttggttgcagattaagttaatctatacaaaaaggaggcctgaaggcctcggaagaaagaaaagaagaaaaaactatttaaagattggcgggggcctgggggctcactccgatgcacccgggtcgccagcctcgtcgccactgtcgcccactccgccgtcatcgtcctcctcatcggagttgagggcgaacgcgagtcgaggggccgaaccctcgaagctgtggacgatatggttggcggcgtcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcctctcgagctcctccgggagccgctggagagtcccggccatctccgagaggcgttgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaattcagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcaccttccagattgcgacgcgcttgttcctctagcgcagcctcacggagggacgcgctctccgccagcctttgcgccgcggcctcagcctcctcgagggctcgctcccgctcgatgagcgcatcttcgcggaggcggagtgcggactcctcttcggcgcaggcggcttcgtgcgccgccagtgtgacctcccgaatagcaacggtggcctcgcggtccgccaggtccctctccacgacgcaggcacgctctaccatcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcacgtattgaaggcggaggtcgtcctgcgcctcgttcatcacggtagtggcgatgagggcagccccccgctcctcctccacttccctggcgatctcccccagcaccttccgacgggcttcgagctctgaggcgtgccggcggtgtgccttgcggcccacctccaccatggcctccactgagcgtcgcccctcttcgacacgcgcccatgcggcgtcgagctccgcccgctctgcttgcagggcctccatctgggcacttaacccgtccaacaccgtggtgtttgcgacggccaaggcctgcagaaggggctctgcgctcagtggggcagcggaaggcgtgggggagagccgcctcggtgaggatgccgcgcggctcggcccgccgatggacgtgccggactcggggacgtcccccggacctggcttgtcctgagcgtcgcccgagggagtgggcccaagcgatgcgcccgcggcctcgtcgcgagctgcctcggaagtcgtcgtcgcctcggcctggcgaagtctggcctcctcccgagcggcttcttcagcttggcgagctcggacggccacctgggcagcttcctcggcttcccgaaggcgatccgcggcttcttgccggtcaatttcgcgggttgcctcggaggatgtcgtcgcctcggcctggcggagtctggcctcctcccgagcggcttcctcaacctggcgagcccgggcggcctcccgggcggcctcctcggcttcccgtaggcgatccgcggcttctcgccggtcagattcccgcctccgggcctccgtggtcgccgcattctcggcctcagattggccggacttggattggcaagaaggacgcgacgggatctcgctgaagcagaagaaaagccagaagacaaacaagatgggtgaatgaaaactcgcgttgggagaatgaatatagccacaatgggcgtgggacgaacctgcgaaggggtcggttaaacgaccaccttggaggggaaataaggtttccccgggatggttctgtcccccccatcttgcggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagcccccatcacggggcccggaagcacgaccccctcctggggtagattgatctcccttgcggctcccgctcgcaccgtcatggcccttaggagctcgctcctctgaggccccgaccgccatcatgatggtcaggatgttggcgcgatctggatcgctgcagagggggaggactccttgggggatgagggatgcctccacggagctgagattcagcacccgttggatcattaccttgaagtcttcagggacccagtcccatttgaccccccggtgggtcctcatacagtcctcggacccagtgtactcccaggcgccccgggcgcgccgctggagtggcgcgatccggcgacgaaggtagtcgccgtacaccatcgcccctgtgagcccctgggatcgcaggcccgccaggcggtcgaggacggcgtcgtagccatctcccagatctaccggcgcccgctagctggaggcctgcgccgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacactggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgccgggtgtccctcgcccagcgtgactatctcccggccggtggcagattccggcatgaagcggcgcggcagcccggcctgcctctcgctcacgatgcgggaaggcggcagcacgctaccatcgagcggagcggagccccgtgccatgacgccggaagaagagatgtttgagagcgagcgcgtgtggcgagggtagggcacaggaaacaaggagttagggcgcaagcaaggggaataatggcgagaggaaggaagcaaatctcttcctcggtgtctttatacccttgccaacgctgtacccggctcctcgcttctcgcgcccactatctctctccctcgtttctcgcgcccacgcttccactaatcccattcgcccgcttgcggcgcacgaggtggatatgcggcagtggcggtcgagatggaacatatcgtgcgcgcgttaattacgctcgccgaccgaagcgccatcaccatatctccaggcaaaacgaaccggctcgtcccgattcgcgtgctactcgagtaatgtggcagtcttgaagagaccgctcattattgacagccgagttaccattgccgatgtgtgtgatttgcgaccgttgggtttctgcccaactgtagagaccagccccacttgtcaccaggcctaagtaagtggcgtcacgcccgaccgcttccctcgaggagggcgatcgccctggcataacgccgggggctactgtcggtgacatgggaccgggagtatcatgactagaggtttgggcaggagcaatcacccacgtggcctgaccccctcggggggggggggggtcgggcccgagggtgatgaggccgcccctctctttgtctccccgagggatcggaccactcccgttccggccccgagggccgaggcgccccgaccccttgtgggttttgcgccgcgtgtataggttaggtgagcacggcggggctcacctaaccgcatttattgcggtttgaacgagcgcgtcacgccgaatgtaacgcagtgcagcgcgctcgtttatccggtctgtgaccagtcacagaccggtcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcccaaccgttacaagcaagatattgtatgaagaagggcgaacatgcagattgctagactgacacgtggtggacaagaatgaccgatttgtgaccggtctgacactggtcatgtcgtcggcagacaaccatgttcccacgttgcacctgcttccggcggagtggaggtaggtatgggccatcccatcagaaggtcattcggacagcagccattgcaagtctccgcccatttatgaagagatgacagggtgatccccgaggtcagacgagtgaggacgcgtggccacactaaaaaacaagcagtgtttttagctttctagagaaggcaagccaagtttgagtaaagataggataagtccccaccaaaaagagaggtggtgcatgtggtatccccttgagatataaaaggaggaccttgcccactgagggaggggagaaaaagaaaaaaggagagaggatctggagagtagatcccacgagagaaaaaagggagaagagggtttctagaggaagagctctctggctctccagctctttgtagcttcttcatacacagatccaccagaacacaggagtagggtattacgcttctcagcggcccgaacctgtatacatcgcccgtgtcttgtgctttttccattctcgcgaactttacacagactaggagcttagaatctcacccagggcccccggccgaaccggcaaaggggggcctgcgcggtctcccggtgaggagccccacgctccgtcacacaggaagcccaaagttacaagaagcgcgacgcctacaaggccaagatgcgccaggaaatcacagatcaagtcacacaacaagtcacccaacagttctacagtcttgccgcacaacatcctcaagccttccctgacctggttcctcatggttcgcagtcgacacagatcccaagctctgtcgagtcggttgaaaatacaacctacccggtagatagtataactggtccgacaccgtgcaaccttgtcgttccgatagggagagcgggaaaaacaaaggaggttgcgtctggattggctatatcggggagacagttccataatagctcaattctggtggactatgcaagggttcaggtcgcacgtgttcatggcgaccagatgtcgttggagcttgacatcccaacaccagaggggattgaacttctcggggatgcggttaaccagttcatactctggcatcgtcgtgacatcatcctcactggacagttcacgttgatgacaccagctccattggtgccaattacggctgcacctcctgcaccaccgtcccctccgatctgcactaccccacccggatctccactcccacagatatcaccagttagaggtccctctccacctccacaacaagtagcacctaactccccaactaccctacctcggcagccgtctcctgctcctcagtcctatcttgtcccaccccttgacgaacatgtgccacctccacagccagatacatcaaaggagcagccaaaaacctgtgaagcccgcaagctcatacccgttatagtatccacgtacactaaggagaaaatggcagagtatgagacacggatggttttgcaatctttcaagggtcgagggggtccgctaaagccagttggacctgatcagtattcggacgcacagaagagcgttgtaggtcttgctgacaaaatgcaatcttggacctccgatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccgggaggcgctttcaaggatggacctaatgcaaacttcgccttcagtttcaaggacctccacgcattccttaagatggataaaatggatatcaatctcgtcggcgcgtggtgcctgtaagcattgcatgtacttcgttattacccaatgtgtgccaatataattgttacttattctaacttccaaatttcctcaggtcacaatgggtagacgctcaaaaaacgggggcctcaatcggttacgtaaatccaacgatggtttgcgagacggcccacactgtgcggatatcggaggatagtgcggtactaaagaataagacacctcaggaggaaaaagattacatcgagcgtctgcataagagaaagatggccgaggtgggaaattacttggccacctcatctctcgcacactccgacaaacaagtcatcatggtcccctaccactttgggtaagcaacttcgacatatttccgttcacatattaataacagcacatgaaaatatgtctaacataatttcataatccgtgttcgcagcgaacactacatactattcttcgtctatccaacagaccaaaccgtcgtagttcttgatccagcggaccatgacaaggacgcgtacatggagttcctatgcttgttgaacttgtaagttcgaaacaattttcgtaaagattccaactttccgtaaagatcattaaagtagatttatcataagtaattaatttatttttgtagagcacacggccgttataagaaacatggcgggtacgtaaagaatccaagtagagagaaattgtacataaggggacactggccggtatgtcagcatttattcggtacgtacatcacgattgtcacttcttatttctgacgtgtccacttatgtatgcaatgttataagcaacctagcttgacaaacctatgcggttattacgtgtgcgagatgctcagggtcaatgggagatacagaactgagtttacatatgtaagtcattaaactctcctattgcaaatagttcattaaacatgactgtaacacaaatcatttgtcttttaatttccgtagctcccgagtatcccttatagtgcaagttggttcgatcagagaacgcttatcaacttgtgcgcggacttgtgccggttcattcgtcgcaacatctgcaatcatctaggagagttccatgatcctcatagcgtacttgctacggaccccaaattcaagaatctaagagagtgggagaggcaacatgctgtggactaaatggatgtatttgtcgcgagggatgcttgtaataaacactatactttctatgtaatatgatttaatttgatgtttcggctaattttccactaattttccatctattgtcccgtgcgggccacctaatttgaccacacgggaaaatagattatcctgtgcggtcagccttactgcaccacacgggataatagaatatcccgtgcggtccgtataaccaatccgcacgggataatcgattatcccgtgcggtcggcacgcccgcacgcgaaaataaagattttcccagacgatgagctgcaggcgggccgggcgaccgcacgggataatctatccaaccgcccggaaaaatgggtattgtagtagtgtattgttcttgctcttacaaaaaaaagccctttcttttcctagaatgttggaccctctctcttggagtcataagcgaagtggcatgataagatgaagcaattatcattccataaatcttgtgccaaaagcaagcacagaaggtctagataaagctagccatacccacaaatgatgatactacccgttatgatggcagaaaaaatgaacatatggagaccgaagaggaaaattaagagacccatagataagagaagggtgaagagccaatacggtccctgaagtttcgcttcgggctcaggatagtcctcgatgtttcaaatcgtccaaataagtcctccaaattaattatttgggtaaatatagtccttggacccacaaaaaatgccgggtgagcatgcggagtcatcatcgcgtgcagcggtatgaatggaatgaaatgaccattctacccttatataccatatggaaaagaaagaaaatacaaacaaaaaaaataacaggctatcccaggccagcattgttgcggatgggtggccgacaaaggaatttacacgatcaatgcttggctgcagcaatcgtaagtgacaattctaaaatgatcatacatgtgtgaatcatttatcttcttcttttctttcttttctatatggtatataagggtagaatggacatttcattcataccactgcattcaaggatgacctgcgatgctcacatggcactttttgtgggtccaaggactatattaacacaaacgattaacttggaggacttgtttggacaatttgaaacctcaaggactaaactgagcccgaagcgaaacttcataaactgtatttgctatttgcccataaaagaaggcgaaatggcagttgaggtgtggtggaagtgatgcatgcacagaggcttacaccatttgtgggtgagaaaaaaggaaactaatgcagagaaagagaagaaagatgagagctgccaacagtcttaccaactagataaaaagaggcttgagttatataaagagaggctaatttacagttgaagagcatattagaagaaaagagatcaaattatgacaatagacattccttctatgcctatcccgcagcagctgttctacatgtaacttttgttagtagtagcaactagctagtttttaaaaattgatcatgcacaatagatataccatggctagctagctagctagctagctatataaaattctctcagatgaccttgcaagcactaatcagggtatccattacccatttgttatgaacattagcctttttgttgttgttgcttactcataaaggtacgaattgattttcttttttctgaaaaatgtcgtgcttctttgttgtgatcaactacttcatcttcagtgacagacccactatgtgtttaggccattgacagagtgcgaatggctatgcacaattttgtggtgtggcaaaagtgaattcatcaacgacgtcggacgatgattcgtcaagtagccgttgaaataaggggcaagaatgacttatcatggagaagattgccaaaccgttaaatatcagatcaaattaagatttttgtttctcatgacatcgtcagatcaaagggacatctgttaacggcatgtactgctaatggatcgcatgggcccttccatttctccacacactggtggcaatgtctaccggtgagtagggatgaaatcagttcgaaaagtttcctgattccggacgtgttttcagaaataggaagtgttagtcggaattttttcagaaactttcgaaaatggacccaaattcagaattcctttcttggaaaaaggaaatgaattcacaaggctactatatgttggaaaccggaatccattgtaatatttccagaaacgaattcggaaactttcctgaaacaaattcaagttttttcttggatagattcggaaataaaaaaaattgtcatgtacaactgattagctttagctttctgtactctaaatgtttagatttataccatatgtattaagatgcttaactaaatagagatattttcatctgacctcgatcgttcgtgcacagaggtcaccgaaaaaaacaccgatcgctacctaccgtaaatgtaagatcattgcagcgaggcaatgaccgttcccacgctagtgcttatatgtccatttaactcattatatctctgttcaaaatgggaaacttttttggttttgctatatttcttgcggcaaatttcttggagaaaaactttcaatttttggaccactagatctgctccaagattcgtggttttgctagatttcttgcgacagatttgctggagaaaaacttttaatttttcgactgctagatctactctgagattcatggtggcaggccgtggaaaaatttcagcaaatattcgataggaggatgatttgagcacagaacctccagcaacttagctttaattgctagccaagttacatacaatttacgatataattacaatatagttattagcatgtagttccatttgaaagattgttttcctaaaaacatatgacagaattttatatacttattttttggaaactaatttttatccctttcttggataagttttaacacggcagtggcatggaaggcgctggtgtcgatggtgctggtgcagattttcatcatggatacgatcccgctattcaaggtgtcgatcgggtgagttcactctccaagctggagctcgacatcgacgagcgccttgaccacctcaacacctcatcttccacttcctatttctcctccctctttattctctaatctgctgacagctggcgaccgagattgccacggttgaaattaatggatgagccttatcccattcgaagatttatttttgagtaaacttcacaaaaccccaggtttccccaggttttgagacaccaacaacatagaaccttaggtattatgatttgtttcgagaaacactagattttggtgcaaacttttttcaagaaaccctatgtttacatcaaatactcataatttcattattatgcatgatatatttagtatatgtgttcacattagtaactcaaaatatatatacctctttgtgtactttatcttcttcctcactcttgcaataataccatttaaaaatcgcaacacaaccccttaataatgatacattaaccagttacttatacacagccataataccaatgctcgctaaaataagtccaacacgtatatcaggaatatctcatattattttttacaattattatgcatacgtatattagtcaaaaacaatgatgtaaggttaaacatggggcttcttgaaacattttccccaaaacctagggttatttgaaaaaaatcttaatgcctggggttttgcattacgggtgccttaaaaccttgggttttgtgaaatttactcttaattaattttttttcttttgtaaaaatcacaaaagctcaccttatgtgatgacatgcatatgatgtttagttccaccttgcctattgtaggagagagaaacctccttataagggacggtactctcctagccacttgatgcatgtgtggtggagagaacaagagaaatactcgcgctcgtctcgcctggcctggctaggcggcgcgcgtacacgacattcgcgtgaatggttcctgccaaaattcgtttctcatccttgcacagatgtttcctttgacatttttgttttgctgcgaaaatcggttttgattttggaaacaccccgaataatncnnnnnnnggggggggccttnagtancatgnnnnncaggnnnnnnncnngngnnnnatctnctnnnnntncncnnnnnnnatntnnnccntgcctcttgatcacgcatgctaatatctctataaaaacgagccctcgcctccttgcaatccacgcggaatcaattaacctcctcctctgcaatgcgctgtctctcgtagtttactctgacccgctctccgcgtgcaccggcgcttgggagagctggtcttcggaaccttcgccttcaacgtcctgcgctgggagaaagcgacattaaggtttttgggcaacgctttgtgagactgcttgttgttcgtccaccacggctcgtcttcctcttcgctcgggtgttgcgcgtcatcatcaacgttcggtaccgcgagttcttcctgctgtgcagccgaacgtccagaacgcttggtacgcattcatcgtgtttcgtatattcgatctgttcatgttttattgtccagtttacatgtgtagatgtatatatgatccgattatgctagtatatatgttcaatgtcgttatttatttataaaataaattaaatctagatgtgcttatattttcaacaaccaccacctcgtcaggctcccttgtcaccactgccactttatcaatttggagctccccttccacctcctccaccaaaagctcaatggaaagtgagctcaagatcgagcaccacatcccgattcatgtcatcaagtttcatgtcatcgtgcaccgccgtgtcgtcagaccttagagagtggcagtcggtgtgtcagcgaagttactcctgaccggctctcccatatgcactcaaaggaagctacagtctcaccggagactacgtggaggacatatctagagggtgccagcgtagaggatggaatagtcaccaacattgcaagcagggaggcacgggatacgctattccacaggttccacctctccaccttagctcctttgtcgccgtggtttttctcccgagcagtgaagcccacgccattccctgctaagatgaggtctctctcttatgggagaaata

SEQ ID NO: 32394 - DNA, 8916 bp, Oryza sativa
cccatatgaacccctctagctctctttggttatatcctgcataataccttctcttccagtatgacttgttgagtatagtgggtagtactcagtcttgcccggtctctcaaccccagagttcgagtatgcgtcagatggtggtactcggaggagtaggcttcgtccgtcgtggaggacatatctagagggtgccagcgtagaggatggaatagtcaccaacattgcaagcagggaggcacgggatacgctattccacaggttccacctctccaccttagctcctttgtcgccgtggtttttctcccgagcagtgaagcccacgccattccctgctaagatgaggtctctctcttatgggagaaataaccaattctcccatcactacttttgtaacatagatagcgcactataggtgccaaaacaactaaaactagaacctttaatttattataggtgccagtttttttaaaaaaacctgatacatgtaaaaatcgagccgagccgactgcatcatccttatccactcgcaacgacgtcgcccgtgcggataagcacgacatgcgcgagcccacctctctcgctctcgtgagcccctctttctctctggcgactctcttccctctctctctttgcccctctcctcccccacccgcgagggccgacggcggcagcccttctcacccgcgagcgtcggcggcgggctctctctcacggctctccctcgcgagcggctgctgttagatccaggccggatccaggcaatggtgacggcggcacgacagcacgacgacgggctccccaaccgaaggcgacgggggcggggcgccctctcctctgctagatctagcgggagggaaggtggcgggctccctaagccgactccactgtcgcgcgcttctcgcctctgccatcctccaccacctcatctccctcggcttcatcaacgtggtcatcctcactcacgccgagctcgacctctcccagcaggccgacgtcaagtccttcttccccgtagagctcccatgctacgtcgtcctcaccaccgccaaggtcggcggcatccacgccaactccaccttcacggtcgacttcatcgctgccaacctccagatagcgatgtaagcggggcaggaaagcgagtttttttagcccgcttatctcagttatagtttaatttttcttccatattttgtactaccatataggacatgaactagtaagcgatttttattcgggtagcgggactacccacttgcattcctacctccagatccagtgaatgtttgagttcatcctttgagtttgagtttgattttgattagaagctctgctaagcttggcttgaatccaagccgagccccgagctattttctttttttttcccttgttcttctgtataggtgcctgttcatgactaaaaccggcagctatatatatattattattggtgttggttctttaattagcaccaatgaatgaagtcatccgtgccgcctgttgggtgacagttgaatcatccagcacctaaggccgattcccaaccggcaccaatatcatttttttaatagtgcatggagtggagacccgtggcaacacgtcgctaacttccttaaagagaagtcaccgcatctccatgcgtagagagaagttgatcgttgctgataggtggttgtggagtcaggagtgagaatagaagaagacgaagattgtaaatggcatgtgggccttatatttttattttattattttcattgattgggtgccaggtcagcgccctcgtagacgaaaaccactatggtttttaactagtatagcaatttgaactgttttataagttgtaaagtgccgtatacccgattttcgtgcgcgaacattcgcccactaaccatctcgcgaatggcgtcgggacgaggaggttaaagacgtgtgatatccgttcttcccgttttatccttttatacgtgatcgttttggtacgtttttttttgttttttttttcactccctggatactggaacgtatatatctttttctgttctttccgtcgaatcttttttttttttcaaattcgtttttcattagtcctttttattttagtttttaacgggaattttatatgaattactttttttgcaaactttgtacatatgcatatatatagactttatataagtaaagtttctatatgtagacttttatgtatgtaaattttttataagtagactttatatatgtaaaatttctatatgtagactttatgaatataaactttacatagaatctatatctacacttaaaaattttaatacgtcaatttataatagaaataaaaaatgctatgagtggactcggtgttctaactgaagaaacaaactcttaacggatcgcgcaggactaccaaagcaaactaccaaagcatgcatgcgggagtcagaaccaattcgcggacttggggaaacgcgaacgttcgcgcattggactcacccgcatctaacagggctatttaaattgtggggtcatactaaagcgcacccagcgatctagtataaagtataagcctatatcgacgccagatcgagttggccgtgcgggcgcaccagatggacatcgacggcgcgggcactaaggcggcagcagcgggatggaaggcgccggcgtcgatggtgctggtgcagctgttcatcacggggatgatcatgctttccaaggtgtccatcggcggcggcatgttcatcttcgctctgctcgcgtatcgcagcctcttcggcgccgtcttcatcctcccctttgccctcatctttgagaggtttcttgtttcctactcttattcgcatgcaggccagaagaacattattgcactaaactagtgatggggggttaatttagggctcatctacggcatttagatggccatatatatagtagtttttaacttaaattggaagtattttagttttcgtgcaaccaaaaacagcgtttttctagtctagttgaaattgtgaatcattggatgctatggataacgccatgcgtaaacttgtggctcaatgatggataggtatcgccagcaggtatcattagcagtctgtaggatatgcatgcactgtaaaaaaacaggtgccgtgatgaaaatatagattctatttttgctaaactttgttttgtgtagagggaagtggagggacatggattggcgcgcattcggatggatcttcttcaatgcctttatcgggtacgcatatatgtttctgaatctgaagcttcaaattactgtcaagtttccattatttatacatcctccgaataaaaatgtactcggttttaacaaaatatactagatcatatactagtattttggagaacctcaatgaccaaggaacgagcggcctgagtttaacaaaaatacccatgatgtattactcatgcatgcatttatcaatatacctaatgttactgtaggcatacgtcgcatatacgtaatccagggctactatttgggattttagaggtaaacatcacataaatataagtgcttcctatactatatgtgtgtccttttaaaagacccttagaactatactccctgttcgacaatacctattattttggacaatgacatgattctcgaaacatagtttgtttgggattttctattgtagtgcacacaataaataaatatttgattttgttaaaatatttttaagactaatctatatattgttctattgccttcaaaatgaatattcaaatgttattgatactcaaaattctatacctcaaaaacaccaaaataacacacaaaaagaaatatctatcggttcttttgaactcagaatatggaaactacactactagacaaaaaattttggtgactgccccacactcttgttatggtcatgctgaatagtcatgaaaaacactctctcgccacacaagtgtgtcacagcatcacaaaatttagttgttcggtgactgaatggattatgtagtcacaaaagtttacatgaaaattatttagttaggtttaaaagtattatttataatattggtgacggttatatttcaaagctgtcaccgttgatcccgtaactgatttaattgtgacaggctgaaaagaaaaaaaagaaaataccagagagaaatagattattagcttatttagaagagttcagctctgtttctctctccacctcctcattcctctcgttcccctcctctgctctctattcttatcctagagaggattcgatctccccttacagcgatgcttgtcactggccgcgtcaaccgttgagccgccgcgtgttctcctcatccgcgtgctattagataaaaaatgaattgattggccaaatatgtatggcaaaccaaagtagctgtatcaaccgctgaattgaaaaatcaagattataacaaaataccaactgaaactatgggttgtcttgttccatactaaaaccaaaaccagagtttgttatagcattaaagaaggtgacgatagcgaatgttttgctagtagtacaacttgtattttgatatgcttgcgcatacaaaaagaattcgtaacgaaaggctgtcagtctgtctatctctctttcttaattatattatagtttaatatataatttgtttttcatttattttaatatttggtagtatgcatgtctcctctcgttatgagtatataagaatatttcgaatgaatgaaaacgaacaaaagcactgcatgataaataacagaaacttagcacatcgcggcccaaacgaaaatgagaaactttatgagcttggcattccgatatagtgccagtgacctcttggtttcatttcagttgtgtcctttctaaagtctgtgatggacacgatactgccctcagtttccatcaattcccattgtatgcattcggcctcttgcacatcttgtcacattcttccagaacaattgtttaaaatgataagcatacattttaatttaaagaaggttaaagatattcttgattcgatatacatgctccgatattcgtttcaaaaaaaaaatcgtttcaaaaaaagatatacatgctccgatatttctttcaaaataggtttggcaaagcatagaactaaatatacattttttaaaaaattaaaatgttcaaacttacacctcttcactttggtgtctgtgtagtctgtaactctgtatgaataataagtcaacttaagattttacggaagcacttaatttgttaggaggattgcttcaacggcaaaaatgaagctactagatccatccaatagctttgctggaagatatcttttgcacaaacctcgttgagatcttcaccagaaattatgaaatcatgatatgttcagttgattaccatataatagtaattaacttaattctatagggatacaaatgggacccggatccattgtctttaggcgctaaaggcagagatgctgtctagcactacaaaagaaaacagtgatttgtatttattcactgtagcaacagcgtagagcaggaaactgaactgtaccatgctactgtttattttgtacatcgatcttgctggttcactccaaagtcatggtactaatacacatctgatttcaccttgcgatatatatatttgtctgttcactgttcagagacgctgcgacaaagaatctttgctctaataagatactcactctgtcccatataaaatcaaaccctagcatctcaatgtaaaattaggagagagggaaaatgaccaaaatacctcttattattaaaaaaatagtaatgatgataggatgataaagggtattggagaaattaaatttctcattttacgtgctgatagtagataggatggtagaagttggtttttcgtgggataaaattcaaactccagaggttgattttttttttttttgggacggagtgaatagaaatttactgatggcaaagccaatttggtgaaagactgttacatatataggagaaccaatttgacagtacgtgatcaataatcactttagtgttgaccagttctaattaattatctgagacatggttttcatctttcttctcacatatcaaactatgcaggtatgcagttccaatgagcctttacttctatgggctcaaggacaccactgcatcctacgcagtcatctttataaacatcattcccctattcgccttcatcctctcactcatgttcaggtaaaggttccatttgcaaggttccattcgccttctttgttgtgtacaatgtatttcaatacttataggttccaacaataattgttaatagattttattacttgagaaagtatctttagttatcaaaaatttaaactaaaagttttggtaccttagggtacagggttcctagtatctcgggcttagatattaagttttacagtagaaaacataatatcaaccagtatcttcttaacaatggtaaaattagctataattatttcatggaatgaaagtaatgcacttgatagtaccatggcaagcagtgtgtgatttcaatcctcatgtcccgtgttcaatctccagcatgcttacaatttctcttaagaaatatttggagggacgtatctccctccaaatctcgtttttaatttcatggaatgaaaaaagatgaccatttttgggtaaactcgaatggtgttgcaaatatatgatctcactgaatcatatggatatgctgtatcaacatatggcagactggagacattcgaaattggaagcatagttggggtactgaagatagtgggtgttctgctctctgtgggtggcacaatgcttgtcagcttatacaaaggcaagtcactgcatctctggaattccattttgcagcaccaaaatgaaccggccacaaaaactgcaaccaatcagctaagagggacaattttattggttgccagcagctttgcctatgcttgctggtaccttgttcaggtaatcacgagcaattttacagttcttaggagataccactttttctattgcaaatttggtacctcttagtacctaaatactatgagatacaaaaatttacactaaatttttggtacctcctcaagaactataaaattgctctaatcacaaacttaccttttaatagaaacatatatactagaataatcttatgctgatatttccatgttgtaactgtatttgcagtcaaaagttctgaaagtgtacccatacaaatattggtcttccatgataacatgcttggttggaggatttcaggtagcatttgtcggaatcatattaaggagacataagagtgcttggaagctaggatgggatctcaaccttgttactgttgtgtactcagtatgtcttcaaaccttcctagttcttgaaattaacttaactagaagctacaatgagaaaagtataatattttgtttcctattcttggggtgtccagtgtagcttgagttgtagtattaactaatagtcctggagttataatatgattttgaaggaataatgaattttcatgaaacacaataggcctaattgttctacggatattgacatcaaaaccactttggtgtagggtgcacttgcaacgggcgggaaatatagccttaattcatgggtagtggctaagcgaggtccagcctatcccccgatgttcaacccactatcagtggtcttcactgttgtgctggactccgtccttatgggggatgatgtgacagtaggaaggtcagttgcaatcatttgtactatctatgatgcatgttcggtatttccaacagaaaatgcatgtcaacccattatcagtggtcttgctaagccgaatttgcatgacacccaattttacatacgccgtgtttagtttcaaaataattcttcaaacttccaactttttcatcacatcaaaactttcctacacacaaacttccaactttttcatcacatcgttccaatttcaaccaaacttccaattttggtgtgaactaaacacagccgtagcctaaaaacacattccaaagtggcatgcatatttctgacagtaatggataattatctacggtgaacaaccaccattacacaaatgggcaacagtgaacggtattgaccaggcactaaccaagcggcatatcattgccaaaagaaaaggctcgaaaaatgatcatattttacctgatatatattgggtttggaagtcttgatgttttatctgatatgttcggcatttgaatctgaatatctctctccacgcatggcttacgtagcatcttacttctatctaagcatagcttttttggcatctaaggaaacacatgttttcttttaactctaatagttcaaaaattcaaatgcatatttgagcctctatataacttcaaacaaaaaattaatcagatgtatagtagatataaacaaattatacagttttgacataaaaattatctccaaccgaaattaaaattttaaaaatggttttgtttttcatagaagatctcaacacttctaacatatatcttggcatgtaaaagatctacaataaaaagatcataaattacaaggttatatatctcagcaaattctacgatttcgatctaaagcttgtcttcatccaacttctccatttttaaaaagaaaattcattatgatgcttccgtacttagtggagaggatggttcagtcattgggcaggacgactgtatgctctattatgtaacagaactagcgatgatatattagtgctggttcataacaagaacctagtagtattacggccagatataaaggaacaggccgtgatgggattgttacaaaggtcatttctgtagtactgaacaacaaaaagaaacaagtgacgaagctggtcatgtgagcagtactttaatattcgaccataacatttgatttagttgctctcttattttgaatgtgcagta

SEQ ID NO: 32395 - DNA, 7448 bp, Oryza sativa
  unsure (1)..(7448): unsure at all n locations
agaaagcatgttgccaatatatggaagatgatataagaataagcgataattcattattcatatttgttttgtctcagtacagttctacagttttatactcttgttatgttatcgtcagcttatcttttaaagttttaattttgaaccagctgtgttctatcaaattgtctctctctatatatttttgtcatagtcaatttgagagtccgtaacaaagttctatcaaattttctctgtatatatatttttgtcgtagtcgatttgatggtccgttacaaagcaaagggagtcggaaacttggctagtaattaaccttcatattgtaaaacacctcattattggtagttagttgtttacttatttcagaagaactgcccccttagtagaggaaaaatataaaataaacttgaaaatataaaataaaggtcttaataaattgatgctgatcggccttggacaagtatgtactgtagctctcttcaatgtgctgaaaaactacactgcactccctccatttcttttttttttttgagaaacacagtacaaacgcaggcgctcacaacgtgcgcactccactccctccatttcaaattaatggaagttacggatttgtatttggtcaaatatttttatctttgatgatcgaattttataaactcataatatttcgtaacataaattcacttaggaaaattttgtatggaaaatttaaaacattttgaattctaaaatttttgtgaacatgcctgtgggacaccccagattaaatattatgtaaactattcgaaacgatagcttagttggatggggtctcaataaaactcaaataaaacagtaatcgtccaacctcatcgctgccctatcaagtcaaatagcaaacatattatgtaacccaaagaatcgcgtagagagcataggaaatattactgggactccacatgctagttaactttagcctgagacatgcccgtcaaaccacacgaaggtgttgactagatgttttacacaactcgggagacttgacaaattgttggagctctacaacatctcaaatgctctaaactcatactcatgtgtaactagttcctacaacaagcactagtttcacattttcatctaagcaatgataagcagaaatagggcataaacacaaattagaactcaaattactaccggatgtaattacctaggctgaccgaacaaatatatatataatgatccgcagaagcttgtatactagttcccacaagcagcccctactaggggtagacacctaacgaatcgagtcctagaagaagtcggaacccgaatcactcaacttaagtcaaatctaatacctgcaaaacaagatcatatactatgccacacatgaccgcgagtatggctagttgaatagttttaacaactttaccaacataatgtgaatcgttctagtttgtcctgtacccgtcggtactagcacactctacacgttgaatgtggtctagaggtcaccacgtagcctttatattatctaatgcctagccttgcaccagaacggcaagtgtgaccgttaggtggtgggcctacgccttgaacataacatcgtggcggcaaacgcatctgttaccccatgaggtactgtactgttatattgcacaaacttagatgcctaaactactattaacagtgaaatttggcaagatagactcgaattggagttggatatcaaagcggaatcgaaggagatagaatcttaccaaaaatggactgcgcattgactgggcagcgtatcggctggaaacagagttggaatttggttgagtcgatatggcaggtagccgatacagctctacttaggctcagtttgggcctcgattgagataaccgtcattgccgtttagagatatagttcatttaaggcagttgtatctattaattagaatatttatgtcggtttgagttagagatatggcaagagtctgccgaatggatttgtttgtattttctctttagaaaagcttgagtcgtgtccacaatgaacaagttttgtactcggggtataaatataaactccagaccattgtaataagagagagaatccaatcaatacaacgttcagcgcattgccaccccttttcttttacttctcgacgagttcttgcttcaagtcggagcatcggccatgaattcttggcaagaagtaacttgtctcgatggctagcgctatcggggctattatatcgttttagatgtattagccctttgatcgtgaccattgttatcatatatcttagttaatctagtcttagtatcggtggggaggtggtacggtggctactactccagatttggtgcaagagataaaaaggaaacatattttttaacaaatccaatatttctttccgaaacaaaccaaaccaatctaatctaatctcctccttccatcctacacatgcgcagtgcaccatcacggatacaaccacgggacatgatacaaccacacgacaaaaacctagatgcaactccaaaactgacgaacaaaacttctaaaaactacaaaaatcgaaccctggcggtgagacgagtccgttttcgtaggtcttgacgacaacaaagacatggcggcggtaacaacaatggtggtactagatgtgaccagaactcgaaactctatacggaactgtcatgcccagaaatttccgaatagaattccaagcagaatgtgcattaaaacccctgtccaggaccggccagggtacacaaacgacaaagttgacatacagatccacgacggaaattaaaaacattccacaggcatataaaaatcttacataaatgcaacggaaattaaaagataaacttgagctagatcttgacttggatagcgggcgacaccattccacgggcatcctcgacggcacggacgaagcctactcctccgagtaccaccatctgacgcatactcgaactctggggttgagagaccgggcaagactgagtactacccactatactcaacaagtcatactggaagagaaggtattatgcaggatataaccaaagagagctagaggggttcatatgcataaagttagcacttaaaagcagtagttgagagcagtaaaatagatgtagtaattaatcaatattaatcatcgctgctctacgctacaccatgttgagatagacccaaaccactacctgaactaaccagatccattaagctatactaatgatgtgactaatcacggtgaatctggttgacccctcataaccgcgggtacgactattcgaatagttttactctgatcagaggtgtacaactgtacccacaagacacagccccacgacacgtttctgtgcgccgacatgccaccatgacataccggaaagaggccgtgacaggacccttcgcataagcccctctaaccaagcacaccacacctcaggttttgcccccactcctcatcaggcagcgagcagccccctctcgtgcctaagcgaatcagcaagtcgcataggccatcgcagggcctatccgaacaccatcacgctcacccttgcctggatgcgtcaactagaggaaagctacactacaagcccagccgttgcccacgctggcttgtggtatgtacggtaagttcttccagggcatccctcaaaccggtccttaattgccatgggcgcgactagcaaaaccatgcacccacaacccaccatttagtgtatcttaattaattaacaccattgcggtggtacaagtccaaagtcatgctaataatcaatgtctaagcattaatgcaattccccctttgtgtactagttgaactaagcagggctaagcaattcctaaaccaacatctaaacatgttacatcccaagttatcaaaggaataaggcataaaaatgataaggctgagaatagtaggtaaatacctcatacagtgacattataaaacaatgcataatttaaaggaaaagtagagcatttgaaatataggagcaatatgttcaagtgacaagcatgacttgccttgctatgctgattggggggggggacctcggcgactatctcaaagtacactggagcgtcggaagagccggattctacacgatatacaaggaaaacaatgcaaataggctataaggctactgaaacagagaacaaaaccatttttaatggattcttttgatttttctgtatatactgagacttcaatggacttaaacggagcacggatgaattttctatgaattttagaaggtacactgtgttttattactataacagaaaaaccttaattgcattattccgcattaaatgaccctggctgatgtcatcggggggaggggggagggtggcgccgacaggcggaccccacctgtcaaaggctcatgggtcaccagtccacgttgaaccgggttcacaagaccggaggggagcggcgcaccatgaggcgccgatgtggcggccacgtggacaaccacgcgggtggaggacagacggccctgatctaatggatggtaggccggacggcggtggtgcggcgcggctggggcacgcacgggcacgactcaagccagcccggcagccatggcacgtggcggcgcggggtcggccactggcggccagcggcaggtgacgcggagagcgacggcaagagagggagaggggaaaggaggggcgtcctcaccgtgaggttcggccggcgcggagggaggcgacggcaaacggcgacggcaacgggactgaccagcaaaacgagatggattagtggggaagagggagtccacggtgagcgaggacgccggccgaaggcggcggcaatggcgaaactgactggcgcatggggaggagtgggctctggtggtggattccgacgactgagggatgaacaaggcggcctttgttagcggtccttaaatcataatatctgaccgtcaatacttgcatataatgcaataaaatatggtatccaacttagtggtaggtattattactaatcatttccactagtgttggtggaatatgtgtatgcaggtaatttgaggagaaaacacatccgtcatgcgaaaaaatgcacctatgcacattcaggacacgtttacacggattggaggccccataagtctatgaaaaccatttagaattgggccaaaacatagtgcaggttattggtggcccattaagcagcctactggccaaaggagaggccgggaggacactttttgggttcggccgaacccaccagttcgaccgaacccgttctggggcctcccgccatctggcttcacgtggacagctcggatctcttcctaaaggcggttggagggtgttttggacaattcccatgcccctaactgtcatttgaaacctatataaggaggtctccatctcacttcaagcacacacaacattgagctgaattacaagaggctctattgtatcttttgtacattagaataaggtagggagtgaggagaagcttttgaggagtgcccggaagtttggcgctcatccgacttctacctcgacgagtgtagttttctaggaggaattctggaggagtaccggagctgtcggtacactctgctccgggttcggagaaccttcttctattaagtaagcattcatgttcctttcttatgttatttaggctgtgtttgctactgaaggttcccaacccatctccctcgttttccgcgcgcacgctttaaaactgctaaacggtgtattttttgtaaaaagtttctgtacgaaagttgtttaaaaaaaatcatatttatccacttttttaaaaaaattagctaatgcttaattaaccatgtgctaatcgattactccgttttccgtgcgcaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaaataaaataaacggcgcagacggctccactccacaggcagcttgaccaaggctacacctaatcctccacaccatcagcttcactgtagaactcttcatctgatgaatgattgcaaggtgagtatatgacatactcagcaagccacgcagcaaatatgcaagtgcacaggataacaaaggatggcatagtagggtttcttttgcataaacagcctttaataaacatttcagaatttaataaaacagttaagtaataattaaacaatattaatccaacgctatacaacataccctgttgtataggcccaacctttctgaacaaccatacccggctgtatagatctatctccaaaccaggaatataccattccaaaccaggagctaatcagattattaccagttatagtatcttctattatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaaaaccccttgcataacacaatccattacagcgcacctttcctggatcataatcactcccttataaacaaggcatggactccccagcgacccccgtgggcttatctccaccacttctcagtctggtgccccgcaatgaaccatgctgtacaaaagataaagccgttgcccatgctggcttgtggttggcacggttaatgtttcacaaccgaaactcgtgaaccggtccttaattgtcatgagcacgactctcaaaaccatgtgctcacaacccaccattatcaggttttagttggcacattaattaattaaccaatcacgattgaccatcgtgaactatcattaagccatcattaattaattaatagtgaatcataagttatcccaatagtgtgctaatgtttctaagcatggctaagcaatcacacctaatatctagctgaaccaatatatagagctcaactagtcaagttataataacccaaggtatcaaggaataaagtaatcaagatcaaaaagggctataacaaacaataggttaattccacccaatgacattcgaaaataaatgcagtatttgaatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32396 - DNA, 1937 bp, Oryza sativa
ttagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcat

SEQ ID NO: 32397 - DNA, 4045 bp, Oryza sativa
ttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttatttctagatttccagatggcccaaattatagcagccattcctaccataactaagtctttcatgttcttatcaagtttttccaaccaatctccaaaaatgttttgactatcaagggctgggttcagattcaggacacaaattgcagtgttccacattaatcttgccaggggacggtcaaaaaacaagtgttgcacagtctcctctctatcacagagctgacattttttatccccttttctccagcctctcttgtataaattgtcttttgttaagatcctatttttggtgaagagccacaaaaaaaccttaatcttcaaaggagttctgaacttccaaatttttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagggattccatatggcatacgatggaggtattgtgtgcgtatgggatgcagagtcgaatttggaaggagtccaaatttgatacgattggttatgtaaagtttcttcttatactatagggtttctaatgtgtttaggactcttagtatgagttttgttcgtggttttaggctacctacctcatgtataaatagagggggagcgtgaggcttcccggtatcgcttttgagagcaattgagttgagttttgagtaaggtttcgagtttagttgaaatttttgtaaggagtgttgttggtgcactttgtaaacacagagagaatcaataaagtcatcatctactttaagagttcttcgatttgtgtttcaccgggtttcggcggtctaactggcaactcaccggcggtcagaccggcggcattgcggcggtcagaccggcgggagcacggcggtcagactggcggcggcgacaggcgcagcaggcgatctcggcggtcagaccggagattcaacaccggtcagaccggtggcatccactcggtcagaccggcagaacaacttcggtcaggccgacttccgtcgatttcgagggtaacttttatttccgctaaaagttttcggttttagggtataccaaccattcaccccctctcttgttggcttagttcttgtgatttgatcctacataggtgtgtgcctgcacatatcctcgagcaaagcgaaaggcgccggtgccttcgacgatcggcatctcacggacatcgtccactatgtggttgctgccgagcacggtaatcacgctgccgttgtacggcccggtggtgttaggcccagaaattcccgaatagaattccaagcagaatgtgcattaaaatccccgtccaggaccggccggggtacacaaacgacaatgttgaca

SEQ ID NO: 32398 - DNA, 1453 bp, Oryza sativa
tccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagcttcttttcttgctgtttttaatgccacatccgatgatcaactcgaacagatcgaggaggagaatttggctttggttgctaacagaattgctcgagctatgaataatgccaggaacaggaaaagaggtggtccaaattgttgctttgaatgtggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgttgagtacatggaagatgttgtgaaaa

SEQ ID NO: 32399 - DNA, 1597 bp, Oryza sativa
  unsure (1)..(1597): unsure at all n locations
aatacaattgcagtggcttgtctgctgaaataacaagctaatcgaagcactacagcaccaaaaacgttttttctaccaaatgtgtttccactaatgatttttttcttcactctcatggcaaacaagatcatcaagtagcaagcctttagaacagccttcgaaccaatcctccagcccatagcttccgtattcctagctgtccagcccttcctatcatattgctaagatcaaccttgcacctcgaaccacgcagcactcgcccaaagcaaagaggccacggaacccaaagctaccgaaaccgcgccgccgctcctagatccagcgcggcgactcggcggatccagcgtgaggaacacgtcgggggttcggatctagggttaagggaaggaagaaaggaaggaaggaagagagagagagagagagagagagagagagagagagagggggtgggggagcgggcgacaacgcaccttgtggtcggactcggaggcggaagcgaggggcagccccgcgacggtgaggaggaggacgactgcggcggcaangatgaggtggaagtggtggccgccgcggcgatgcatctcgtccggggcgagatctgggcggggcgctgtccgtgaggggaaggtttggtctcgcgtctcgtttcagtctcgccgcccgagcacgagctgcctcctcatacggggaccttcggtgtttttgcgggaggtgcctgtggaatgtggtatttcatgcagcatgatccttcatttgtttcgtgtagtgaaagtaaggcagaagtagtttttttatacttttcaaattttataaatgaccatcctttttaaataaagtcttaaattttgtctctttttttttcaagataagagtgaaggcacatatatcactatactcgcgctccgggaatatgtgcccgaacataaggtcaaatagatggagactagcagcagctccttaacctttgctaaaattctattgaaagcacacgctcatataatttgttgctgtcatctacagtacatagcatgagagactatgatcctatgggggtcatttgcttaaaagctgacctcaccaaggtttagtttcgaggccaattatagcttgttatagagacatcatgaccaacaaaatgataaaaggcataagttagccttagctagggaagatgtttagtttgtgttaagtgggtgtttatttcaagaaatcgtgggcaaaggctattatgctcacgaacgaattatctaagaagtgtctaaattttgcatgtgaaaaacatgtcgtgtttatgtagctcatttcaacaaatatagttttgtggagattgatcacgagtaactaaatccggttatgaccctacaatatatttttgaaaaagaaaataagaaaaaaaaaactttctcatactaggataaaagacctgttttttcatctagacataaatctgtatattacaacgagagtctaggtaacaaaatctaaggcttagggtagaccaccaactagttttgagtatgagaaatggagaagatagatatgctagccttttaattattgtttgtgtttcttttggtgcaattttaggctagtcata

SEQ ID NO: 32400 - DNA, 10360 bp, Oryza sativa
  unsure (1)..(10360): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacctgtgccgagataccaaaggaagggctcgggaatgtgccgctcaaccttgacctcgcctgcgccaagctgccggagagtgaggcgtagttcgttctgctccagtagagagaaggaagaaaggaaaaatgacaggtggtcctaggttgactggattgcctcctaagaaaaaaccagagcggtttggatgaggggtataaattgcatggttttaagagatgaggggcgtctaatacccgattttaaagttaagggtgtattttagataaatataatagttgaggggtgtaaaatggacttatcccgatttgaacggactattataccatggattgtctacaaattaattatttttataaatagaattttcagaaatagcttagaacaaatgctctaaatagtgcagtagaataatgatttcgaggaaatgttattttctgtgagtttttgaagttaccagcttttagtgttttttaagataaggggaagagttttgttaaaaataaaattaaatccgacccaactagggatgcacaaaagtctagaaaaataaaatagaaaaaaacactaagacaaacctaaacatatcatgttgtcttgtagcagctcactcaaatagaaccaagacaagaggttaatcctagttatttactccgaaacaacgccctcgagaaatacatgacattttgtctgccgctgctattggaacacaaggctagattgttattcgaagcctgacatcacaccttcaacaaaggaataacacacaagcagcgatgttgtggaatcattaggttttcactctggagtgattgctagtactctgtgccatcatctggatggacttagcacaatccactcacaatctgatcataaccacaattccacaaaaccgcctttagcattcgctgaccaagcaaccaatatatcagattgctaactatacagaccaagcagtaccaatgtgtagccaccaaggacaaagtactagcctactggatctgccaccaccaagcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgattggtcaacaacgcaagcaactaactaacaaactaacaatagagtcataacatgcaatgcaaattaatgtatggatcacctgattaattgggtcgtcgttccattcccagccgatcgatcgcttcaaccattcgatatatatagctgccctaagcaggatcggttatttatcgatcgattgattgatgtgtggttatggccagcggtgtggtgatggtgatggtagtggtgacggcgacagcgatggcgatggcggtgcaggggagccgtcactcggatttcttcgtggagggcgaggtgtactgcgacacgtgccgtgccgggttcgtgacgaacgtgacgacggcgatccaggccgcgcgggtgcggctggagtgccggcactacatgagcgcgagcgggtcggtggagagatcggcggaggggacaacggacgcgacggggcactaccgcatggagctggtggaggtggacaaccgcggtgccgagttggtgtgcgcggtggcgctgctcagcagcccggtgaccgaatgccacgagatggaggtgggtcgcgaccgcgcgccggtcaccctcgttcaggacgtcggcctcgccaccatggtccgccgcgccaatcctctcggcttcctccagactatgttagctagatacgctgatacggatacgcgatacgtggatacgaagatgtggcatttgtgaaaaactaaggatacggggatacgtctatatatatattaacaatataaaaatttaatatataaatttatgaactcttgcatggaaataagctcgtataatgtcatggaaatattttctaataattgtaattgactaaggttggtgaagcgatttaaccccgagaatgatgatgcagactgaagactgccaacttgccaataacttgccaacaggtttattccaagagtgtaatgaacatacacgtcgagagtgttagatgcattagcacttgatattccaatccgaaatttcatccgatctaaaagtagcactttgtaccaagaaaatagaaagagggacaagaagttaaaaaagaaaaagaaaatcattgctaacactagcatagctgcatgggagaggccaacaactgaatcgaccgatggaacttgcttgcctcactgctgaagtaagtggttgcctggttggagatggcgccggcggcggacggcggtgctatgcctggcggcggcagcactgcattcagcatccggtgttacgcccgcatatggcgacggcgcacaactctgcgattggcgtccgtcagcggcagcggcgctaggagtcgcgagccgcgtggggtgtcgggccatatgcgagaaccacggaagcgacgaacggcgtggagttgcaggataaagcgatgtttagttctctcgatcgtatccagaaggtatctcaacgtatcgggggagtatccagattttttttttgatttttctgaaaatcaccaatatcgccgatacacatgggatacgtatccgatacgtatccgtatccttccacgtatcagatacggatacgtagcttttgggaagtatccaggtaatgtagcctccagacccgcccactccccatctgcggtgaccttctcaagagctacgcgctcggcaccgcaccaagctactagctacctcatacagtgctccctttattattatttcctcttcttgcttttatatttatattatatccgtgcgttgtaatgggtgaaaagattctaatgataatatatgtttttcatgtataatcatgttaatgacaatgtttgtattttaatgagtggtttgtttttttataaacggtgttttttttcttgcgtgattttctcaaaccatttttttagaaatggcgtatttctttcaaatatttttttcatagcatgtttttttttgcattttttactgacgacaaaaaccatattttttctccctttttttcttttatttttttgtgttttttgcctgttttttcaaacaattattttctcgcgctttttttttgcttgttttttcaaatgtccttttttgcttttttttttcaatacaggagaatatatgacgaaataaaagccgtatagtagatggcaaaaaatcgatggatcctatccgagtcaagcatccatcaatttagtattttctctgacagttttttcaaagcgatttgttttttaatagacggtgttttttttgcacggttttttcaaaccattttttagaaatggcacgttttttctgaccgtttttttctcgcgcatttttttatttgttttatggaagatggaaaacattttttagcgtttttttgcgctttttctgacttttttctcacacgttttattgaacggtttttattttctcgtgcattttctatttttaaatagttagattagattagagatagagaagagatatatagtaattagaaatcgcaccactatgtttcgcactttccatttttttctcgcgtgcattttttattttatacgaaccaacttcttattttttaggaaccatttttgtcgtcacatttttcgcctttaaaggaatcacattttttttctctttttttctgttttaaaggaattggatctagtgttttttgcaccactttttttttgccgacaaaaaaaaccaggcgaaaaaaatttgtccgatccaaaacaaaacgggcgaaaaaccgggcgaaaaaagaaaagaaaaatcaaatctgtctgatcaaaaaacgggcgaaaaaaagaaaaggaaaacaaatccgattccacggtaaaaaagggcgaaaagaaataaaaaaggaatctgtctgattcctaaaaaaacgggcgcaaaaaaaaaccaggtgaaaaaaaagtccggccaaaaaaacgaatccgcgtggacgcagtaaaaaaagagcaaaaatattaaaaaaacaaatctgtcggagtaaaaaaaaagaattatatgcgacgtggtaaaaaaaaaatcgaatcctaatatatttgacgcggtactatatatctctatcttctctatctctgctacttaaaaaattaaaaacatttcctatgtccataataacaaaaaaagggcgaaaaaaacattaaaacaaaaaaaaagttcgattcaatttacttccgttgtccgtgaaaatcttatcttatcttaatctcaatactacttatatatatatatatatactacttaaaaaataaaagaaatttccgtcgtccgttgggaaaaaaactgataaaaacaaaagatcggaaaaaaaaagtccgactcctccaatggaaaaaaaaggagagaaaaaacaaaaaacgaagagaaaaaaacttccatcgcaaaaaaaagatgtccgactctaaaaaaaatccgactcctcggcggagaaaaataaaggcgagaaaaaacaaaataagagaaaaaaacttctactataaaaaagaaaaaaaaggtcctccgtccccgcctgtgcgatgaaacgccagcaaaaaaaaaagaaattgaggaaagggataaactagattgaagttcccaaaattaaaagaggataaacgatattgaaactcccataactcgaaaagagggaataaaatatattgaaatttctcgacaaaattctctaaattcgaagaaccctaatttcgggtaagaaccataagagtcaaatccaaatcaattatgctaagggttcgggttacttaccggatttgaagcccgtgagctcaccggagctttctgggaagcggcatcgccgcaccttcacctcctcgcagtcgtgtcgggttccctgcgcgcgcgctgtcctggagcacccctccaccgtcctttgccgaagacgggaagcgtcggcttggcatcgcccctaccgccgacgaggtccaggccgcttggcgctcgtcgccgtttgcacgcccacctagccggaccgccgacgtcgtggcacggctttgcgccgcccttgggtgcgcctcctagccggcgaagcaggagccgctcagtggtcgtcgctgcacgcgcgcaccagcttgccggaccaccgtcgttccgctcactcgtcgccggagagaaatgggatcaagagagatggatttgggacctagggttttgcccctctccccggtcgatgcttcattcgtcgcggggatgattggagccgtccattagattggacggctcagattcgcccagcattaggccgtcgccgccgttgattacgctgcgcccaatgggccgcagaagtgtatcggtccgtccccgcatatgtgggccgcgctcagttgctcagcttgcgggccgtcgaattgactcaactcaccaaagatgggctagcccaagtttgggccggcttgggaagacctgggccgaaagcaaatttgatcaaacaatgtggctcacatttttcaaattaaagtccattggataaactcttaagtaggctcgaaaaataaatctaaaactaaatcctaaatccatgctaattgataaaattagactcggttctacctatttgttaatatatcaaattagacttgatttttacagaattgaggttttcaaggtgtcacactatcaaacggtgtttttcctgtagcaacgcacgggcactattgctagttagaaataatgtgtaagatagctagacgacgatataaacttacataaggtgatgtggtttatcataatttaaatagtatatagaatgatgatccaaatgtaaaagtaatatgatgtggctttatgagagaagataatgagggagataattgcgaccatagattaataatttgatggctagaaacaatttgaggtgatatggcttaatgagaaaagagagaaataacattaactaagtgaggatgaattgtctaggtatatagatattatacaaaatgatggggagatatattgaaatattttgagaattatgtggaatgatgatttaacatgctcggatttttaaagctctaaaattttagtgagggtgaactatataggcatataggatattataaaaagtgatggagaaatatattgaaatattatgtgaattatgtgtgatgataatttaattatcatgcttgtattttaaagctctaaaacttaataaattagcatgcttacatgaggtttgagatgtaataattgttagtggataatgtggcatctttgcatgttgagctttagaatttagaagaccttaactttatagaaagataggatattaagataatggaaaatgtatttcatctccagactccggttatatctaccctatagttcaacaaatactttcactcatcactcatcactcattctttcatctaccctaaagtttaacaaatactttcactcatcactcaccactcattctttcatgcctcactcaacggtctagattatccgattgagatctgacggccggaatagctcccgcgtaatctcgcccatgcgccccaaaatttcgcccttttttcatcccgatcgattctagatcgcgaaaaaatccggcccctatcagttcgctttttttctaatataagtcaaaacggtaataagccaaaacggtttattagggaataaaaataaatttgtaggtaaaacttatatatatatatatatatatatatatatatatatatatatatatgttctttgtaacttaaaagccaatgctgaaaaagaaactacgtagaaaatatcttaaaatcaatcttaaaattaagtttgaaaatttaaaatttggcttattgggccgccctcggcgccgccgctccctcgcagcctcgcccttcacctctccgctgacgccgcccgtgcctcaccacctctgtcgttccaccgcgccactacggctcctccctccccatcgtccccatcgccccctcgccgcgccacttccccatcggccgccccgatgcacgccgcgtccccccgcgccactacgacgcctccctccccggtgtccccatcccccccccctcgccgcaccacttccccatccgccgccccgatgcacgccgtcgcgtcgcccgcgcctcaccgcccccggcgtcccccgcaccagcggcagaatggcgcaggccacttcatgttccccaggtacttcgaatctgaggcctcctggttgtggaacaaggaatcactagcaccctcctccctctctgctctactcttcttcttgcaaatggctgcttctggattcctgtgtcctgcctgatgcttgcttgcttgtgctttgcaaaggattaacgcctagacgtcgtgcattggatctggcaggagtgcaattgaattcctcatgctactcatttcagatgattcagccacctgtagaaaatgttgagtgcatgataaaaaaaaactaaattttcctgttgtttacttgtaaattgggatttgcactacagcaatctacaaaatctacatttttcttatctgttggaatggggcggtgtggatttttggttaatttttccaacggcaggattttagctcgatgatacatcacggcagatgcacttggttctgttcaggaaagattaactatgcattctttatttactgattaatattagtatgctttacattctagcgtgtgaaactgttaatgttagtactgcatttcctttacttggttgtaggattcatgtggtctcacttgtgttgatgttttagcaattataattcagattgccctggatggcatagcatatgaatgatctgagatgtcttatacccctaatatttacatgcaggattatcattacttatttgcgtttgttgcaccgtcatttcatttatgtaggtattgcctcgtgatgaagcaacatttcggtttgtcaatgaagccaacaagaccaagagcggtagttctctgtgtcacaaggtagctgaccattattagatcgaacaatggttttatcaggacctagcatacatattcagacaggtggtctacggcgtggcagcggtgcggtcacaagttccaccacggtgagtgcctttctgcgttcatatctctctgtactgaattgatcttgactagcataattatatgctatcatgtttgtacacactgcaattatttctcatatttttacctccaatcgtatggcagcaggttcatggtagcacatgggtttggtaaatctattccaacgaaaaatggtagtgtttgatcattcccttcgttttgtatagctttggttaaccttctgggtgaggtgcactacaattccttgtatgccattgaagttgagtgcttctgcttttttgtgatatatgggagtgaagaaaaggtttcctacaattcctctacttggcctcagatcaaatgatttgaggggcagaaaacgaaacatgatggtattcagtatcaaagctaagtttttttattctttttgcagtcataaaatttgatggaatactaatgcctgttgcagggtaatttgccctcaatctgaggtattgccatgagtattatcattttctccctgcaaattgcaacaaggtaatttgctgctagaaactttgcgcatctatttttttaggaaaaagtacgaattaccccatcgaactatcgtggtcgtccgaattacccccttgaaccacaaaacaagacattcttcacccccaactatacaaaccggacgaattacccccctcgacctaatccgcggtggttttggtctacgcggcgtacgcgtggcagtccagtcagcattttatttattaaaaaaagtgggacccacatgttatagtctctcatctctctctcctctgtctctctcactctccgtctctctcacacatcctctctctcgcgcgcgggt

SEQ ID NO: 32401 - DNA, 13370 bp, Oryza sativa
acccgcgcggcgcgcgcccctgcccaccgcccgtcccgcgccatcccgcgccgccgcccgccgtgtgagagagatagagatagagagtgagagtgagagtgagagagagaggagagagaggagagactatgacaggtgggtcccacattttttaaataaataaaatgttaactggactgccacgtgtacgctacgtagaccaaaaccaccgcggattggatcgaggggggtaattcgtccggtttgcatagttaggggtgaagaatgtccggttttgtggttcaggggggtaatttggacgaccgcgatagttcggatgggtaattcgtactttttccatttttttaacaccataccagagtttcctgtagtatatattacaaattgatcaataatttctggttataacatttacaaggtgtttttttaaatggctacttcgttataacatggtgttctgttcatgtgaacttgtgaagtggctgagaaagtctttttagctaaaatgcagtgtgctatgttgtgaagagtgaaatgaagaaatggcaaaagggtgagacatgggcttatagttccagtgatatgaaatcgttcatccctgtcttgattcctagaagatgatatttttttccaagtagctttgatgaaatgtagcaatgagtcaatgaccaaatttgtaataatctttgtatggatctgaacaccatcgatatgattttttaatgaacctcttgtattataaatggttgtttgcggctttttgtggtttactgctattttgatggatgtctttgtctcctatgtcacttgtacttgtgaatttgtggttatccgtagcattagtatggacatgctattattacgttgacatatgtttcatatcaaactgttatttgggtttatattcacgccctcgtgctatgtgctcaaaggatagcggccaacgtgtgccttatctatcccgttaccactcgccgctcatcttcctgcacataaaatttctaatccactttttaagttcaaattatttactccaattatgaaaatttgtacttgaaaattttaaattttcatttcaatttttaaaactttcaaccttttgatttttgtttggcaaatatttaaattagaggcctgaaaatgcatcttttaaataaatattggcgatagtccattctattaaacccgcccagtatattattcttgccaagaatatgtctgacatatgacatatattgaattaagactcaattgcacagatcatacaagaaatagtttttgctaacattatattttaaaattctttaaagagaaataaacttgcaccgtagcgtttagcacgggcatattactagtggtacaataatggaaaaggctctctaccttcttgaggtcatgttaaatggatttaacccaaatatgttttaactttgcagtgactcaattgtgaaaagaaaaattggcacgtcacacagatttatgactgctaaattcttatgaataagtgtaggcgtgtagcaactttttctagattgactgctaaatcaatttaccatcttttattggattgtcaatttttctagattttttttagatcaattcaatttttgtttggattataccatccacacagtgtatctcatatgtttgggaattggttatgcgtgttaataaaaaaaattaaggaactattttttaggggcttccactatatattgggctctttggcttagtagaaatgatatgatttttttgataaaaacactctcaaaaacttatttgtaggtacttttcaagacaacatattggctccagggttgggctcaactacaaagacatgatgatgatataaagctaataaatgatgcatgtcgtaaacttgaatcgacgattatgcacctttttaccaacttcggagggagattctcaaatactataattcagtaattgtggattcttttatcttgtgttggtgtttattagtttgtgtttattttatgttatgtcagtgcgtgctatgtgtgtttatctgtggattttgtaataattgattatagcttattgagcaaaggtcggattgtttattctattattttaaaaaaaagtatagcaaattggctagaaaataagatgcatgtgatggacaaaccagctagtaaaacgtgctttgtctcagtcgtaggcttgtagccttacgtaacaaactctaatgattggattttggatcctcttacttgcatggtaaagtcaaatgagcacagtatctatgactctggggattttgtagctgtccaattgtgcaacgaatggacaaaatatgtgctatattatccgatagaaaatttgagccgctacaggatatgtatacttctctgcaccataactacagtgaatcactttagataattgtagcaacatactcgtgctaccattcctctgccttaatttgtacctgcaaggctagtactccctccgtcccacaatataagggattttaagtttttacatgtaacgtttaatcactcgttttattcaattttttttgcaaatataaaaaacaaaaagttgtgcttaaaatactgtggataataaagtaagtcacaaataaaataaataatattttttaaaaaaattaaataaaacgagtgatcaaacgttgtaagcaaaaactcaaaatcccttatattatgggatgtgatggagggagtacaagttacgggatccttttcttgagctatattgtttaaattatgaaattctagattttgactttaacgaccaaaaccaaactgacgatagccttccagaaggcgacatttagtgttggggttgtcaacgatgggagcaccgatatcagtgatgcttatgggcgtcacacatctttttggagacgatgttagctgatgccttcttccccaacttcgtatctcggggttgactctctaagtgaaaatctagttataaatgttcagaacaatgatggcaatatctacaatgtcgtgatcttcttggaaacatacattggagatagtgtgctggtgaggcattattggcatcggattggctttgatggctatgacgttgggtaaatgactgatttacttagttaccttcaatgttattttctgctttggtttaacgttagtcactcatggtgatgtatgccaaattcgattatagaaataattgacgttgggaaaaactaaggactacatataacttgtacactgttgggcaaaacaatggttatgcagatagaagtattctttaatctttaaagtgatattcattttttaatcaaactgtgaatttttttttcatttgtagtcatttgccctgtaatttttatgacaattgattgtagtttctttaaagaaaaaccgaaataaattatattgtgttaaaaatgaaagaaacagatggcagcgttaaactccaccggggcttgcaaaaacagacggatcttgtgcaggagcatgaatccggtgcaaatctaatggtgaaagttcaaatgattcacaagaaaaaaaaatgggttgagtattgcactttcaggaaaagaaagatggcacacagcgtctctcctcaagcaagaaatggacttatttagtgatttgcaattgcacacgagatgcagtgaaaagagatgtgtaattttaacatcgagcccgtgtttaatctctgtctggaggacgtctttccctccgaatctccctttttttatttacaattgcacaccctaaagttatcgatcggagcacacgcgtgacgacgtgagcagcctctgctttctctaccggttgtatacatacatgctcaacgagctatatgtatataattggatggttagtacttcatatatactaacgtggaggatctcatcctggccggcgtcgtggcttcttggccggtgaagggctctccgcctcatcgtcgtcgtcggcctcctcgccgcaccgtcgttgctcgccggcgatctccttgatgggcgccacgtttaggtcgaaagcggcgcccacgctcgccgccgtcgctgcactggagaccgtcgccgacaccgatgggccatgcaagtagtggaacctcttgtgcccgcccagcgcctgcccggtggcgaatcctcgccggcacagcgagcagacgtgccgccgccgccgcccgtccgcctccgaggcggcgtcggcgtcggcggcgacgcggcctgatgatgccggagcagcagcaacgacgacgtctctgtgcgcgggcggcgccgccgccgccgccgatggcttgcggtggctcgccttgtgtccgccgagcgcctggtacgacgcgaacgccttgccgcagagcgagcaccggaagtggagctccggcggcggcggcgccagcgccagcgccagcgcggtgctctccccgcgcgccgcggcggcgagcgccatgaggcacagggagatgaggtcgccgccgtcggcggcgccgccgccttgctccatcacgtcacgctatccaacacacacagctcgtgtcgtgaaaattgaaggcgatacgtttgcatgcgattgcgtctgtccgtggtgtgtgctcttatttatgcgtgtaaaaaaacacgaattggaaaactctatttatactctcgttttgcatgtaaattaaaacgttatcaacttttttaaaaaaaatagtatgatagatcaatatgttatactccctccgtcccataatagaagagattttgactttttttttcactatttaaccattcgtcttattaaaaaaaatttagaattattatttattttatttgtgacttactttattatccaaagtattttaatcacaacttttcttgtttatatttgcacaaatttttttaataagacgagtaatcaaacagtgcaagcaaaagtcaaaatcataagatggagggagtatgtcacttcatgcctattcaaattcaacttatacatgtaaaaattctttttatagtcaaatttattatttttttcgaattatataagtcaaagttcaatttgtatgtttgtgaaaagatatatcatatattaatctatcttgatattttttttaaaaaattataactttttaaacgctacgtacaaaacgaggacaaaaatctacttgcgaatcatagtcgtcgcaaatggcacgaagaaatcgcgcgcgtcaaatcaaagcagcgcacaatggctgacgacgcgaacaaactcccgaggtaagaagcttggaatttgatctgaaccataaaaaaaaaaagatacatggcgatcgatatgtcgtaatttccagttttccaccaacccacacgtgcacttttctgtatataattctcgacgtcattttcatctcattatgagtttacaaattacaaccggtccaagttcgatctcaacttgcgaattttacatatgcaacttgtggatttatgcataccctgaatagtgaatactctgaaaccggtgccttttctacggaagagggatgggccactgtctcctgaagcaatgcatatgattctcgacgtcattttcatctcatgatgagtttacacccggtccaaattcgatctcaacttgcgaattttatatgtgcaacttgcggatttatgcataccctgaatactctgaaaccggtgtcttttctacggaagaaggatggaccactgtctcctgaagcaacaaacacagctgcgtgctctttgactagttcaaaatttgtccaaaggaaaactcgattctgaaaccagcagggataaagttctagaacgatcattttatcagtccccttgtgcggcatgacctgcttttgttttaccttcaccaggtagaataaacatgcatatgacgagtgcaatgaagagcacacggagcgccaatcttgaaagatgaaaatcatagcctcataggcgagtaattgtatatgtactactctataagctctttaaaaaatattttgtaacgaataaattcatttcatcattattaaaaaatataggaatgagtgtattttgcacacatctacacactatcgcaaaggtcaaaataacaccatcaacaccgagaaattggacattctaccacttctaagattgggttttgccacaatgccattccgcggaatggcgtcgttaaaatgccactttcaacctatgccaaaccgttgctttgccatattcgccatttcacaagatttttaccattttttgcacttcaactgaccaaaatgcccctctctcctacagtttctttctcttctccggtgaacatgtgggatggggaggagaccacgacggcagggtggcgctaacctcaggctcggtgccaccaccgccggagctctcctcctcgtcgtcctcctcttgctctgcaaattcaagaacacaatctttgagctcaaaccacacacaatctccacaatccggagagctagcgagggcgagggcgagcgcgagggctgcggctcacctcccgccgccttggtcgctggcgagggtttcggctcacctcctgccgccttggtcgccggctcgtcggtctccatccccgccgcagttaccgtgccgaccgagcccgagacgacgatgcaggtcccgtcctaccacgagctcctcctggagctagccttcttgggccatggtggcgtgcagcctccggcgcgcggcggagacgctggcggaggagatggtgacgagcggcgcacggtggtcagcgggaggaagcagcgcgttggccggcgggcgcgacgacggaggagattgtggcgcgtgacgcggtggccggcttagggtttccttctctttctccgatgtgcgggcggcgggcttcggccatgggggcgggacgtcgccggcggtgagcttgggcagtgcgggcgtcggcagcacgaacgactcacttgtgacagccggaggggtattttagtcagctcgggtggaaaattaggtggaaatagagagaattggcccaaatggcaaaacaaatgtttggcatctcttgtgagtggcattttaacgacgccattccgcggaatggcattgtggcgaaacccactattggcagtggcctaatgtccaatttctcatcaacaccagtacaccacaccatgacacaaaactgtctcaaattccaaaaagattaatgcatagaatttggagagaaaccggatttggtgataatgggacctcctggatgacatcttcaaggagaaacgcaacacacggagcgatgctgatgtctgtccagatctcaaggggatactatacaaggttttcacccgatggtctcatcaaagagggaaagagacacttccaagagggaaaacgacgcccaaaggcatcgccattgtctgccacaagactgggctagacttttgccttccacccaccccggttgttctacagctactgctccaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagggaaaaacagaactcgatgataccgacgagatcgtaatcaaacaggttcgattagatctctcgtcgacttggctcctgtaggcttcaactccgtaggctgtggtggatgtgctgactatgagatttgatgccttaggtcctcccggggggtcccttttatatcgcaggtcaactggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaatagacctcgacaagtctacctccaccagcgcgtcgctgaagaaactacaggaggatggcacccttcccggtcgcgggaccatggagagagaagcaggaggtattgaaccccagcctgtcctgggtcgcatggttgcgatcgaggactatattctctgtggttttcttctcttggtcttgaacttctacggcctttctttgctccatttgaaccccaattccatcgccttcctcagtattttttcgcatctttgtgaggcctacattggggtagagccgtttcttgacctctttcgtttctactacgagttgcgttggatggaatccaacaaggtatctggatgcgtcggtttccgactccgggatggcctgaagtcgcgctatatccttttccagtgcccttcttctcgtagcaaatggcgggcgaggtggttctatcttcagatagaaaattcggattcagtcttcgttgttcctgaggaacaaccagacaagatttcgtctcggaccgcaaaacccgccttaaccccttctcttcagtccttcatcaatgccatcgatgacctccgagtacgaggtttgtcagggtatgaagtcgctgtcgacttcattggtaggcggatcaagccgctccaggctcgagcccacccagcctttgactattctgggccggaggacgcaacccgggtttctcctcggggtatttttcttgtatttaaattgacttccttatgtgcgtgttcctcctgacttatcgaattctggttctcgatctacatgtttgaacagcgaaaccgtggagcgccgcgtcggccaattgatgatcagcggcccgacaacggcgagcaaagtccccgtccccctttgcgagaagggggcagccgaacacgaagctgccatcaatgtaagtgtactcggcggccctttcgcatttttcttcggggatcgcattgtgacttcatgaagtgtaggctctccctctgactgatatcatcgggccgctcgtggatcatcaagcagcggcgtcgctgaaggaggacgtcaccaaggaggcgcccgatgttgctgtcgccgctgccacaacgagtggcggcaacgttccgaaaagggggaggaaattctcctccgtgatcagaaattgtcggaagacacccaccccctcggtaagctctcttggtccttcatcgcgtagtcggaaaacttccacctcacatcatgcccgttatactccagggctcggatgcgtctcccccgcctccacgacggcagcggcttgtgacgcttggcgagaagtaagtggatgaatttgaggttttgtcgcttcgtcaaactcttgtagcctttcacagggtagcacgggcgaaggcggcgcaagacggatctggagggacttccagcgcgtctcctgccgtggcctcgacggatgttgtggtcgtgcccaggagccgcgaggcaatgcctagcggcccagccagcgatctcgtggctggtcggggtctgccggctgtcgtcctcacctgggaggagctctaggtcgagatggggcgcctccttgaggctggtgctcgcagcattagccgcgagatcgcggaggcgagggcggcgtcagcgtcgtcgacgaatgagtgcgccgaccggctgacacgcgatttggcagaggttcgcgaggacctccagaagatgagggagctggtggccggcaatgagcgacaacgacaagggctcgagcatcgtatgtcggagcttgagaacaacttgtcggaaaactgtggctcgctgcgggtcacctacactggtctgcaccagctcgccggggagtgtggcgttaagactaccatcccggcgaatcccaacgagttctcgctgacgtcttcgcttgcagaactggcgacagcgatggaggcgatcccctccaagcacgcggccaggatcggagaggagacgtccaacgggacttataccggggcgtgccatgtcctcgcgtgtgtgaggctggcgcaccctgaactcgatctccagaagatcttggatcaaggggcggctagcgacgcgcgcaaggatgtgatggaagaagtgggcgatctgggggagtccgtccccccgctttttgaagaatagaatttcggctcccttgtactccttagtcatgctttgtaaaactctaattggttccaaccgcctttgtgcgtgcagtcatcaccttagttttctttagcattttgatctcgagtactttgttgtcattgtagagacgttgatgtcgagaatgtccagcagagcgggcagctgagttgccagtgttatttttgttggcgacgacttccttaggtgggttatttttgttttcatctcatttactctttcgtctggatcgacttgctttgctgtgttctcgggagaaaagagcagtttgccttagtcgtttccatgctaagcagacctcgagagtgcgcttgctgaccaagatcgccgcatccagtattggaggacgaaatttgaggtcgcggaactcgagaggactatgctggaggtgaagaaggaccaggccgtgcaaacactccgaggtcgcaaggtgtggttcagctcatatctgaagagttgctgcacgtccatgactagggtctgtagagagctccgagtaccccgtggagatcccgaggaatcagcggccggatacatctcgtggctgaatggggcctacgcccagctcaaaggcatcggccagcgtatcgatgaggccctgaagcaggagtgccgtcgatcgagccgatatgccggggggcatgtactggcttgcatacgagatcttcgtccgcagctgcacctcgagttcctccacgaagggttttctcgttctcggagaactcctacggagatagatggcctggcgaagtcgatggcgccgctggcggagaaggtcttccaatccatgaactggcgttggccttcctggtagtctccgtgtcctgtgacaaatgtcttagggaaaagtgtaatataattttggatttttatggaattgtaagaagtacttgtgaaatagaaaagaaatatatctaactaagctttcttactctagacgtagtgtgtaagagtgtcttctcacttcgcgacttcgatcagttgtttgagctatacactctccctagcccccagccttgccatcggaaaattcttctcgaaagataaagctcttggacctttgacctgcctcggttgaacaagcactgatcctagcccccagccgtgaagttggaaaattaatttccgattacatggcttggttaatacacacggcgagaactcttacacgaccagatcttacatggtctttcgtctctacaggatccgacaaggccttatcggctctgggcgtccccagccgaagttcccttaggttcctcggaggccttgtcaagacggcgtaaagggatatgaggataggtttcaacgctaggtgtcatctgggtaagggatcatcgggaaggaacactttgattgtaatttgtacctgaaaataggctttattgaagctgtaagatatcttacaagtatggatactattgtcttatacatagaatttacataattgatcaatgttccaggaatttgccaactcgcgaccatcgccgtctgcaatcttgaatgcgcctggcctcaagacttgtgtgatcgtgtacggtccttcccatttgggtgagagcttgtttcgccctgcttggctttgaacctgtcggaggacatagtcgccgatcgacaacgtgcgtgctcggatgcgcttcttgtggtaacagcgaagggcctgttggtagcttggctgctcgaacggcaactcgttcgtgatgttcctcgagtagattcacatcgtcgtttcgctgctcctcctgatcctcatcggagtacttctgtactcgtgtactttgatgtcgtagctcggtggggagcatggcctctgagccgtacacgaggaagaatggtgtctccttgttagacgttgtcggtgtggtacgcacggcccatagtactgatgggagttcttcgacccacttcttgtcgtgtgacatgagcctgtcgtagacgcgggtcttgattccttgtagtactatgctgtttgccctctcgacctgtccattgctctgagggtgagaaaccgaggcgaagcagatcttgactcccagcctaatgcagtgatcctggaaatcggcactgataaactgggagccgttgtccgttatgatacggtgaggcaatccgaatctgcaaaatatgcctttgatgaatttgattgcgtcgtcggccttgatttcccccgtgggtgtcgcttcaatccacttagtgaatttgtcgatcgccacgaataggaacctgtagccgccctatcctcgtgggaatggcccgagtatatctagcccccagcacgagaacggccaagtaagagggatagtttggagtgcttgcactggtagctttgtgtgtttacctgtggaattgacaggcttcacaccgctgaaccatgtcgcatgcatctttgagggcggttggccagaaaaacccttgtcgaaaagcttttccgactaatgtccgaccggcggcatgtgacccacagatctcttcatgtatgtcgaggaggagatgtctgccgtcgtcggacgagacgcattttaggagtaccccgtttagcgccttcttgtatagat

SEQ ID NO: 32402 - DNA, 21644 bp, Oryza sativa
actagttccgaatcccctttcacgaccagtcgcctaactccgagtgcagctgcagctcttatcccggcgagtattccttcgtactcggctgtgttattggtcgccctgaagttgaggtgaattgcatgcttgaattgatctcccgaagatgatgtcaagatgaatcctgtccctgctccttggctgttgagtgcgccgtcgaacgccattgtccacgtttcgttgtcgatttggttgtctgacctgttattaggcatggtccaatcggctacgaagtcggcgagtacctgggacttgatggatgttcgtggcacaaagtggacatcaaattggcttagctcgactacccattttgcaatgcggccgacaacgtctttgtttctcacgacttcaccgagagggaaggaggatacaactgtgaccctatgggcttggaagtagtggcgtagctttcttgatgtcatgattaccgcgtagagcagtttttgaatctgtggatatcttgtctttgcgtcgtggagagcttcgctgacgtagtagactggttgttgcaccttctctctctcaacaacaatgataatgctaacggaatatggcgtggcggcgatatagagaaataattcttcattaggttggggggcaacaagtacagggggatttgataggtagcgcttgagtgcaatgaatgcctcttcggcttcctgtgtccatacaaatttgtcttgcttcttcagcggagcgaagaaaggttgtcctcgctctcccatcctagcgacgaacctgcttagtgccgccatgcattcggttagcttttgtacttccttgagtcttgtaggtgacttcatgttctcgattgccttgatcttctcgggatttgcttctattcctctgccagagatgaggaaaccgagcagcttgcccgatggtactccgaacgtgcacttctctggattgagcatgaggcgatatcgtcagaggttgtcgaacgtttctcgcagatcgtcaatcaatgagtcgcttgtcttggtcttgacaacaatttcatcgacgtaggcctcgacattgtttccaagttggtcgctaagtgcgccctgaaccgtgcgctggaaagtgtttcctgcggttattagtccaaacggcatcttcacgtagcagaataccctaaacggtatgatgaatgctgtcttctcctcgtcctctttcaccatgctgatttggtggtagccagagtaagcgtcgaggaagctcaacaactcacaaccggttgttgagtccaccagttggtctattcgaggaagaggaaagtgatccttgggacacgccttgttgaggtcggtgaaatcgacacacattctccatttcccgttggccttccgcaccatgactgggttggctagccactctggatggaatacctctttgatgaaaccagctttgagaagcttgtcgagctcttctcgtatggcttgttttcgatctggtgcaaatctccgcagtttttgctttactggtttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacagtcttgtcggggttggcactggagagtggaacgatgttgattgcatcgtccggtttcggcgtcttgtttgtcttgctcactttattgggtggctcagctgtggcaagtggactgggcgtgtgctcgaccatgtcgaggctccgcttgtcgcattgcactgctagcttagcattcccttgaatagtgattgttcctttcggtcccgacatcttgagcacttgatacgcgtagtgagatgcggtcatgaacttcgcgagtgcagttctcccaatgatggcattgtatgttgtattgaattcagcgacatcaaaggtgatctgcttcattcggaagttatttgcttggccgaaagttacaggcaacgtaattttacccaatggtttggacgatgactgaggagtgattccatggaagggttgatcggtgggtgtcaactcgcttcgtgggatccccatcgcgtccaaggtgctgccgaagaggaggttaattgagctgccgccgtcgatcagaactcgcgcgaccttgatattctgaatagtgggttcgaccacgatcggatatcgccctgggatgacagcagtcttggggtggtcctcttctgagaattctatcttctgttcagaccacttcatcttgggtgcagctccctgccacgtcgaacagacttcacgttccactttcttgtattctcgctttgaggagtatgtcgtggaacctccgaagatgtgcaagacatggagatcagagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtttgtccgacttgtgtatagggcaccatgttttcttcatgtcgctgccttgtgggtctgggcgcttgggagggtctgcgtattcagttgtgagaacttccgcttgagctttccttttcccactcttgcgatttttcttcttgcttgactcaggtgcgtccttggctagtttcttctctcctccggtcttcagtttgtcgttcttgcgtctcagtgcgtcgtccgcgtgagcgcattgattgacaattttgaataatcttcgagtagtcgtgacacacctcgttgccaactcctaggtagtatagcgatctctgacaccggacttgaaggcgcggattacagaagcgtcggtgatttcggggattgtatttctgcactcactaaagcgccgaacataatccctcaaggattcacccgggttctgtgtcaacgcatgtaggtcgtcttcgatcgcgtgacgcttgtaagctccttggaagttggcgacgaactgctgccacaggtctgcccacgaagaaatcgagtagggcgggagatgcatcagccatgaacgtgcagagcctttcaatgcagttggcaaataattcgccaatgcgttgttgtctgctccagcagcgtagagtactgtggagtaaacctgaaggaattcttctgggtcggtactcccatcgtacttctctattgctcctggtcggaatctctcaggccatcggacatcacgcagcgaacgactgaaagctctacacccagcactgggggcagtgggttgtcggcgatcgtacgtccttcgtggatgtctatctgatgatgaggatgaggaagatgacgacgatgacgatgggtcacttggtttcggtgtacgattacgagggcgtcggccaggttctcgagaatcctgtcgtcgtctcctgttgctgtcccggcgccgatctccatcgtcgtcgtcattatggcggcatcctcgactagtatcgcccagcacccgtcgttcgcgatcatcgtgatcgtggcggttatcatggtctcggtcttcgctcgaacggcctcctcgttcttcgttatcgtgacgtcgtgaagagacgcgatgtcgggaatggttctcgttgtctcgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcagctcgagaggtcgtgattctttgtcttgtgaataggacaatagacatcacgagttggagaagtacgctgaattccacgctctttgcaggcatgaatttcagcgtggacgttgagaaaaacccagcaggcttgcaaggtgtgttttctggttttgtggataggacaccaggaccttgtcacctcggaagtcatcctcgccggctcgtgattcttgtcggaaagacaaggtttggccgcactaggatccttctcgggctcggatgtcgtcgacgttccgttctccgcttcggcgggaggatccttcgacatggagtcgtcttgggttctagccactgcgttcttgcttccggtcattgatggaccagacgagatcggcaccgtggtgtaaaccgggaagacgatttcgccgacttgagtccacaccagcattgttgaagcaggaactcctttgttgaggttggtgttgacgctgttgtcgacgaagctggatgacatagtagtagaaccttgagcaccaagtccccctacctggcgtgccactatcgacgggggatacccgtagaccggatatagagggtactggggtacgctggtacgaggatctacgtaatacgacatcaagcagacaaaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccgaggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataattgatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctaatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcgccaccttgcgccacctccgccccagccatcgacccagtacacctcagctctcaaaaagcaccagatctagtcgtcgagttcaatagtgaagccaccacgccgcttgtcatcgtcactgccacctaatctccatggcggagctaggaggcaaacgggatatgttgccaccgtatcgttccgtgcgtggtttctggtggcatcgagacggaggagggagggtggtggtgatgacgactagggttgaagcccccccccccccttccccggtgcggttgtctacacggggggcgatgtgagaggccaagtcagtataaaataaagtctttgtaggatagaggttgtactgatatgtgttcttgcttgcgggtgtttggattatcacagagaaaactcaccatgtgcagtagaacttattggtaagtattgaagcggctccgatttaaagctaatggaggtatatgcggtaagcgggacacatgcaccgtatgtctatgtcatgaggactcacgtagaccaacaatttcaagcaccaactttggatgattggatccatatatatgactatatgagtcatgacatatttctaaaatgctttgtccaaaccagtcaaaccttgaaagtttttaccagaagaaattagcgacgtcgagactaagcacattcgccattgatgaaacgtttcgtccttgagttctcgttaattttttacccaatgtttaaccattcgtcttattcaaaaaatttatgtaattattatttattttattgtgacttgattcatcatcaaatgttctttaagcatgacataaatattttcatatttacacaaaatttttaaataaaacgaatgatcaaacgttggtcgaaaagtcaacggtgtcatacattaaaatacggagggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattcttttttcgctgtttcgcacggacaggtgcaagaactacagtaggcaagccggcgcaggtccgctcaacactgcttcccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggtacagtacagccgcctgcaactgcaatgcaatgaactgagcttgtgaaacagtgaaactgcacactttttgcactgcatctcaccagtcaccagaccaggtaactgctattgcagcagctgcaacaagagcagtcaaaggacgacatgaatacagctaaagagccgagctctcgattatgaggtcacgggcgcaaaggagcttgagctgaaactgcagctgctggatgcccaattaatgaagtgatttgcaactcctaaccatcaactaatccgcaacgatcgtgatttgctaggattaatccctttcctgcaggtctcttcgcggcataattaggtgacgttaacgctgaccggcttccccctttttcctgggacagttgcagaggtgccgttcagacgacggtaaaaatatactaaaacgacagattttccctgatttcgtcaccgcgaatcgcgtcaccgtgatgtcgatgcgtttgattcggcgcagttatgcaacagatttgaggttttgtacgtaatcatggctcatttactcgagtaaattacgccgatacagggcgcaattggtaagctctggtcgtgaaatttttactgagttctgacgcaatgggcttggactgggacggtgaaacgtattcgttgttgtgccaggacaaagagatgcgagatgcgtcatgggttattctgaattgttgctgttgttgattcggaggaaacgaagatggaattgcgtgttgaggccagatggaagggtcagagcaagcaggacaacattttcatttttgggctgattggtttaggtatggaggaaaggacttgttctgttgttggattgcaggagcattttaatatgaccagtggacgaatcttctgaattttaaatggggatgggtgtaatcaggcaggatcatggtagttatggtagtgaagagtgaaatgccatctctacaataaatgttgtttctagcgaaatgtacgttctcttggaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaagaatcggtttgctatgtaagttaatgaatttcatgcaaactctactagcatgattctaaacttggataggcggttaccgttatcgcacctcattgataagcctggttaccgcggtaactgatgttaagggagaccttgatttagactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgtctctgccggcgccggcgccgcggcggccgacatgtgcgtggccgacgaggtgttctcccaggggaagctgctgcctctaaggctctcgtcggcggcggctggcgatgcggccgggcttggtgttctgccgcggtcggagtcggtggcgtccaccgtggggttcggctcgcggtccgacagccggagcgcgagctccagcggcagcagcagcggctgcgtcagccggagcgagtcgtccaagagcgcctcctccgaccactccgccgcgcatccgccgccgcagcagcagcagcagccgcggcggtctctgtcgagcagcctgttctacgcgcacccgagcccgtcgccgcagctgcgcacccggccgccgcgccgcagcaccgggtcggctcccccgccgccgccggccaccgcgtggggcatcttccgcctcggcgtcgtcggcgccccggacgtgtaccctccacgctccacagattccaagaacgccgccgccgcagcaaaagtcggcagcagcaggagcgcacggttcgagccggcgagcaccgccgccgacaagaagcatccggtggtgggtctcttcggcgacagcttcgggtgcaagtgctcccccgacgtggtggagccagtcaccttgccggcggcggcgaagagggccaaggccaagaacaagaacaaggccggcgacaagaaagctcagagtgttcgtcgcagcaggatcctggactggttcgaggaactaaccatcaccaagaagtagtaaatctttcgcgtaaaagatcgtgtaatttttttttctccgagttactctgtgatcaaggtaacatcatcattttagttcttaaatttcgatcattagaatttcattcctctgattaaccggccgcagtccttaagacataagttttctttcaacttgttttgtacagattacccttaatccgtatattaattaccttcggaattgtcgcgatgacacctgcagaggtcgcagtatatattcttgtttcagatgtcgtttacttttcttttttgtttctagaaccttacacattatctcatcagtcatcaccgttcgcgtgttgacgcttgtcgaattgtctatacggcgcgagataccactggtgtcacgtcgaagcgaaataaccgcgtcgggttcgggttcgggttcttgtcctcctcaaataaccaatttacgaacccactacttatatcaagtaataactcataataattttttatgttatggttagatttatcgtatctatagatacatgtgagacgattcataaacctatttacagattaaattgataggtaacttatgaatcaatctgctaattacctatttattttacatgtaagcgagttctcataggttgatccgcttgcattcctatcgcgagtggagacggggacagccacgcgtgcacagcgtaacgtacaattacgtggtgttgccgcctaccaccgagcacacggcagcagcgagcagccgaaccgaacgcgtggttccaccgcgcgtcgccggaatttgcgtgccgacggcgaccgcccgcgggtcggtgcggtgcagcagaatccgctctcccgacggcgacgtacacacggcgtccatccctttcccaaaatctcacctggaacgcgaaaaaacaaaacgagaaaaaggccactgtagctggctggctggagctcatgtgcaacgcatgcattgtctcgccggttggttcgtgctgcactgcgtattcactcttcagatacttgtggttttttttgttcctttttcctgcgtagatcgagattaggtgaggtgagcgtgagcgattcttggagcggttcgtgagcttttctttcgacgattaggattagctcatccaacctcacctaatctcatatccttttgcacggcattttgggtcgctactttctgaaaaaaaaaggttgttgttgccacatactacagcttggtggtcgatctcatggcttgcttgccggatccaaactttagtggaaagagagatgcccaaatgtgcacgtcgtttctcacctgatgccttttcgtttgccactttgccgggccagtgaaaaggcatactccctccgtcccaatatattaagacctaggatcggatgagatattttctaatactacaaatctggacaggcttcctaatatattaaaacctaggatcggatgagacatttcctagtactacggactgtctagattcgtagtactaggaaatgtcccatccgattctatgttttaatatattggaacggagggagtacattatgggatagagcaatcgagtgaaatgcacggtaatcaaatcagtagagcgtgaggtgagtgaggtcagtgtacatagaggttaaagagaaaaaattaaagtaagaaagctacgcctacactagattactagttgctgtaaaagaatttttgtgtaggagaaagtttggaaagcattggcgtgcatgtctctgggaatgggagacgtatgatgtgcactgcaccccgctgcttaaacaaagaagttaatcatggctgctacgcgagaaaggctgcaccggtgttttgtttgcacaattcccgaggccactaaaagtgttactactccactactacacaaaactaatcaatccaatctatactagcctaatccaattgtgcaggattacgtacaagtaggaccggccgacaggcattgcttccagggttacattgcatgcctctcaactgcacacaaggttatgtactgtcacgaaatgtttggatctcgtcgtccccatagccaacctggtagtactttcagtatcagtacatgacacagcaacagaaaatgaaaaaaaagggtcaaaaactgttgctggcagctgcgtcctgaaaacaacattcactaacagaggatctgagggttgccttgacggtgaaatggtagacactctagacttaaaatctcgtgctaattaaagagcgtggatgttttactgcaaacagaactgaatgtttgctgtacgattcaccagtagtcaccacgcttcatcgctgtggctgtgcagtgtaggacgtgcccgtcttttcgctggcataatcgatagcctgtgttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctagcgggaaaattatctcttaaaaaccctaattgcgaaatttatttctttgcttgttgtctagtgtccatgccatctcaagatctcaaatccccgatctatcgtcgagttcaattccgaatccaaaaccttccaaatcaaatccctccgcaaaagtctattttgcctcccccggggtcgatgggctgaattttctctcggcccatctccccctccctcccccggcgctctccctctctctctctccccctccgctccgcccgcgcgccgcgcgcgcgtgcgcgcgagcaccgcgccgagcgcccctcctcccctcctcgctctccttctccccatccctggcgagctccccgcccgcgaagccggcccccgcgcgccgtagttcgcgcgcgcgcccgcggggttgccgcccgtgccgcgccgtatgcgccgtccgcgtcacccggtcccgctgccctgccgcctgcagccgcgcagccgctcggccccgcagccagcgcgcgtgcccgagccgcgccactcaaaccgccgcgcctcccgttgcatcccgcgcgcgcgtgccgtggtggccgaccgcctggtcgccgccgtcgtcagcgcctgcccacgcctgtcgcccgtgtcgccgctccgctccaaaccgccccaccgtcatcgccgtcgtcatcgcctcggccccgccactccgagcgcaagccgccaagggacggaggcagagcccctcctccctctgccgcgacgcccccgctcccctcctccttttccccaaagcggcaaggaggcgagccccctttctctccctctttttccctttcctcttccccgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctgtttttcgcctccacgccattgccgccgccccccgtgctctgttcgccgtcgccgttcgtcgttgcgcgtgtcggacgagccggcacgagcaaggacgcggaaggggactccgggcgcgccctctccttcctcttccccggcccgaggccggagagattactcccgcgccgtcggcctctcgtcacagcgccccacctcatctcggtagtgcctccctccgttcttcctcctcgttccatctcctccccttagactcgggtagtagcacaagtagcctccccgtagctagccggcgccgccccgactgctgccgtcgctcgccgtgtgctcgccgccgtcgccgcccgagctcggaagcgcctctcgtcgccggcctccctcgatgcgttttcgcccaatccaacgctagcatcgaattcccgtagccgcgtagatgctctcgccgccgggaatcggcccctcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcggccaagaccgggtcgagccgaccccggtcagtccctccccgtgcgcgtgttccaccgcgagccgtgaggctgcgcgtgggcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggactgcacttactctgcttgtcccgtctgcaaggctcgcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccgttccggccggcgtcgtcgtctacctcccgccggcccgcgtggcagctacgtaggcgccacgtcggcgccagctcggccaagaccgggtcgagccgaccccggtcagtccctccccgtgcgcgtgttccaccgcgagccgtgaggctgcgcgtggtcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcacttactctgcttgtcccgtctgcaaggcagattggcggacctacctaatttgttgcatttgatccttcctttgttaattgtgataccatgtccccttgtaaccatctagttgcgtctcgatattcgtgcaccctgcgcgagtatcgacggacgccttcaaacttaaaattttgagtaacaacttgggtaaaacttgggttttacaaaagacttggaaaacccgacacctgggtcggtgcttgcgaactaaatgaatttccaaaaccgcggaccggggaacgtaccgggtgtacgatttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttcaaaatgccttgtcatgaaagcttggaggtctcctgacgtggctgatccccacgggctgggtgatccgagttagtaatgtcgtgtgggtaaagtgtaccccctctacagaggttaacaaactgttcgaacagccgtgcccacggtcatgggtggatgtgaggtgattcctagcgtagttttgtttgactactgcttgtgaaattgctgttgtggaaaggggttcgatgtttgaaaaatccgtagctgatggaatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagtcgtttttagaaaagagttcaaataaaatcaattgcaaaaacaacagcctccccttgaagcctgcattaaacacttatttcccatggcttgctgagtactcccgtactcacccttgctctatataaataatcccccccccagttgctgaagaagatgaagcggatcctgctgatgaggaattcttccaggagcaagccggctacgatgagttttagggtttcggcctagttcccaagtcgcgcctgtgatgtttggtcctagtcctggcttccactttccttttgtaatgcagttgtgagctcggggtctgtccgcagcccaacatgactgtacctctactctataataaagagacctctgttgctgtgataatctgtcttcctgtgataccagcactgtttcctgggactggtatcgattaacatgttaatttggagcgtcacgggctagttccggtcggtactagttcggggcgtgacattatcgaagcaacaaccaatatgttttttaaagtaaatttcaagaaaatacagataatttcaccaaattatcataaaactatacatttaaggtgatgtatcacaaagctatagatttaaaactaagtatcataaatctacatatttaaacaataaaattaccccgaaactatccttttggccttttggggtttaatctttaccaataatattaatattatgtttgagttatatacgtttaagatttgtgattaaattaatgttaaatctatagttttgtaataactttgttactaaatatgtagttttgcaatactctatccaaaatttataattttgtaacaaatttgatattaaatctgtagttttgggatatatctataattgtgtgaaattcattcttttttgagaaattatatttttaaaagcgtggcacgaataatccacttctcttttgtttaaaaaacaaaagccttgtgaagtgagtataacttaaccgataaggtttcttatgttgtaacaagctcactcgagttcaagtttcaagtttgacatggacgctctgtattatggctaattattttttcagtggcacggaacatattcgtcgatagtgaggtgtcctcggtgattttgtcaattttatggtagcctacactatcgaagtttgatacttttaaaatcttccacccatgaaaaattaggaacggtaacaaaccaaaatttggtcgaatggattagtgggcggggtggctaggtggctcaccaacgcaggcccgtctatactgcgtaggccacgggtgacaggttgaggtttgttctggctgtggacgtactagcgacagagctagggttggtgcaataagggcagtagcaacgcaagctgcacgtacgaggaacctaaaaaagccacataggctttagacatgggtccaaaattagtttccacacagtgcaaatggcctcatgagtgaatttaatttttcgctttaggccctaccacttttgatttcaaccctcatatttttctcaatttacaaagaagtgtaaattttacactaacccccctaaaattgagaaaagaatataaatcaccactatcaccgggtccacccccacaaccctctccccttctcacgcacaccatctcgacaagttcattggcaacaaactccgccgccaacgcgctctccccagttaccctacctgggcaacgaactttgcaccggcgacctctccaccctagcgatgagctctgccaccgctagcacctctctcatccccggtgacaagaacaatatcgcgacggccactacctccggtgtctcccaacttccccacctcagcaacgaactatgtccgcggcggcctctccccatcatgcccctccactttcggacgccgctcgagaccacaaggaaaccgtatccagcaccgccgcctgatgtcatggcctgatctggcctcaagctcaatagccatggtcggatttggcctctcttatcccttgccaacaagtgccgatcgagcatagtgcatcgttgtcggccatcgccttcgtcgacaacctcactcctgtcacctctctactgctgccgccatgcctccatcgttgttggcttgttgctgccaagctcgggtggagagagagagagaagggcttttgagctcgagtgggaccgctactaagctcaggtgaagagagagaagggtttttgaacttgtaactcacaagtaagaccgatcttccaagtgaagacatggtccccacccaactctctcttccacggcaagaggcgtcctatgtggcgggctagagccacacaccacgtagacgcactgtgaacggcctaacataacagggatatagctcattccctcctcggccttgccaacccgtgatcacccaacgacacgacaactatgggcttttttcgtttattgccaaaaaaacccttaccatttgtaggtaaagccaaaatttggcaagatcaagatatgcagatggcccggactaggttgacccgaggcttgacccactgcagctcagatttttacctaacattgtcattttgcaaacagctagaacaaaggcctgagcatacacaaacaacaactcgtaccattcgaattacttactaacagtaaaggatcccagcttagatagatcagggacccaacaagacagttccgaagatgcagtcaagaacatcaaagatcctggagcccatctaattagcggtggctcactatctgtgcttccccagcgagcaacctgcatgtccgaccatattatcatctctttcaaacaactacgatctccgtcctaaaatatagctacttccggttatacatggagaagtgcagtagctatattttgggacaaagggagtacaaaaactatatttgacatacctttccactcctaacattccaagcatatacactgccatcaccagagcctgcatgaaaaataaatattaggtaatgaaagaggatgtgccaaataatcacaaaggatgttagagaaaagtgggtcaccagatattatatggtttccatcagggctgaatgatgcttccagcgtcgaattgcttaccactggcttcacgttgtatgttgctatctgaaaaaggaaaaggtcaaagtctccacataacaagtctgcaaaatataaattaccaaagatagtttgcatgcttacattattgccatgaaatgaatctagcacatgaacacgcccagctttggtggttaaaagaagccgcctgccatcactgctgaactttatgacattggcttctgaatcatcattaccgacagagaaaatatcaaaaggcccctgtggatgtaagaagttaaatgggttgggtaattaagatcaaacaacatactcattcccattaccttctcaa

SEQ ID NO: 32403 - DNA, 3794 bp, Oryza sativa
gctcaataaaggtacagaacctcagagaaataaatggatgcatacatatatgacttgtttaggattgtgaggaacccaatttccgttttcagaaaaaaagatgatgtacgtaattaaaggggcttgtaagtatttagttgcaaaaatcatacatctgggcttcagaatgatatttcaccatcagatggactgatggaggacaataagaagtctttttaaccgataatcagaaataagataaactaaatctgtaaaagccttaattgactgtaaactgcaggttgccaaattgacgggaaagtagtcaagcagtcaaacagtaaacttattgaggagaaatgtacctgtgctttttcaacccttgaatcccataggagaactgttcgatcaagtgaaccagagagaatgttcccgttctcagagcacaatgagatagaaacaaccctgattaagacagatagtatcctctgttggtattggctaaccgacatattttattggaatttatatttattataaagtttggcaaacctgtctagatggcctttgaaatatctcaaaaaacagttattgaccagtgagagtagacggagagaatctgcacagttaattattttaagtatttgtatacatgacttatatcactctgaagctatgacaatataggacttaccatcccatccattttttgaagaatgcaagacataagttgggttttcagtgaagcacacaagctcaaccccatattttttgctattaatcgtcttcaaacacctgaaagtaggtaagtgattcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacaattggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcagagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatttgaaagatgcgatggtggttgtggcaatgaatctgccaccacacctcttcatattgcagcaatgttattgggttgccacataaataatcaaggcgagcactacatatagtaaaaaacaaattaatgttgtttatttcaggaaataatattatgtaacattttgttttatccctaaaaagctaggatttagctagtaagttgtaatcaaattctaaagctgctatatcagagagaaaaggggtgaatagaaaagtaggataagagaaggcaaatgaaagaaaaaaaaaagagagaattgtttcagttccgtggtgttccacgtaagcaccttagggggttatttagtttttttttctaattcaggatttcaggggttaagtaagcgaacaccattatggctatttctttatttagtttctgttcctcttaagatggaaccaactagagggttgcactgttttgtatcaaaggtagaatgtatggcaaactatttgaactagtataattcacaaataccaacatgccatctctaaatatggcatcttcatatttagttcaaaataattgcccgtaatagcatatattgttcaagaacatgtcctctaccaccacaagtgtccatggagtgacatcgattatgaatgaactcactaggcactccaatccaatgaaaccttaagccccttctattaaaattcatccactaaactaaactaaagttgatatattcgacaagcaacgcctttcgattcatcgatacatcacctaagagccatgacagcaatgataacccatgtaacacttagaagaaaatggcacaagcaaagcaaaagggaaacaccaattccagtagtcgatagaagcaaaaaacaccgtgtaacagcagaatcttacatagtcccggaaggccagcccaacctccatgcacttgaacatctcatcggtgacctccatgctcaccatggtcacccgctcctccctctcccgccctagaaaaatcaacagcaaggggcggaccccccaatttttttggggggaaaaaactgttattagtcctaaggttaagacaaagagaaaacctagcttccagatcgagaagagaagatcaaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgccgtgcctggaccggcccgcggtacggcacggcctgctcggcacaccggcccacgtgccaccatcgtgcccgttccggcacggcacgggacggctcgataagcagccgtgactaacgggccgcc

SEQ ID NO: 32404 - DNA, 13285 bp, Oryza sativa
gcagctcctctccccaccgccattgcgtcgcccgtcgtcggccgccgacgccctcctcctcttccgcctcgcactgctggcctcgcagagaagggagagagagagagatgagaagggtgagaagaggggaaaagagagaggaagctgatgtggcaatgctgacacgtgggtcccacactgactcagccgccacataggataaaaccggcggtcaaaaccaccgaaggatctaaaatgaacggttttgtaagttgagggacgccggatatctggttttgtggttgggggacaattttgtaactcgatgacaagttaagggaccttcggtgtactttttcctatattatgtatgggtttggcccaagtttgttgcttgggtcacaatgggctccgatccattttggcccaagaaaatgaccccgagtcgagcgaagcatcgaggaattcccaggcagccgccagccggccgatcccccgtcgctcgcctcacttcgtcggctcgtcgtcgtcgtcgatgccgttcaccggaggactgggggcggcggccagccgttcgttgcagcgcggcggcgagatacttcttctccatccaccggccgcccgtcgatcgcacattcgcacgtacgcgacgctcctcccgcactggccggctacaccatgctgaatcgggtcaggactctccacacccttcatacaatttgcttcgatatatatccaactatattcaggagaactaggggtttcgattgatcgtctgaattcatttttgtcaaatcgtaatgcgttagtagttggggatagaaattggggtactaggctactagtaattacgaatcggaattaatatcgaatgacctagattgccatttcaccaatgtgcatacactgatatgcgcagagccacatatcgatttgctggggtgaattagaactttctaaaaaaaaaaagaactcgagacaatctggagtatacatggattctgcgtctctagttcagtacgcgatccatggctagctatgcgtgctcgaaagtcgaaaccagctgaatcaggccctgtttttttcagtttgggattattataatctagattattgagtcagattactataagctagattgtaataatctgtagtagaataagcagttagttgtttcttttctagattattagagtctagattattgggtttgcaagtctaaagaggaagtggggtggcatggtgggtaatttttcactcaataatctggaaaaagctcacctaaatgagcttatcagattataataagttagctccagattataataagctacttcaataagttgtctgtttctttcattttactcccaataatctggattataataatcccaagctaaaagaaacaaggcctcggtgactttattttcaccatatttattcagttttctctccaagtagtacttctcttcaatttctacctacattatattgacacactagctagtttatgcgcggatattctcgatcggttggcaacatatttaaaatggatatttgtttttccacattatcgtatcttggattaattttggtagttcaacacacaccatacatcaactataacatacaccctttgtccggctggttgttcatagagtatcaattacacagtagcaaaccgaaaaaaaaaatcgtttagtttacaggaaactttgtaaatcttgaaagagaaacacttatatgtatctgtttcttgatgcactcttggaagtgagacgtacgtactgatcaaatacccgtacgagaagttttttttttctttctgtggctgccgatgaagctcatagaagatatctaatagcacaactgcatcaaatgaaagtaaatattcgattagagtactagctagcttgttccagacagctgaaattgatcgcctttcgatcgaacatatatagaataggaaggatatcttgataagcatagatgcatgggggataattaaacatgctaagtctcttttgggatcgatttgagttttgcttttcaaaccgcagcaaaaatgaaagtaattattgctaattctctagatttgatctaaagttgctactacttccattaattggtcatgacaaattggcatttggacattctaatttacacggtatttgagatgaaactttgaccactattttctatcaaaatatatttgtaaagttcaataaaattataataccttctgaagaaaatttatacacacatatatatgatgatttctattatttatacaactaagtatacagaggataatgattcttaaaattataaaagtacaaattaagtccaaaacaacatgttattatgacatgagggaatttaattctttaattactagttgttttaagaggactacaaattaaagtaaaccatatacgaacttattttttagataatggattatattaaacacggcctctacaagtcacaagcacgagtatataagactctcctgttatatgggtaaagcataaataagttttaaaggcggacaacaagcaagaggaacttatgattagtctcagtactaacttacatgcatgcattctaatcagtctagctaaacatatatagtttgataactatatgctccatctgctagctaactttgttgctcatagcaaagttatggaataatatgaggtaaacatgatttttatatatattgagaaatggagtgataattgaatattcaatatatgcatgaagcactcagaaatggtttgcagttttgttttgccacttgccatgcatatatgtgctagaatgggtagatgtctgcttaatttgcaccagatttgtggatacttgttcaaattattgtagaaatatggaagatcaattatatccccatatatgcagttttgccagactagctagcaaagtcacaactcacaacgaagctgagaatgcactttcttgctacatcttaatttgtctgagtagatatatattcctatgcatcatcacgtggtctctcaaaacaggagagcataaattcaagcataggctgatcaactctttaatttgtgttagtagctactaccactgcgcttatgctaataagggctaggggtaccgtacgtaccacgggcatttcttacttgtttctgaaggagtatactataccttcgtcctaaatatagttgattctggactagacaaacaattgttcacatatatatagccataagttttatatttgggatggaggtaatagaagcaccaattgcaacaagagatagcatgaaaaaaaaaccattagcaagagcttttagaaaatttcttttgagagcattgatgaattcatgaattgtttgaagagaacatatcgaattggacaaagccatccaaagattatcttccaagctgtacattatagtgacatgatctgaaaagttgtcctcgaccatataaaaaaaatgacatatatttcttatcaaattttcaggagcatgcatgattgcaagttttttttcttcattcattcattctagagtaagaactagagagagattctcattacatgatcaaaacgacgaatcgtctaagcaaaatcaacaggtaaaagccaacttaacaagaccatctttccacaatgagcatacacaaaaacaaaccctaaatccaaatatccatgcaaaagtaggcacgcacacacgcctacacggccactcaccttgtcgccggccgtacacatgcggcatgccgtccacgcgcgcggcgtcccgagctgatcaggacggcgcccatgccgaggcgaacacgacgttgtgccccttccacgtgagcacgaggtcgtcgtcctcccgcttcatcccccacccggccgcgtggtcgttcagcatcgccttcacctcgccggcggcctcctcgccgaacgccgccgcgcggaacccggcggcgcgcatccgctggccccacctcgtcctgtcctcctgccgctccaccctctccaccccttcctgcgccagcacgttctccaccttccaccccacctccgcctcataccaccgccgctgctcgctccccttggggaggaacgtgtccacggcgtcgtacgggatccacaggaagttgaacgccgcacgcagccgccccaccacgtcgcccgcggtgaagtcggcgtcctcgtccaccaccaccaccagcgtcgggtcgagcgcccggagagatttgaggagcatggtacggagggacaccggcggctgcgccgtcgtcaggctgaccgagccggccgtctcgtccgggacggtgtggaggagcatgtggcagttcacgaccagcgcctcgccgccgtcggagacgagctgctgcacccggagctggtcgacgagggacgtgagcgcgtcggccggcgaggtgggcaccacccggaagtccatggacatgttgcgggaccgcgcgaagttgaccagcttcgcgcccagctcctcgtagggcatgtcgagcgccggcggcggcgcgctgggcgcgacgtcggcgacggtgaggcggaggatcgggggcccctcggcgcggccggcgagcatgtcgatgagcgtcgggatctgcatgcagtgcgtcgtgctgaggtcgacgatgtgcacgacggggaacccctcgacggcctcgacgatggcggcgttggccgccgtgtacccgaaccggtgccacggcgtgaggtcgatgaagctggcgagctcgacggccgtgaaccggtgcacgtggagcgccgccgactcgacggcgtccgctaccgccgcggtcaccgccttgcacgccccggtcctggacgcccgcgacacgagcgcgcacaggaacgccgctgtgagccgctggttggagtccccgtccgccggcgcgatgttgttgagcacccacaggatctgctgcgtcagcgtggcgtcgttggcctcgatggcgttggcgcagtgcaccagcagctgctccatgcagcccgtgctgttgaggttccccaacgagatcttcgacgccgccgccgacgacgggaagtagccgctcccacccaacgtcgtcgtcgacgacgacgacgaccacggccgcgctcctcctcctcccctcgtcgcgccgacgtcaaggtacaaccctaaccctagtccatgcccattagggtgcagaggcggtggaggtggcgcggtgtgcgtgaactgcatcatgtagtggtggcaccagcgcggcgcaagcagtgcagagacgcgattagaaaacagcggagacgcagagctagtacactttgagcggtttgaggcacggatttggtgcttgtacaaggcatatatagagggctgtgcacttgttgctcggaggcgccacacgtggtctcatactctcatcccaagctgccgctgctagctatatactgctacctagctaagccaaattccattagaactttgggaacaacatggatccaagggagggaatggagagaaagagaagctggccagtgatctagtacaaggaatatttcagtgaaggatcgatcgagcagagatgcaactgtagatggtttgtactatctagctggggaaaaaatggcaagaaactaatgaattcttcgatctcccatgtacttaccatctacaaagaaggatatatcgagatctgagagcactgttatggtagctaattaaccagaagctaggaataattagccgatcgagatggcatgcggttctagctagctaggagccagcttgaattcaagattcaagctgcggagatttctgcttgattgtctacaagagaattttatctaggatcgatgaactagcagatcagggagcagttgggaaagcgaggagaggatagatggggaatgctaggggaggggaaggggaagggaagaagaggttacaagtcactaattatagagggaattatgtagtggtttcttggattgttctggatggccagctattcatatatttgtctatatagtaactagtaattatcaagatcgctagcatgtcacattatgaacaatattttataattactctgcttggtaaaaatatataatgcctgtaaaataatgtataattgtcaacacgccaaattaaaggttaaaatgacatctagtggcccccgttttttacaagtctgatagcccattcggacttcaaaatcattcttattacctcatctgaattatctctcattttttctgcaatgatttaagctgtctatgatagagtaattttgcttctctctaaaagatagctttgtcgtatttacaaaaggagacatgggttgtcgtgattgtaatttattcgattttctttggaaaaaaaacttaattcagagaacgataaaaaatatatgagttaaatataacaacatactgatcctagcctcctacaaaacacacatgctcgtgtgagtgtacatctacctgtattgtgttgcacatagctagctagtataaaattgtgaatataaaaaacttttctatagattaccttttaaagaaagaaagtatggaggcaaaacaggagttcgatcataattaagtatcataacctcatggaggatgacgcagatcgacgtacggttgaaccggtgcactgtacagttgcgtgtaaatatgtacgctaaggaattttatgcacatattaaatttttgtaatccgttttcaaaaaagaaaatgtaacccgattattttagagagagggagagagagatagagagatcacggggcatatcatggtgaaatgatttggtcagttcgcgttgggccctacatggaacaaagctacaactagtttagtaattagagagagggtccattctatttaatatcctcattgttgcaactggaaaacgactctttgtatggatctaaacttacgcgtccaagcactggaaactattcagctgaagaattttatagaccaggtatgctgctctgcagcgcgtagacacacacacacacacactaacaattcgaccaaattgattgatagatggcacttgtgacatataagttgcttataatagaatagtaggcttacacttcgaatatttccatttgttcttaatttgccatagaataagagtgcatttgtttaaagttaatcaagcaaatcatcttcttagttaattacccaatgtcgttatgattttttaaggctatctacataaccatatcctcgatatgcctttagttaagtgcatgttaatttgcgtgccaatgtcggtctgtgtcattgctagttgttggaaaccatcgggataaaattccaatagttatacattactacatctgtctcatagctaaaaatagatacattttagaatgaaggtaataagatttcttcactacctgtgttaatatcggtggtgctgccactactttatagcaattagatccaaaacaagaattcagatataggatcataaagtggtagaactactgcagaaacttttattggttctgcttattaaccagttgtaggcgttggtttctcagtcggaaccaatttaagagtactaatgcctaatagcataggtgccggtttaaaatacgatacttataaaactataagtaccggttattatactacaaccatcacctataaatccgaactgtgccggttatgctatccacccagcacctataaattagaatgtgtcgggtatttacttaaaaccggcacctattaagttttataaatatcggtttttcaataaccggtaccaacactcataaaatcagcacctatacctattaaaaccggtacctattatctgggaggtatttgggtaaatactatagatatcggtttttttttaagaactggcatactctagtgaaccaatgttgcgctataattaatctcagttaggacgatccattattaccacagttgtaatgacagaggatgtttttggtagatttcaaacatacaattccaagggaggtgtgagcctatcatcacgcaagcttgaagtagggatcagaagaatttatagtacgacttataaatatacttcctttgtttcaaaatatttgacgccgttgacttttttagtacatgtttgatcattcgtcttatttaaaaactttaagtaattattaattcttttcatatcatttgatttattgttaaatatactttcatgtacacatatagttttacatatttcataaatttttctgaataagacgaacggtcaaacatgtgcttaaaaaatcaacggtgttaaacattttaaaacgagggagtatctacgtacggatgtctgcatgcatacacacacatacatgcatgcatgatgtgtgtgtatttatgcctctctgtagcagtaaaaggaagaaagaaagaaagaaagaaagatgccaattggcagaccccacccaaaaacacattgttgtacgtgtattctgtacaccaaaacagaagcagatcgaagcattcatttccggccctactgatcacacaacactactactcgctacagcgatcgatcagctgtgatctgtcccccgcgcgcacggctcgcgttcaatgcgtcacacacatgatatgatgcgcggtgcacacaccggcatcagctgcgcgtagtacacgcccacctacagtggtatacggctccgctcccatgtatcatggggagatttcagttcggctcccgcgcatgacggcactgtaattttctttttacattttagctattttaatattttatcttataaataaccctttgaaaaaacttattttagaaataaattgttttttcttgatacccacggctgagaacctatctataagaaaaaatatttacaatttaaactatttttgaaacaatattttttgaatagatcctcggtgccagttttgttgacattgaccactctatacatcttgactgtttgggacgtgatgatgttggctgccagtgtcattagcgctgagtgctgagatgttaagatctcgacctcgacgctacagtcatcgagtcattccaagatcaagttagtttaagaatctatttgtaaaataaatttatagaacaatcaaaatataggggaaaaaaccagcatgactgcacggacgatctgcggtccgcgacgcgagcgattaaatgcacggagtttacgtgacaccggccgtggcgggccggaggagtacgtacgcgctgcaacgcgcgtacgatctcccgtgaaccgcggggctcgtacgtacgtactcaccggccgttggagagaggcccccgcggccgcgcgcggcgcccccaccgaccggatcgtctccactcacgtttgtccaccgtaccacgcccgatcacgaacaaacggatggatggatcgatgcatctgcgcgcgcgacgagagcgagagtgaatgagctcatgtgcgcacgcatggctagctgcctgcctgccctgcatctgcgtgacactgttgagagtagtaacaacccggagattcctcgtgactgctgctgcatgtcagcagttttgccgtcgtacgtagcagatgcaggcaaaagctcaaaccgggaccacatgtcagcttcatgaggtcattctcaacccaatgactaggatggtgtacatagcattaaataagttgtcacctaggatgaaaaatgatgtgacaagtgaataaataaggaaagagaaggaaaccatgtcttgcatgagacgtggtttctacacaacatccaatacattatgtgagataaatagcattaaatttaggtatggaatagtggtgtttgcattgggagagtggtgtctagtactaatttcttgatgatgtggagtttatgtaaactatgtttagtgtctggggttgggaatggccttattagtttagctgtaggtaagctctatagctacgtacaacttactactagtctactaccgctgagtacgaacaggaagctagctgccgggcttgagctttgttcctttgtctgaaatatctagcttatctgatatgcagttgggcgtagtatatgtgcggtaaacaccatttgattcgtgggaagaattggcacgaactggaccacggactcacggaattagtactgatcagcgtgcacttagcttgctagccatgtagcacatatgtacatgcaggctgcagcgaaagaatctgatgatgctctgtgtcacaagatcaagacggtgtttgacgtgcaccgtggatcttattattatcaatgcctgaattcaccctagttaattatgtgttccagaattctgatacctacctccatctctcttaactcttgcagagtgtgtctgactgaaagtgatggcctcttgcatgcacgtggtataattcacatatatatcgatataagatgcatatttttttcccaagcgaaaatggggggaaaaagttggaaaaaaagatgtttaattttcagtcacctgaaaatatataaccacaaattccgttcacttttaaatggcttagattgtgcaaagattcgtacaatgcaacaaccttatcttctcccccttgcggcacgcttctccaacccatcgcgagctcatgcaagcgtacgtgtaaggccacctagatatgtctcctcggttctgccactcttctgtaagacgaacgacgatgagctatccttggcatgccttctttatcttctgtggctctcccgttcctagtcactccagatattccacgacccaaccaccaatcaagtgacttaaccctatttgattcatcttagaattattataatctgtattataaggagtaagttcaaacaaacaaatagattattatgatagattatcgtaatctataagccagattagtgtaatctaataatctcctttggaggagcctttttttgattattggttggctaaagacccactatccttagatgcctccaataatccagagaaacaaacagctcacagcttattctatgtcatcttattataatccatcttagagtaatctaaatttaataatttatattacaataatcttaagctgaaacaaacaaggccttaggtggtgccaccgtgccttgccactcgctcgtttcgctgtcaccccttccatccctctaatgtcgagtaaacctccttccccctccatcaacccctaccataaaatcctaacctacaacaccatttgctctcgtgccgtcattgaagcacggatcttgatatatgtgcatcttatgttgagcaaatttgaccagaattttgaagattttaggcgagaagaaatcttgtgatccccccttccaaaaaaaaggaaataatataaaacccaatcgaggtgagcactatcgtttgcccttcagcttagctgtacctaaaatttaaattttaaatcttaattttagagttgattttgatgttttttcatcatagtttattttttaatgttagtttttaagtcgctaaaatacatataaaatttattttctgtccaataagaattatggtttacaatcaattttaggtaaaacaatgtaagcggtaacgatgcgatagagtattatggtttataattagttttaggtgaaatgatatgtaattgctgcttaattactcttctgcctcaactgatatggacggtactttcaagttctccgaacgtgcatatataccatgtttttgctggctttcatatatagatttgcaattgtcatcatcttatctttactattagtgttttttcacaccctgatacttttagactcggatggaatcgaaagtaccaaaattgacactttgaatgtagtatcaagcgataacttctgtgtaaccgtaaatatcaatcactactgggaaaaccattttactggacaatactccctccttcccataaaaaactaacttagtactggatgtaacacatcctaatacaacgaatctggacatacatctgtccatatttgttatactagaatatgccacatctagttctagattcacttttttttgggacggagggagtagcaaataatttttctaggcagatagacctctcggagctaaacgtccgtctacgaaaaatccatcatagtttgaataatcattttctccttttccttaactagcctaagagcttgtgcgttgcaatgaaaaacaaattgagtttctaacattaaatcaattagtccaagtaatacaacaatttttcgtattgaataagtaggtgattttaaaatttagagggaaccaataatgaaatggaggactcgttaaaaggttgtgtaatagtgtagattgtgagatccaaatatcagcaataggggtggtgtgagaatagacacatcactactaacattttaagtagtatagatttgcagttgtcatcatcttatattatacatacaacaatagatagtaagtgctgatatatttttttttcttttgacatatgttcatgcatctctagtctctacatagtttcgccaaaggtaattgaagcttatccattcagaatcttgacgtgtatatttacttctgcatattcttacacatccacactagttaagaattgtgatattgaaatttactcggcagataacaacgacgtttatcggcacgcaacgcatacgtacgtacataattccagcaaacgctagctagctagtagcttagttcaacccagagaattaattaaattactgatgtcgtgatcgtctgaaaaggtgatgttgttggttacttgtcgaaattttcctacatcaattacgttacaatatagcattcacacgtgtcgacccttagtctaattaagcgtacgcttttgattatacgacgcacctaacaagtatcaggcattggcaggaccgagctacgaatgctgcatcgtcaaaacaccagaatccatcaaccgaaaaaggcagatcgatttcagagattaggttgatgatgacttaaacaacatcaaaattatggtcacatcagaacaacagcttgtgatccatggcatcccaaatgtcccggtcaaacgtggcaaaagttgggtcctgcctgttccttcttggacttaaccaaatgcaagtatatatgcttgctgcaatgaccactactacacagtcccagaaaaggcgattgaaacaatcttgattttgcacgcatggaaaggtgaccaactttgtcagtagaagaatctgatggaaagcacatagggcgaagaagatagggttaagcatgtctattatactagtccccattatgatcagccactaactaaacaggattttgtttaaggctacaagggcaagatgacaagtagct

SEQ ID NO: 32405 - DNA, 9498 bp, Oryza sativa
ctgtgtgtttttctgatcattccatggcactcattcagtcactactgatctgttactctgatctgttattcctgtctctgcttgcatggtagtttgaagctagtacttgtactggcttcattccaatcattgtttagggtatatgtcactaaattccatgtgtcctgtgcatgagctagcatagctgtcatgctcggagaaagaggggcttatactgctaatttgtttttcttatccttggagtcttgtagtatttttgtaacaccaaattgggatcagaaatactccattcaactaactaaggtactctgtatgcagcaggctaaacaaatactagtgccttgtactcgcccgttgggcactaatattggtgatactttgccgacaagtacgatacaagtacaatgcattttattccggattcaggtttcagacactagataatagatacataagccgtgatactgacatagtgccatatccaaatctccctgtttaaggtatatttagacttgaaacatacacgcatcggagtttggattaggccgtaatccattccgattatattcgagagcataataatttatttattcataacttcgtttcgctatgaggttagactgtaaatctgtagtaattcatagatttagttcggaccaagcaagatgcctgagccacaagtatttgggctgccacggcccagtttctcctgacatgataagggcctagcagtaaggctcacaccacttgggcatctcaattcggcctggtaactgtgtggccgtgtggaccacacagttaccacgggtggcgatatgggctgcagcgatcggagcaacggcgacttggcgggatcacaaatcacaatcgaaacgtgataaacagcccactggaaccgtggcccggcacgtcgcacgcgtgacgcgtgggggggtgctcgtctcgcctcctccgccgttcgccgcggccgcgccgcgggagggttgggtatcatggccgcgcggtcccacgggccacgagccacggccacggagctggggctcacccggcctctcctgtaccggttttttcccggctgccgcgggcccgcggctacgtcctgtgcctacgaggccacgatacgtgacagcgtaagttctttggtacgtggcaccaaagggcctatttggatggctaccatgtcaatttttctgttagtaccaaaacttaggtaaatttttagcactaccaatttttttggtagggcaagattatatctggtttgctaccaatataaagccaacatatgaattgtagtgaaaattgttctagagtgatccgaaatctagcataggcattaccaataaattggtttcaatccaaaccaagcatgaattatctatttatttgtcgtgtgatttctaacaacaaatcacctagattttttatacccttagaattacatccgacggactacaaagggcctgttcactttgatgccattttcaccttaccaaattttggtaaagttaccaaaaaagtggctacatttagtttgctaccaaattttggtaactatataagaatcatgccaaaattttggcaagttaccaaaattttggtaactttgccatattttggcaatgataaggttttttttgcatcaaagtgaacaggctcaaaagaaaataaaaaaacacatatttaattacacattatttttattaaaattatagtgtacttacatatcatatcaactgaatttacaaatgtaattttagttatataggactgtaattttatattttaaaaaaaataagaaatacatatttacttacataatatttttatcaaaattacagtacacttagagcaggtacaatagcaggctataaactagctataaacatatttttaaagagataaaagaggagagagaagtgcagcgggctataaatttatatccagttgtagcatggactctaatatacaataagtgtatgacatgtgggaccatatattaatagcgtaatatataactattgtatgaattagctattaaattaactataaatgatttagagctggtagttggctatactattaaacttgctcttacatatcatatcaactgaatttacaaatgtaattttagttatataggactgtaattttatatttatatttttattttagtttcaaacatcaaacgatcgagaacatgtgtgaccgttccctgcatttgtcaccctgcgtttgctgtctacagttacacacaggagccacgccccacgaatgtcaaataaacgaaagcacacagggttctcgaggtcaatttagcggttgaaaaatcgacaaatatcaagtgaaaaatttgtcgacagatttacagcaaaaactgaaccaagtataagtactatttaaactaccaatattaatatttgtagggctacgttttggtagcaattcaaaacggccccaaatcaccaaccaggtaattaaccagtaaccaaccaattgactagtattttctccgttctaaaataaatcaattatatgatactataatactatgaatttaaataaaaatctaagttcgtagtattataatatattgatattgttgtattataacaatttattttgagatgaatagagtaagtgcttgcaaatactcccaccgttcaaaaaacgaatctagaactggatatgacatattatattctagtacgataaatctagatatatatatccagattcatattcctagaatacgtgagatccggtaactagattattttttttggactcaggagtactcaaccactggtccacgcctctctgcttaatcatcaactgtacttctcatagctagcgcgacgagctaggacgtactagtgcacaggggctatactacattagtaccagcatctacgagggtcgtcgacgcactgcttcctccgttgattcaccagtgctacgtgaactatatacgacgtagagaggcgttgtcaccagtgctttcgattgtgattcatttagagcaggtacagtagaatgatttagcatgctccaaaaagttacacatcatcgtattcctacgtggaggaaagagaaaccagaaaaaggaaggaaacgggcaactaatctagcgccgacgatagcacggctccatatgcgcatgcaactagtactagcaattaaaaatacattttttgggccccacaccaccccatccgatcacatgtggtttgctctccttctccttccgcccaattagtatttcccatctccgagcagtgcagctgtgcaacacaggttcagatcaagcacgcggaatcgctctcctcttcctcctccatatcttctccaacgcagcgacgcttcttcctagcatcgtcgtcggtgccaccgttcgccgcggcgtgcagatgaaggccatctgaaagcgtcggcactcccttccgttcattaaaagactgatcccagtttccagcctttgggcgacaccgctgtgtgctagatctgcgccggtcgcttgatcgacgcctaccgcatgaagctggcgttgtctccacgctaaatcttgctgtcttgcgggtgatttcgttgattaaaacaaacaatcggctagggagtggttcagtagttctgatgtactctgtaccggtggatttggctttttttttcttggttttttctctatttctgcctgatctcagatgtatgcgtatcttgtttacaaaaggcggattttgtttccatgtatttttttcgccgctgagtgtattttttttacctcgctccatctgattttcgatagcttccattcaattatattcatgtagacataagaactcatatctcaaaacatgaatggccacaaatatgaagttcacttttgatcatacacagtaagtactcataaagtatgtgtatgtataattaaatatttctttcatgagatgtagtaagtacaatagctagtctattgtattagttgtttgtaatattagctataaaatgacatggagataatggagccagcagcagactatactattaaccttgctcttactccagtatatactcgctggcgttgtcagaataaagaacaccggaacgagttgcatgtgtatcatgtgcccagccgtccaagaacgattcggctcttcaaattggccactatcaagccagcacgctctcgaagggacagcataaatgaatcgatctagcgaaatctaaagttgaattcttttcccagttcaagcaagcgcaagagcgaacaaacggaagtggctctcgtcggtgatccacgcgcgttaagggtggggagaggaagagagtacacgcgcgaatgaagaatcaacaccgtaccagcggggattccgatgcgattgacgatttttgttgatatatgttcccatacatgttttctccgtgggaatcaatgtttatatcctattcgatactcccatttcttttacttcgcgggacaagaacccaaggccgtaatagttgtaactttgtttagtgggttttctttgctagaaattctagtcataaatcggtatattttaatccaatagcataacataataaacatgatatatacaataaagaatggtttttccacggtgataaacataaatatgctagcaagaacagtagcaactaaaaatatgtttaacactgaaataagaaaaacataacagagaaagctccggatatagaagaggaattgttggtgttgttatccccgctccgttgtcgtcgctccgtcctcctccgttggcgccgttctcggtagtggttgacttgattcgagttgttggtgcagaggaagaagattgtgacgtacgtgctcccaaaaggtgcattagcttgactcacagaagtagaggtcgtagtagtaatatctttttgctccggttaggtcatacacaatgcacctacatggtgaaactgtagaagcctttagctcaccccataagagccgcgctgctagagcgagtgggttcatcaggctccccgtgtcttctacaagacatggtggtctcaggtaggaaatgttgaatatataagcacatatagatttaatttattatataaataaatcatgacattgaacatgtatactagcagatccacatcatacgatctagacatgtaaactatatagtaaaccatgagcaggtcaaatagatgaaacatcatgaacacgtaccaagggttctggttatactgtagatcaagttgatgaggagcaacgcgcgctgcaggaacaacgtgcagtgccgaatgttatcgttggtgcacagccctcgagcatagaggaagacgagctgtcgtagaagaccagcaagcagttgcgcaaggcactttccaaaaaccttattgccgccttctcccgatataggacgtcgaaggcgaaggttccggagatctgctctcccgattgctagtgcacgcaggcaaatgggatggagtagactacaagcgacggcgcagtacagaggaggagtcaaactctagattgatttcccgtatattgcgggagtcggcggctcggtttatatagagatatcgggatacgtgatcaggacgcctacatgatcttcacaccacataaccaaactggataagtcacgcgtaacttaatcgaattccacatcgttccacacatgcattggattattcggtttattttcaaaaacaaaactgaattttgtagcaaaacaaaactgcaaaaggaaattgcatttgcacaagggtgaggaaccaatgttggcaggccattcatgcagatgtcgcgtacgcaagccatctagccgggcgaggtgagcgagcatgtgcgtgtgttccacttgttctctctatcacatatgtccatgcatgctatctcatgaggtggacttttatgattttttaaaaaattaatctttaaaggcaaattttgctacaggacatcgcaattgtgtggttttaacccagggacaccgcaaaaacaaaggtttgggcaaaaacaaagctttgccgatggacaccgtgccgtctaaatgaaacttgccgtgctgacatggcaagcggagcccttttttgacgtggtcggaccgaaatgcccctgcgccttatctccgccaccgctgctggcacgagcggcgtgaggtcctcccggtcaaccgagacgtcggcggtgaaggagagcttcttcttcttcttgccgttgctgctgctccactgcacgcgggtggataggcggaggcggaggatgctgccggctcggtgcgttcttggggaggtggaaggggatagtgatgggtgggtggcatggtggttgcagtggtcgcagctccactggtagtcgccaagcttgatgcggaacgcgacctgcgtgtcgttcttctcctcgaggaggatcaagtaccgcgtcgagaggaccggccgtttgccggcggcgcggcgccaaccgcagaggcacaacggcgagcgggtcggcttcttggcggacacgacaccgatgatcaccaccacggggaaccgcgtctgctcatgctcggacgcttggaacgccgtgccgcgcaggaggtcggtgtcgacggcgtcggcgtcgcagcgatacacggcgtggatcctatcgacgcactggtggtcggggacgaggcgggcgcggctgtcgctaagcgcgaacgagcaacggcactcatcagccttggtgtccacagacgacgccggggacggtctcccacatcatcgcgccaccgccactgcccccgccaccaccactacccccatggcgaggagccagtgacaccgtcccgccgagggacgggtcccagcggaggaggaagtgggggccgacgaggaagtcgtgggtgctgtgggcgagaggcgagaaggagagcggcggcgcggcatcccggtgccggagggaggacgacggcacggctatcgaggaatgggttgttgaggcggacgtggtcctccttggtagtctgagttaacgagagaaaagaggctaggggtaggggaggaaataggaataaatatgtgggctacgtgggctgggacatcctgttgtgggctggagtgtctccacccggttacttcggattttgaagagcccagctacgagtatcccccattggaaaatgggtgtctcatgaaggcggtgtttagttccacatcaaaattgaaagtttgactaaaattgaaagtttgaaaaaaaatgaaagtttatgtgtgtaggaaagttttgatatgatggaaaagtttaagggtgtgtttagttgactctaaaattaaaaatttggttgaaattggaacgatgtgatggaaaagttgaaaatttatgtgtgtagaaaatttttgatgtgatagaaaaattaaaagtttaaagaaaaattttgcaactaaacacggcctaaagtttaaagaaaaagtttaaaactaaaagggtgaagtgttttcagttagtgagagcactaatgtagctagtgactctcatggtacatgccctaaccaaacaaccacggagtattgtcttcagcacacatgctgacatgcattgtgacttttgtgacgcggatactactcatctcgccctgcacgagccgtgccgccgtgggatggtgtaccacggacgttcgtacggatgccgcatgcctcgctaccgctgcccgcccggcccagcgtcgtacgtgcagacgtacatgagcctgcggaccaacgcggccgtgctcccgagacacgaggccgcgaccaccggcacggcagaaaaggccgcgccgcgcagcggggggcggccgtccgcgggtcgcgtcaagtcgtcgcctcgcccaggcgcccacgcacgcgtgcgcccaccccgaaacgcggcgccgcggaactatcgccctgcgcaaagctgaaccgccgtatccaatccaaccccacccccacaccccacttgccacctcccacgcttcgtccccccctcttttttcttctaccccacctagagtttcaatactacccacttggattagttattatacgcaatatggagtactatatatagctgttctgttgtctttaaccatggcgatgaagcagctggccaacactaagagcaaggctaatactactaactttaattcatctaagtcaatctaataactaattcatacaatagttacttagagctggtacaatagcatgctataagctatctataaatatattttaaagagataaaggaagagagagaagagcagctggctatagatctgtaaccagctacagcacggactctaagacgtgatgtgtgtatgataggactctaagacgtgatgtgtgtatgataggtgggaccagatattaatagtacagtaagtagctattgtatgaattggctattatgttggttatagatgatttggagctagtagtggactatagtgttaaacctgctcttattatactattaatatatggtctcatctgttatacacacactacgtcttggagtccgtgctgcagctagctacagatctatagtccgctgttcttctctctcatcttttatctcattaaaatacgtttacaactggctaataacttgctattgtacctgctctaatcatgtactatacgctatacgctttcgataattaagttgaggataagatcgatcacgacgcgaggttaatctgttcgcttttattcgacgttttgatgctaacaaagtagggggagaaaaaaacataaggtactgtaaagagtcaagtagaagcagtgcacgcgcaccgtcgacttttacacggccaaaaaatggctaagggatacctcgccggcgagaggctaccaaagagttcgccgggatgcagcaaagaaagcatatgagaattgagcaggttaattagctagctagcctagacaaaaagattcagcagctcgggctccctctcgccgtcgccgacgacgccgcacgtcgtgacggatccctcggagttcatcgacggcgtgtcggcccgcctgccgccggatcgccggtccccgggcgccggcggggagccggggctgagccacaggccgaggtcgcacgacggttccggctggggcgccgcggcggcggcgtcatgcggagtaccggggttcttggtcgtcgtcgtcgtcgtcgaccgcttcgccgtcgagaacgtggagcacccgcccatggcgcgcctcgccgtggaggcgaacacgtcgcggccaccggcggcggcggcgtcgacctggtccggcagcggttggatgcctccgccgcgcagcacggtgtcgaccgccgcctggcagaggtgccagctcccgccggagagcagcccgaccgcgccgcccaccgggttgatcgtcctccccgccgcctcgtacagcagcgactggaacaccgtgcaaccaaccacgccatcccatcagccaagaacacgcgcgcgcactcaccggtaaaccatccatcgtagtacggatccccacccttacctgctcgctgcggctcgggga

SEQ ID NO: 32406 - DNA, 2046 bp, Oryza sativa
acacgcacccctggttgcaccccttccgcagcacgcggcagccgttgcagctcatcccagacgtcgcacacccacgcagcctcgacctcgagctcagccatgggagactcaccacactcgagtatataacacgacgaggtaacctaaccaagggggttgggttaaccgcgggttaacggaggtgaggttaccgcggcctcgtgggcggaacaagttccagcctcccgggctcctgggttgcggggggtgcggctccgcgtctccgcggccggtcggggagcgcgcgggccgtcggatcgggatcgggcggcgcggggtgcggacgcgagcctcgggtggtgcgcctcgcgttcgccccgtccgtcctgctggcttcttggggctgggcgatcgagtgtttttcgccgctgctttttggggggtttgcgggatgcgtggatccgcacattgggacgcgctgcgcgtggaatggatggatggatggagggaaccttgtgtgggggccactttgctgcggttgcgggtggctgcggctgggtagtcggtgcggtgcggagcgatggatggacggggcgcggaaattcaccgtgccaccgtatcagcttgctggtatgtgtaacgtacgtaagcatctcggctttcgtgtttacaagtctactacgcgaggtaaggtttgtaaatgaagagcttacccgacatgcaatctgcggtcaatactcatttcacaggaaacccacgtagtcttcttattactccctccgggttgataatattaggcgttttggaaaacctggtcttcaaaaagtaactttgacaactaatttctattataaaatatatagaaatttcaacaaatatatgattttattgaagtactttctaagactaatctacacattggttttcatatttttaagataaatattttagaaattattcgtagtcaaagattttaaagtttgactttacccttgttcaaaacgactaatattatcagcctggagggagtatattatttggaaattgctaaatttcaatcacctaaaatcttagggctggtttggttcgaggtctaaattaggcttaccaatatttggcaatttcaatagtgtttagtgtatatttggtttgacgccaaattttggcatgcctaagaaaataggccatttgaatagtgaacttagacaattttggcttcaatccaagcacaactttgccttaccaaaattagtcataccaaaacttgataaaatttggtaaaatctatatttagactacaaaccaaaccaacccttaatctatctatttgtctgtctatctgtctatctatctatttatctatctatctatatagacttttatactagcttgaaaagaagcccccatgctatcttcgtggtttagaaaaattaccacaataattttaaaataaaatctaagctgttagatcgtgttaggaccaaattataacaatgtatgttaatagcaatagttgtatacaaaggcaatagaaactgaagaagatagttgtacattaaattctaattctactattaacatctacgtttataaagtatagcatatataaaaacatgagctaattgtccaatttaactaggacacataagattgcatcgggaaatttccctagtttgcagttaaatttgtttattgtataattcatgctaagtttcgtgacgataatagagtcttctctgtctctggctacggtaacgacaacgactgtgatgctagatttagagtttagatatgagagttaggggaggcgttggagaaggggaaaaaagagggtttcactggacttggagaaatgaccgtggatgacttgcaagaaagacatgcggcatgagggcatctcgtagtcgattggacgtacagaggagaggaagagaaaggggaggaaggaggctggctttctggggctccgcccgtgctagggaagcggcaaactcaccgccctggaaagaattagagatgtgataagctatatatcaaaattctctttggctgtactggtagccacaa

SEQ ID NO: 32407 - DNA, 11222 bp, Oryza sativa
atagctacaacggatgattaggaccacacctcaaaaaacatatacaagagatttgcggctaccaatacagccaaatagtacaacttcacaattttaattttgatatatagattatcacatctctaattcttcccacggttgtgggtttgtcgcttcccatcctagaatttgcagctacaaacctacaacggatgattagtactacaccttgaaaaaaatgtgtacaagagatttgtgattaccggtacagttaaaaagtacaaactcacaatttaaattttgataaataacttatcacacctctaattcttttcaccaaggcgggcttgtcgcttttggccccttttgggggaataagaaaaaaaaattttccctgaagcacacagtacagctgccattaattttgacaattcgaccatttacaaaaactaattttacaaataaaccgtcatcaaaacttatttcaaaatgaccattttgttcagcattaaatcatatggacgctgaatttagacacctcggcgccaaacagcgtgacgctgaatgtacgttggcacgctgattcagcctaccatctacggtgacggcgatttatttataaaattagtttttataaaggatcaaattgtcaaaattagtggtacagctgcagcctcagcgcaagtggccaaaggcatcttggctttctgtttccgccgcactctctcaaaaggctccaacgcgccccggtgcttcccctcgtctcggcgtcctggcaggtcgccatccaggggacgcgaggaatcacaatcttcttctccctctcatcctcctctggtagtccggtggccctggcgtttagcgactcctaaaaaaatctgatacgagagtactggggaaaccgatcttctgtgacgtttctagacgactagaccgggtttgcgggcttggcttcatggttgacatgctgcgagctaattgggtgttcgatgctgtcgaagtttgattggcaggtgatcagattcggctttggatttggagtgcggcatgccgttttcatcctcaaaatcactttagggcctgattgggaaacaggacttattcacatcggatgtttgacactaatttagagtattaaacatacattaattataaaactcattccataaccttggactaattcgcgagacaagtcttttgagtctaattacgccatgatttgacaatgtgatgctatagtaaactttttataattatggattaattaggtttaaaaaattcgtctcgcagattagctctcatttataaaattagtttttttattagtctatatttaatactccaaattaacgtccaaacatttgatgtgacatggactaaaaagtagttttagccccatctaaacacccactaagccacctcttgtcatgctttctccttcttggaagcataacacaggtacttggggtaaggctggatctctgctcgtggacctgtggtaacaattttattggaaaaagtatacccaaggtccctcaacttgtcattggtttatcgtatacgaggtcatccgaggtccctaggtggttttgaccccggttttgatctacgtggcggctgagtcagcgtgggacccacatgggccccacctgtcagctggccacgtcatcactctctcccctcctctcctcctctctcactcttctcctgtttgggtaggcagctggggaggacgtcggtgggttgctgccttcggtggggagaggagggagaggacgagggcgtcggcggccggcgacgggcgacacgacgacggcggctggcgactggcgacgcgccgccgccattgctctcgtccgccattgcagaagccacaggcacggaggcggaccgccatcgagggatgaggtaggcaagcaaggggggcggggaggccggcgtcgacctcctcaccggccgtgacgtcgccatcaagtccttccccaaccggcgacgtggcggccagcgaggggagcaaggcatcggcgggggagcaaggcgtcggcggcggtgaggcggttcttggccgcggccagcttgacccggagtttgaggttagaaatcaacacgaagaatcaatcaagaagcattcagattagcacattccaattggcaacctataaacgaaagagtgctcctaataatcaagcaaaaaatgagagaggttcaacctctgaggttaattagaaatcaacatgaagaaagaagcattcggattagcacattccaatttgcaacctaaatgaaacagtactaataatcaagcaaaaaaaaaggaagtgagaaaccaaatgggatggatggatggagtactgactcggtctggcggatcttgtcgaagaaatgggcgtcgtagacaccggcggcgtcggcgaagtggacgacgccggggaagtagtgcttctcgacgtgggcgagcgcggcgttgcgccgccgccgctcccggccgcccgaccgcgtcgtcgtcaccactatcagcatccacctcgacccgctgccctcctcctcctcgtcgcccacgtccaccaccgcgccgttcccgaccccggccgccttcgccgccgccgcatccggcacaaggctcacctgctggttcacggcgacgtgggacgcggcaagctggtggtgcggctggaataggagaagaacaagtagtgcgaagaagaacagcgggcagcgtgacgcggcgacgaggacgacggcgcccaagcccgctcgccccgcgggcgccgcgaagaacttcatggtgccgacgatctccgcggcggcggcaagccaggcgcatcgtcgggaggcacgaatcctacggggacgacggcttcccaatcttcaccgagaccaagtgcacatcggcgccgcgtcgtcgccgccgccgccgccttgctcccctgctctcgcgtcgtcgccgtcgccgccgccgccggccgccggacctcctctcccgtctcgccccgtcggtctcctccccacccgtcggccggcggcgccggcctacccacagcaccagagagaagagtgagaaagagaagaggaagggagaggaggggaaagagagaggaactgacgtggacaggctgacatgtggggcttacgtgggtcccacgctgactcagcgccacgtagaccaaaaccgggtcaaaaccaccgaaggacctcgggtgactggttttgtatagttaagggactccgcatatctggttttgcggttcgaggacgttttttatcccgataacaagttgagggaccttcagtgtagggtttagggttgtgcgcaccggatcgtcgagagactgcacaggcccaccaaacatgggctgtgtttagatccaaagtttggatccaaacttcagtcattttctatcacatcaacctgtcatacacatacaacttttcagtcacatcatctccaatttcaaccaaaatccaaactttgcgctgaactaaacacaaccatgaaaactatcgctaatattgatggtaaacgagggtggttttatagttctagcaccgtgcgataaagtttggttcacgctaaaattaaaattttggttaaaattggaacgatgtgatggaaaagttagaagaggcaagcacccactcaactagatgctaaacatttcattaggtcgttctgaggtggaatcgaaccactctgttgcgattattaaggcagggtgctactgtaccagtagtagagtggtcaagtttgtatgtgtagaaaaattttgatgtgatgaaaaagttaaaagtttgaagaaaaaatttataactaaacttggccttactttattattactaatccaactaggattgtactgatatggatcggcttataacctgctaactacgagtaagttttattatacctgttcttaccaaagtcttgtgcactgtagcatgataatacttgcacgtagtaatatttggggcttttaactatagatttggcaaataactatttgccacccctatcttaatgacatatgggtccatatgtgtctatgacatatgagtctagtggtaaaaagttaattgccacatcaaaatttgataaatggttaaatatctcagtaatatttggtcgacgtgcaagtggaattgtttcggaacaggatcgatcatgcaggcaggatcagcgagaatctgtagaatctggcagccgtggcatggtgctccgtgcacgcaggcttagcctcgctagccgccctgcagccgtcggcgagtttctctgctccctgctgtgctgtctgcgagcgctgcgcccgaggccgccccgacaccgctgagtcgctgacacctcgcgacaagcctggaccaaagcaccggctgcacgagccgaacgtatccagggctttggctcgtactcgtactacgcccagtgcatcatttaactcgtcacagctttgacaggaatgttaaaaaaaaaaagctttgacagggagcaggcaacaggagtatgtgaatgttcatcgatctgcagaattcatctaacctggacaaagctcacctgttacagctagtacctcttcttgctacagtagcaatttcctgatgaactttgcagttgttgagtttgagaataacacagtactctacagaatggtttggcaagatcaatgaaaaacacagtactctacagaatggttctgaattctagtccaagtgcatccaattgcacaccctactacaccctacaggtcaactggaaactttgagctgttctaaagatttcttgtctcagaatctggacgaaccaacaagtctacaatagcgtgcacttttgtgcactcccaagagggacaaaaattcagtagctatagcagctactagtagtagagagttgctggaacaatacactggacggagggggcgcccagcagcagctgctggctctcagtaatatattgagagggtgcggtgatgtgacaacgccatgttctgaacgccacatgaccagagccatagatcgatgtcaatgctcagaagctgccaagaacaccaagagcaagagcaacgttagttcctatagttaaataaaatagccgcattgactgctttatagtatgcctcaaacttagagttacatggataaggtgagaaaactcctactagatgaatgtcttgaccgtaaactaaagcagaatggtcaattttgctctttttcaatacttaagagtaaatataatataaccttttctgattgctcatcaatgtagcggagcgtgcagtgactaggggtgtgtttgttgctggccacactttaccacaactaacgttaggcaaattgtgatagccacaaaagtgtggtggacaaattgttagtctctgacatgtggggcatatgctattgaaaaagtgtggcaaaccacaactgtggcagtaaaccaaacacatgcctaacaaactgcggcagacaaaaaatgtggtgtggcaaagtgtggccatgaaccaaacaccccctctttgtatctaccaagaaatggtatgaaagtattaggtgatagtgattcagatgtgcctacctgctttccaaacttcttgttgatgagctctctcattttttccacggcatatacagaacaagcacgaatctccacttcctcttcacttccaggcacaatctcactgctcgaatcaattgagcaagataagttggagccatatttcagtatgccaagctccctcaagacagcaggaacaatatagtctgcaaatatggtgatggacttgatgtcgtggaactcgccatagttttgtcccttaaaagcaccccacagatcagcaacaaatatctgagctctcttatacaagaaaacctggtgtcctttgtaaagtgaatgatcccgaaaacctgccaaaattatatcttagaacaatttatatcgctgtacagatgtgcttactgcccattgaaaatagcaaaatgaaacaacgcagtatgaacaggtgaaaagaatggtggaaatgtaaacatgctaagctggactgcctctagcaaagaattccctattaggctaaggtgagaggtggaacttggaagctggaagcagacaatttaatgcattagtccttattttcaaatagacattaaaaaggaaataatcataatcatgataaaccggccaggtaatataaacataaatcttcaattctactcaagcttctgcaccaagcgaaatgaaccaagaatcaaggaatcaatgagcaaattactcaaataagttctaaccacttgctggaacaatttcattttaaagattccaatcatcaggcattcaagtaaactaataaaaaaagaatgtcaagaacaaaatggctgtagtcagaacaaagatttgcttgacgagggacttttctaaaagggaaatcaaaatgacttttaaaacaatcaattggacatggcatcagatgacatgtttgaaacacagcctatgcaggggtgcatggcccacacaagattaagctacatgcctggaatgctgcaagtgcaacctgaccacaccaactcattactgtgtcctcccagatccacagtagcgggccaaatctggatgcacaaccagtggttgtacggccatttctctagtcctgtttcactaccatacatctcattggcccattggacaaatggcccatctacagaacaatgctataatcctctcagtaaatacagctcccctcgtcagggatatggtgtcttcaggggcatctaaaagcctacaagaagttctcaaaaaccaagcttgcaacagtttagatcagacagatcaactggggtcagatagtatcttcaatttttgttttctctctctgtaatatagctggacaaatcctggttgggactcttggactagttaaaactagtgctaccaagtagaggataagtgtaacggaagatttaccaggaaaatgacgggtaataagttcgattagagtagcagcagagtttccagcagacttcactagatttgcagcttcacctccaaagcttctttcaagttccataccaacctaaatgcatccaccagaataagagataatttacaaataagagattcttggatgtagccatgtagcctatgcaattgcttggcaacaaacctatggcaaaaataataactattataggagcataattagatcctatcaacaatctcaagatgattccagaaacaactagatgactaaattcatcataatagagatggtgagtgtctttatgcttttaggtgatgacactgacaaatttcaaaatgcatgaagcagaatacagggttctagagatcaacttttcaatgaaccaattaagtgcgacagaacagtacctcatgaagaagccgtactctttcctcctcaattggcagtgggcgtggccagttcagcagttggcggagctgaggccctacattttaaaaacgttttttttagtttaagagatacttacagagtattcaaaatgcatctcagctaataaaaaaagaatacctcccactgtcccaaaatataagcacttctagagtctttcagtgagattaaggagaggtgaaactaaatgatatattgttgtgattagttgagatgaggaagtaggtggagaagttgctatattttgagatagagggcataacttttttatgatagaaggatgtagagcgtgaataaggggcctgagaagatctaaagttgcaccatatgcaggctatcataatgtataactattgattccatgtcaccacaactggtacaataatcccatatttcagtatactgatgtcaataaaaaccataaaatatacttgttatataatgcaagatgtccgtatagaagaaaagttaccagtgtaactctggagacgatctgcatcaagggctgtcttatctttctctaaggctaactttagtccagaagccaaatggtcatagctcagatccttatctgtttcagttacaaacattatgatattactgatcatggttctacaagaaacaaacatagaaatgaaaaaggctatactgcagcttaatagtaagaacatcaatttcaggtcactggaagctagtagtagcctagtacacctataattcatggagattacagaaccactagtacacaatctggaaaggctatagttgatacaggagtaaaagaattgaaatcagataattacagtggttgatacttgatacctgttggtcctattttgtatatccttaggtacgagtacgactaacttttacatgttcgaaacgatgcagcattgctagaacttatacctggccagaagcagaagttcagagcatccaggacgaagaggtactggacagtgagggggccatcgtcaaaatagtgaattccttcgaagtcccattcaacttttggaacatttccttggattttgtccaccaccttctcgacctctgtaagggaaaaattaataaaaatacatgaggattgtacatgcgctttcctttgcaaaacaaaggaaacattagcgtcaatttgtaggcactaatcaaaagcatttgcttcccacaaaatctcaagttcttctctcaaaagaaatacttggaaactatttgaaacaacaaacacccagaaaaggataaatagccaacaaggaatttcaggcacagaactctgaatcaatcagagatcgttgcaaggctaactaaactactagagtcaactactcattatctaaaataaatctagaacaactatggcatgcattccagaccagaaatcatactgctacatagacagacaacatcgagcaatcccctattttctttacaaaaataaaacgttgggggtaatcctaaaccctatcacctgagaaacatccggaagccgcgagcaaaaagagagagagagagagagagagagcatacctaacatgtcgaccttgacgtgggaggagcggctggccacccacgccgccgacgcgcgcacggcctccatggcgagacggagacggcgaggcgattcggataaggcaatgaggggagcgcggggttgggggaggcggctggagggcgggggacggggggcgcgtggttttagcggtttccggtggtggtggggttttggggtggtttggttggggtatggctcctgtggtcgctgtcggctcgggctctcgtttccaagggcctcggagaaattgccgttcgcgcggcccagcgactggctgtggtggtgcgccgtgcggtcggtcggtcggtcggtcggtctatctggtttgacccaacggccgccccagcgaaatgaccgaactgccccccaatttaaggggtacgatggagaaggtggtgaggtgacaggtccctggcccaactgagcccatgacccatttagagcatgcccaacatgggattataagtttaagattcatcgtagaacttgttttttaaagtccatttaaagataggaacgggcatcggttgtagcaacaagctcaaattagagtgataatctggacccactcgtcaaacactcaatgaccataagcttataagctttgattctcttttgctttattatttaactagaaaaaatacctgtgtgttgcaacggaataaaaataaattatattaaacaacaaatttgcaaggttccaatttcttcatgatttaaacaaagcatatcctttgcgtggaattaccaattaacctgttcaaaatagtctaaatcggctatgatattagcacgacacctacgtggtatcttcagtaagctgacacataatacagtcgcaaattaaagtctgcatcaaatactacaaaacatgatacatcaaagaaattatagttagttcactttaattctaacatacgccatacattaactcctcgacccaattccatgtgatgtcaaaccaatcgatcaaatataattattttagcgaatgcataagaataaaagaagatgtcatgctgagcttaacgggttctctcttccagttcacatgtgtcgaaccctccatcaccataagagcccagaaaactgaaagcacatgcaaacaaatataactgcatatggatttggacactattcattgaagtaagattctataatcatttgacttgaaaactaattcttattaaaatttaccactgtttcgccaaataaaatttggagtaagccttttactgttgagcgtgcatggctcacgtgcacgatatgggctcgaacttgtgcgcaggcgaccacaggaccgatctagacgcgtatgttctgcgcaaacgtgtttctctcctactccaacatggatgcacacacccattcgatcatcgtgttctctcctattcctgcacggacaacgaacgaagcggagagccggagagtacgaggatgtgggatgacgcgcgatgatacaataatgggtgacacacgaaattttttccggaatacttgcatatttttaagtaggtaggtatagaattaaattaatttacaagtaaaataagtgtgggtaaaataatatgactggatttaatttttattaaattacttatgattaattacactatttagaattttctaggatttttcagagctcaaatgctaattttaataatacaaatataattatagtaattaatttaaattaaaaataaactaaaaacatctcctaagtcagggtcaaatattgcccattcttccttcctcctcccccaagccggcccacttcctctcctctatcttcttctccctcctaggccggcatccttttctcatgctcggcctagcccaagccactcccatctcccctactgatgcatgggacccagtgccacagtgtcatcttcaacctccagaccaaaatcccgacgttgtacatcgatacgggagtcgcatccagttctgaatccggcctcgtcgctgcttcccttaccaaattggatgcgaaaacggaatcccctaatcctcctcttactttccccattgaaatccccaaatattctaaaggaaatcacgtgaattttggcaatgtttctaatccagagaactcggtaaaaccctagcctcaataggaaagactcggacaaacaacgggcttgattaggattcgagtcgacagacgaaaaatccaccgaaagccttatgtattttgtaagtaggtatagatatagatgcgtccacttataggatggacagggattctatacaatgctaaacttttcatccaattgctcttaca

SEQ ID NO: 32408 - DNA, 569 bp, Oryza sativa
gcttttgagtcgagggtcccggagttgaagcggcatcagccgtcggcatcacccgagaagagcggacaggagcattagcagccagcacaactgaaggtacatcgtcaataggtaccggagcaacatcggaagaggcagtagctttaagtccacccaaagcagttgcctgctctatcgtatcctgagttgcaagtatgttctaagagacaggttatcaaaccagtatgacatagaattttaagagaaaaaaaaagaataggggaaacacggataccttgccagtgccatcagaagaagaagaagaggaggaggagtcgctcaactggacagcatcaagctccatgtcgggcaccacagagcggcggcggcggcgacgatcatcgcttgaagactccgtggatgacaccctctcgtaaactacggggttttttcctcgcttctcacgcatggtgcggtccagctcggggtgtggagaatcttcaatacgcagaccctttttagaagatttcggcaatggaagtctgtcaggacgagcagttctctccttcttatgacgccagtcacgcagg

SEQ ID NO: 32409 - DNA, 461 bp, Oryza sativa
tggatttgaaggaaatcaaacgggcgaggaggaaatagctgctgatggtaacgacgttgcggatgagcttggtcagatgttgcaggacgccagggaagactgcgaaagtgaaaaggaggcccataaattggacaagatgttggaggaccacagaaattcgttgtacccagttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagat

SEQ ID NO: 32410 - DNA, 431 bp, Oryza sativa
tgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatcaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgaca

SEQ ID NO: 32411 - DNA, 810 bp, Oryza sativa
gacaggtgcttcccaaaaccatttgtgtgatcagcacaactaatcaaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgt

SEQ ID NO: 32412 - DNA, 685 bp, Oryza sativa
caatttgctgtgtgtttgtgtgcacgctttcaagcttctcctcgtgcttcacatcgtcaagcggtcaagcgaataatgaggtatttgaatcatacacttgagtttgaaatttggtattctacttcatcttatatatgcttaagtggatattcagatgctgattttggtggttgtagaattgataggaaaagtactagtggaacatgtcattttcttggtacatcattgattgcatggtcttctaggaaacaatctagtgttgctcaatcaagtgctgaatctgaatatgttgctgctgctagttgttgttcacagattctttgacttttatctactttgaaagattatggtcttacttttgagaaagtacctctcttttttgataatactagtgctatcaatattgctaagaatcctgttcaatactcacgcacaaagcatattgatattcgttttcactttttgagggatcatgttgagaagggagatgttgaattgcagtttttggacacaaagttacaacttgctgatatttttactaaacctttggattctaatcgctttgcttttcttcgtggtgaattgggcataattcatccttttggcatggtttgagggggagtttgtacctcgtggttttatcaagcaataatatgacaatgagaaaaattgataaaagagagct

SEQ ID NO: 32413 - DNA, 855 bp, Oryza sativa
acctccgagattatgatgaaacattaatggtggaggatgctttgccgcaccttacctctctccaaacaggggcggcaaagctcatggtctaggcgatggcaaggacaactggacgaggggtgcggcgtgatggagatagcaacactttgtttgggaaggtgaggatatagtggcatggacaacttgatgataagtgtctataaggtgagagttgggtaggaggtcacggtgagggtcgaggaaggacgggcaatacatttaatagtcacgtgccgaatgcttggtagggtaacaattaaggtgaaaaaaatgtgacattaaatgtttgagacacataaatgaaaaacttgttacaattaatgatcaaatatacttcaaagattacaatgaaacattaatcacgggggatgtttcgttgcatctaaatgcaccaaatattaatagcgaaggatgctttgccacatataaatgcacaaaatgtatgttatgttcccacttattaaacacagttgaattcttttatgaaaaaatagtgaagtcgatacaactagcatcaactatccgacacaattttagtttgaattccaaatctgatccacacattaagaaaaaaataaatccagtttatgagtagtaatgtggttgtaggaaatgatatgttgtggattgccaagggtggaataggggaggggggttgttgtcaaaaaggaaatcaattgcattaaaaaacaacgatttttatggtgatgagataatgattattaaagacttatatttatagataaaatgtaacaaaagttctaagcatgctatattccatattctcatatcattttaaggtgatggaagtaagtt

SEQ ID NO: 32414 - DNA, 962 bp, Oryza sativa
aatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatcagatgcaaaataagaacaatataatggtgtgtgccaaattcacttgagtttctagtttcaaaaaatcaattcgtccttacaaagcaaaccaaacctctgactgcacaggatctacagagcaacagatcacagctccaaagtatattgacctgcctgcaaccttgtggctccacgcattcagctcttttggtgtaactggcactcaacgtatgaaatttcagcatggaaaggaactgaaaggttcatttttctttcgaagaacaaataaaaaatgtaatgtcaatcaccaaagaaaattgtgtagaaagtgaaagagtatagcaattagcccacttagcagtttgtactgatttcaagttctactggagcaaattgcagtgtccctaagcagagcatgatgggtgtaggaatcttggtagatatttgcataggccatatcattaatctccgacctctaaccattatgtgttcaattcatggaaagaggattttgtgccatagctcaccacaacacgtttcagatccaatttatagtatttatatat

SEQ ID NO: 32415 - DNA, 439 bp, Oryza sativa
tccagcttttctactccatctagggtttgtttgcttgttgctgcgtgtgatgtgaggtttgaggggttttgccgcgggatcgggggagcaatccgtggggttaagcggatgggggaagggggggggggggagcaatccgttgcagatgatgtggtagtttccatcgggtgttgtctctgctctgctgttcgcgtcattccacagagtagaggagattcggcgccgggattgcgattttggttcgccattggcggcgtcgttgattctcgtcgtgtcagctctggtacgttgggttgttggttgcctgcctccccacgcccgcgacctgctcggtggtttggctgatcggtgatcagcaccgtcttggcagtttggcatacgccgcagccacaattgcatcgtctcttgtctgtgtgggggggggggggggggagcattt

SEQ ID NO: 32416 - DNA, 703 bp, Oryza sativa
aagtgtgggttgctctacttggaaagcctctagaatctcagcacaagaacttcactaacttacctcgttccctttcggaggagaggaaatccttcacaaacttacccgggacatccacaatatgcaacggattctcgcgggcgacacctaaccgtctaggagatcatctccaagagtaataagcaccgagatgacagcccacgagatattccaagtgctcacccaagatctagtcttcacacatctccaaatcttcttctctccctctcaatctctctttctcacaagaattaggctctagattgagtggagaaggccagaaacacttgggagaggctagcaatagctctaggtttgaaaaatgaaagtggaatggccaaggaacgagctggaaacgagctgtatatgtataacggctaggtgacgtcatctagccgttactcacaaatttgaactggaaactagacaggaagttccggacctggaagaccggaacttccggactacacttaggaaaatctttttcacaagaccggaacttccggacctggaagacagtaagttccggacttgcatttttggacaaatggagtatttgcaaaaatgactcctagggaaacttgacacttggttcacactaagagcacttgatatatctcagagcatcacctggaaccccttttaatagtacggtttttcctaa

SEQ ID NO: 32417 - DNA, 710 bp, Oryza sativa
tctgaaggacgagatagcgcgcctgaagaaggagaatgctcagttaaagggtcttcccgcgccaggaggcgtccggatccgcactacgccccgcaagacgacgactgcacccgtgcgcatccagcttgcgcccaggaacccacctccatcagcagctcccgcagcacctccagttccgcccgcagctccggtagttcctgcagctccagtaccagctccagctcccgttcacgtgtcagctcccgcgtccgctctctccttcgctccagcatcagccgccaggggtccagccagtggcaacggaggttggttgtctgctactcccagtggcagccgcgatctcagcagcagtagctccagtggctcagagccgggcggcggcgagacttatctgccaggctccaggagtcgctcagagggacctggtgacgagcaggaggacgccttcgactccaccgaccgcaggagccgttccgagcattaggctcgctttccattagtttatcgactgtctagtttctgcttgttagtttgtgtgtttaggttgcttgcttggggtcagtcgacggtcgatatcatgcgcctatgatatggctgtcttaataaggatttttgcttgctttttaagtgttttaattcagatccgaacaattgcagtttaaattcctatataataaagcttagttcctgagcatctgttttccttcttt

SEQ ID NO: 32418 - DNA, 2934 bp, Oryza sativa
ttcaacgtttgaccgttcatcttatttaaaaaaaatataaaagaattaaaaagataagtcacgtataaagtattaatcatgttttatcatctaacaataatgaaaatactaattataaaaaaattcatataagacggacagtcaaacgttggcacggaaacccacggtttgtctttttttggacagagggagtaaatgttagtgttgtgtaataaaaaaattgatgaagtgaaaacattataagacttaaatgcatgtttagattcatagttacaggatactctctccattctaaattgatctacatattttataggtataccaagaccaagaaaagctaataactcttttatagtgttatattcactctagcaacaaacttcatgcatgcaccatctccactatttcctagccaatagaaaatcaagatattacatatgggttataaatacgtgtgtgtatggatacatacgttaatgtccatttactccaatgcataaataacgaatagatttaatgaatcaacacaaatacgtagatcatttaggaataatctaaaaaaaattatatatagatcaatttagaatagagagagtatatcatatcttgtacgagaggttgatttattctaggatgaagtaagtatctttaagtagcgggagggcagcgcgacggacggcgcaccggtggggcgatcctgtgttgttagctgctttcccgtttcccttcttcttcgttgccttttcttttttcttcttcaatctcgtcaaatggcttgatgtgcggtccgtgcctgtggcagaggacgccatggtcgcagacgggcttaagcgcctcgccgctggcgtggaccgatgcggttgcccacggccgcgtatattcgatgacagcggcgacagtggttcattggttttttttaattcgttgaatactatacgtggagttgcagtaagatgtagagtattatctagatggattacttataagaaaacccccctagcttcgggaaccatttatccaactaatttgtcaaacgaacacgtgaattgcgttcatatagttttaaattcatcatttattttgctcaaccactgcttacgcaagatggatctagccattgttttgatttcgagtgacacaaaacatagaccggggcactagtctgttttatagtcaatttaatttaaaatgaagatagtatatattgaccgttccgtcgtcaaatcaaattgtgaactgcaattataatatatggccgtctcttgcagtcttcaaaacaaaagttaattcaaatgtaacttgtaagaaagagacggagccatttagcaaacaaactccaagagtccacaactgcccgctcctcgagcggtgaactttttctctttttttaaaaaaagaagaagaggaatgctacagtagacccagccatttttcaattctaaacgacaaaagactgtttattaactagtactactagtctatttttagtgattttaagttagaagttaagagtgttactgagagcaagtttaatagtatagtcaactactaacttcaaatcatctatagtcaatgtaatagctaattcatacaatagttgattactatactattaatacctcgtcatactatcatacacacattacgtcttgtagtccgtgctacaactgactacagatctgtagcccgatgcttttttttctcttcttttatctctttaaaatatatttatagctggcttatagcctggcatctgctctaacgtgtgcaagttggatttcaaactttcttggcgtcaaattaattcaaattatgcgaagtggggattgcatcctagctcagcttgtattgattaagaaccttgcgttgaagtttggttcctgttcaccaagttgatatccgacccgttcgaggtatcgacacgaatgctcatacttttcttgaagttaaattacaccttaaagcaagtacaataatagactataagtcagctataaacttatatggagaagacaagagaggagaaagaaaaaaaacgggttacaaatttgtagccagctgcagcacgaactctgaaacgttacgtgtgtatgacatgtgggaccaattattaatgatgtagtatatatttgtagttaactattgtatgaattggctattagattgattatagataacttgaagctaatagttgttgtctatagtattagagcctatttggaggagcttaagattataaaaagcagctagttggaagccagcttctgagaaactggaaaagctgggtttctgagcttctggcttctagttcattttctggattatataactatatcttctcataatttggatcaaaagctggactgtttggggagcttctgattctatgagaagctgcagcagttagaagctcatcaaatagaccattaaacttgctcttatggttgtgtttgatacaggaattcccaactcccctctcgttttccgcgcgcacgcttttcaaactactaaacggtgtattttttgtaaaaagtttatatacaaaagttgcttaaaaaatcatattgatccatttttggaaaaaaaaactaatacttaattaatcacgcgttaatggaccgctccgtttttcatgcgtgggtgatgggttcccaacacccaccaccgaacacagcctatatttgcaaaaataagtatgggtagaaatcagattttgtacaacttactaaatagttatgctttgttacggataaatataaattgcccacatgatagtattgtttagaatatacttcgtctattccatattgatccccatataaatttttatcaaaaccaagcaaattttaactaccatatcggggtaatcggggtaattaaaagcaagggcgaagtgctcgcacgagagaatttgggacggcgtggacgcacgcg

SEQ ID NO: 32419 - DNA, 724 bp, Oryza sativa
ccctccccctgcccaatctctccatctctcttcccagttaagcagggagagtggtcatgatgcagaacgagggcgagagggtcgatctgctggccctgccactcgatccggtgggtagacgccggcctccccctcctgcgcttctcctcgccgccgacgccctcccttcccccaacacacacacacaccataataatactactcctctctcttcccagttcaagtaggggtggtggtgatggagatcaaccagggctgctggtgatggagaacgacaacgaggtgatcgatctgctggcctatcgctagatccggtgggtacatgcactcaagctcgccatgaaggtctggatcagtgatgttgcattgccatgggctattgttgtgttgaattctccgttggttagtagttctttgtctctgtaattcatatttgattccttttgctttgtgctctcttcagccgatgcaatccttctccatctccacagtgggttggcgcccttctgctcaagtttgaagctccgctgccgtgcggcgccgacactgtttcgcaattgcagatctggccagcaacaggtaatctgggaaccatctgtcgtcgcctagccaagggccatttgcaattgccttgccattgttatttatggtgtaattacttaggggcaatggatgtatgcaacttcatcattaattgagaatccatatgtataggtattttggg

SEQ ID NO: 32420 - DNA, 1470 bp, Oryza sativa
aagtttttgtcccaagctccaccaaaatcaaagagcgcaagctctcaacatatcttacaggatttgattgactcgctcggtctgaccatcagtttgcgggtgataggccgggctaaaatttaaacgggtccccaattctttctgcagcttctgccagaattttgaggtgaaatgactccctcgatcagatacaatctttgtgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctac

SEQ ID NO: 32421 - DNA, 1152 bp, Oryza sativa
attaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtg

SEQ ID NO: 32422 - DNA, 662 bp, Oryza sativa
ggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttggaaatcaaatcgcctccattttcttgaagcataaacttggatttgtctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggc

SEQ ID NO: 32423 - DNA, 889 bp, Oryza sativa
ggcgatcagtgaccacctgcatatacaccatatagatatatgttattatacacacatcgatcgatcagtgatcagtaatatgcttgtcgattcatccatcgccatgttgtcatgatcggatcatgattctatctcttatatagctaatacaatatttatcttctttgcaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggtaacactcagtcagtcaccgtcgacctctgaccatgatcgccgccgccatgcacgccatggccggagtagcatgattttgtacgacgttgtatatacctgcggccttggggagcgacctccagcatccctcgccgttggccttgatgtaggcgatgagccgctggtcctcctccttcgtccaggctcccttgttcgtgtgcgccttctcgcagcatggggacctccccatgctagctaggctacctagctcgctacacccagatcagtccctctctctctatatatatacacacacagatcgagggaaagctctcttgttgatgaagagaagaagcacaggagcgagggagggaggaggaagatggagatgagcgggggctggttgcaggtgatgctttgtgggagctttttcgtgagcaaggagagagaggagggtggtggttggttggttttatacgagggagagggagaggaggggagggccccattgacccggatccctctgggccatttgaccgagttggtgcgatgagacgagaggaggagcggaggttg

SEQ ID NO: 32424 - DNA, 471 bp, Oryza sativa
tctattcccaactttccatcacatcattttacatcaaaaactttcctacacacataaacttccaactttcttcaaactttcaatttttttcagaaactaaacacaccctatatcatgaccatctttgtcaactttgagcttctccctgtggtacctgattgttgtcaaagtgtagaaagcacatcctacctagctattgcctctggtttatacagctgactgttggacaatattaaggactgggctttgttatattctaggttaaaacgtatgcatgctcccatgtatagtttcagattgctcctgaatatagctaaaacaaaagttgctcaaggaattatgcgcccatggaggaatatgcaagcgtcaaatctagcaatatggaagatccactggtggagaaaccctttgtagtcccggttcgtaacccccctttagtcccggtttccaaaccgggagtaccaatccggg

SEQ ID NO: 32425 - DNA, 1143 bp, Oryza sativa
aaatggtgctgtatccatgggaaacaatgtatcccgaggtcaaggtgcttcatggcttcatgtcccatgattttatcatgctcatattttaagtattgtagtataccgttactctaataaaaaataatattagttggttacatgcaacatatttaatgatgtgaatttactcttcgtttacataaataaacgaagatacatttattaaatgatgcccattttggaaaaacctcaataaccttaggccatgtttgacaaatgggatagagaaatgatttcccacccactaaaagacatctttaaatcctaaccattcattctccccctttcatttaatcctaacccttcattcatttcccaatcccaatcccacctctcatttcccattatccaaacacacccttagagaatgattaaaatgggatggaggaagtattttgatgttattgatcttgttaacctttactagaggatgatcaaattgggatctagggattgataataagcattcattcctagataaaaaaaactaacacttgtaatgcatgcaacgagcacggatgcaggtcctctgcagtactgcatgtgcagtactactcactgacatgtgggcccgatgtgcagtactactcactgacatgtgggcccgagggcctgtggggcccacatgttagtgagcagtactgcacatgcagtactgcagaggatctcaattggacgagcacatatgcctctacaatctatatgtgtggtgggaccattctacattcgattggaccattcaacatatctacatagcagccatttactactccaactttatacactcttagggtatccacaatatagcattttagcaggtaataagcattaaatactcacttattacccggtagtaaccattgtaggactagtaagtagttgcagcccggtaacacggctacaatcgggtaacaggaattaaactatcttatttgcacggtgtttctgataaaatgcatggaaataagtcacggctagagattgccatcggtgattttttctgaagctggccctaccttgtttcctactgatatgctgatacattgtggagtgcatgattgcttactactacttgtagacctggcccatactactgacaca

SEQ ID NO: 32426 - DNA, 256 bp, Oryza sativa
agaaggaccgcgatgacgggtccaccgggtccaccacccgcactgccgtcggtgatggcttgctcaccttgtcgtggaagtagaagtgcaggtgagtcgtcggtgaggatgctgacccgcggcgggccaagcccggcctggtttcttctgggcgggccgccctcgcaaccgccgcaagtgtgaccacaagggtgatcaccaccactcccttggcctccattgttgagctcaatgtgagcaaccaagctagcttctt

SEQ ID NO: 32427 - DNA, 699 bp, Oryza sativa
ctgatagccagcttgatggtttctaagtaagttccaaagttttttccacataaattctttggtagatctattatatataaaagttagttttttctacggtgttgatagaattatttttttaagagttgtttctttctttgttggtgcctacttatttgtcacgttttatagtcttctataaagacataggaagttttatctatcgcgttgtcgatgatccaatcggctcgttgactttagagtctaggtcaccaatttattcgatgacactggtttatatactttttggatatgccggaatcatatctctcgcaacgttccaagatttggagtttctttgttctatttttggctcttaaatgtctccttctaccaaatggttagaataatctcttttatttaaatccaatttgccctgtttcaggaggggaaaaagcagagaaagtgacgatgaaatttattattcggcagcgcttgtaatattattgcaactggcaggtcagcttctataatgatgtccctatgatatgcaatatgaatttatgatagacttcacatggttggtatatcattgtgaattccctagcaaacaacaacataatacacttaggtcgtcgtactaggcataattaaaccaagaactcatcaatattggttggagataattaagagagcgaggcccccacttactatatatgc

SEQ ID NO: 32428 - DNA, 2244 bp, Oryza sativa
  unsure (1)..(2244): unsure at all n locations
cctgcagcccntataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaacccttcgttggacagaagagggcacgcgggcaacgaggtgcagcgaagaagcttgagggtcggcacatcataacggaa

SEQ ID NO: 32429 - DNA, 587 bp, Oryza sativa
ccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccgtccttagcttctgagctagcagcg

SEQ ID NO: 32430 - DNA, 307 bp, Oryza sativa
gcagcaagcccgagaacaagcccggccagtaccagatcgccgtgcgcaccgcgggcgagaagacccaggtcaccgtgctggacgccaagggccaacccgaaaccacccaggcggcgcagcgcatcgtgcgcgtgattggcgacgacctgaagtaagcaccaccgccgctggccccctggtcagcgccaccgacgccagtcctgcgactggcgtttttttatgcgctgctcacacgcgcatcaagccttacaaggcgtaaaaaaacccgctgcgcacatgcgcagcgggtttttcattcacgccccag

SEQ ID NO: 32431 - DNA, 709 bp, Oryza sativa
attcctgcagccctgacaaatcaccatctatttcctatatgcaggtcctaactaatcaaaagaatcgcacctgcctctaacactagcacacattcttccatccccgtggctttaacatcgccttgtcacctactcgtccctgctgctcatcatcggtcttctaccaccttggctatcgctctaaagttatcctattatcccctacctcccacctggccaccacctctaagcctgaaacactaatccaaaggaagtttgtttgagttaatcgtcaccggtgggaccatcaaccctctccctctcctttcttcctatctcccccgtctaggtgttataacgatgcccttgttattaaattgtgatccaatgactagggcgaggtgtaacaaccctagtttgttggtagcccttgtagggatttgttcggttaatccatttcaagggggattgaaaggccctcattgagaagtgattaaccaaataaactatagtaatagtgtggtttaggtccttatggcccaaaagtggttggcgggtgaggatgagtttataaacctttatgctcccgcaatggtacctttagattaacccttttacatcatatacgacaggaggacgggaatataaatagggtactactgatagatgggcatgtttgacgtgtaaaatgaactaatgcagatcttaaagacatgatattagagtagct

SEQ ID NO: 32432 - DNA, 7952 bp, Oryza sativa
  unsure (1)..(7952): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaaaaaaacccaataacattatatttgaaaatttgtaatacccaaggatccaacggcccatgtagccatgcatgcatgtttctttgcaaaagcagcccatagtagccgaagcccaataactgaccggctgaacgccacagttgatgtgtgtcctcagaaaagccgatcgaccagctcatccagttcatgatcagcaccgggttcacgattccgacgaaaaccggtcaaattccgtgaaatttcgacgtttcgatatggctcggaattaagtttcgattggaatttcgaaggttaaacagtagatttggtcgaaatttatcaaaaactgtgacaccgatagggctcgaaatttagtggtcaaccggtaatgtaaaccttgatcagcacttaaatgatcgatgttggagaattaaaaccgtagtgtatctgtttgatcaaatttcaacttatattgttgacaataagatttaaagttctatactggtttgttttggtaagtttaccgtgctggaacatgaaacctcatttagtttcttcggaattcaacggcagtagagtaggagacatggtttgtgtgaggtacttattaatttagtggtattatatagagccaaagattgattatgcttcatcatcatatggtaagacaacaagtaagaacttacaaattgattacacaaccacacattcatatacagccaaaggcaaggcctttattccatatattagttgcagcacacaaaacatctaatttatcatgtgtagtaccagcacacaaaactttaattcagtactttaattcagatgagggttttatgggtgcccaccaccagacccgcttcctgagccgcctccgtagccactaccacctggaccgctcccaccacctccgccgccgccaccaccaccgccgccgctagcataaggtccataatatggcccaccagcttgaccatatccaccgccagcaccataaccatacccgccgcctccaccaccaccgccaccgccgccaccaccaccgctagcataaggtccataataaggcccaccagcttgaccatatccaccgccagcaccataaccatacccaccgcctccaccaccaccgccgccaccaccaccgccgccgccgccgccactagcataaggtccatagtaaggtccgtagtaaggtccatagtaaggtccatatggtccataataaccacctccaccacctccaccgccaccgccaccaccgcctccaccgccgccgcctccgcccccaccacctccagcatagtaaggtccataataaggcacatatcctcctgtttggccaccaccacctcccccaccaccaccgccaccgccgccggcggcgtatctagctaccacccccatcctcgcattggatactccaatacttagtagcacgaagaaggtaatagccagaagcttgtttccagccattttgagcttattccggttgaaggatgagatatggatgccaaagcaagactgcacggttatttatagtgcaggcagggagaccatgcaattatatattgcaaaatgacacttgtatatgtaaatatatgtactagtgtgacgagatgcagcagtattgcccttcgcgaacgagtaatacaaaatggagtggttttaaacacattatgacttttgctggataaatccctgctagtgaacctttaaattttctgacttggcctgactgttacgtttggattatatatgtgagtttaatatttgataatgatgctgcataaggccaggtcaagtatcaataccacgtactcgagctcaggcatttgaccatgcatccatcgcaaaaaagcagcagatacagccagactgatgacaaaaaacatttgccactagcagtaacgcagatgacatttgttcttattacctatatataaaaatctatgaggcattgacattgtgctgcttaattacaaccaaattgtacatatgctcattcgtacactggctttgtctaatccgtgtaactagtgctttcagcgcacactgtaccactctgaacaccctgaacaaaataactgaacggttttgcagactgcagtgtgttgtttcacaaatcaacgctgctatacgtacgatctgggtgtttacgatattcgtactatgaaacgcttatgcgtttattaatggtgtgccgtacgtccgtcttattcacgttagatcattgataagtacgcatagcatttttcctttcgcaaatctcacaaaacatgtagcatgcgtgccatgccgtacgttacttgactgaaacatataaaagcatgcctgatttctaaagcccatcgatgatagcagattgatgatccggactgcaatatacaaattaatcatgattggcttccaagtgaactaagtgtgtgttcgtttgaatcactactaaaaaaccaaccggcttatagatgccgattcatttaaaactgatacttataagtcttttcccacctccgatatctttaattaagaaatataggtgccggtttattagttaaaactgatacggttagttaaaaaactaacacctataatataataacctataatatattataggtatcagttctgtaaaaaaaccagcacctattctaaatcaagccgatctaggcgagacgagccgatcgacctggcctatctacgcgcgttgctcgatccttatccttatcccctcccccccccccgggctcttctgtgcgctctccccctcgccccttcctccgccacgccctcccctccccctcccctatggcccccctcccccctctcctcctcctccgatccgccatactcccctcccgccccctcctaactggcgagcagtgtcgcctgcgatgggcggcctccccaccggcggcgacctcagcgtggggagggatgtatgggtgcggcgacctcggcatggacagggacctagcggctggcgacgatctcgtgcggagagggacccggtggctagcggccacctcatgtggagagggacctcggcggcgacctcgtgcggagagggacctcggcggtgacctcacatggagagggaccccggcggtgaccttggtggattgacgagtgagtttgtgcatcttgcttgtgttcttcatctgtgatgggaactattgttgtttgttgttgatgatttgtgatggagattgttgatgttcatatctgtgattggtgatggattgaattagggattgcttgaatggagattattattgttcatctgcttgatttgtgatatgtgaaagcatgcttgaatggggattattgatgcgcatcggctcggcttggagccagcttcttttttttttttaatccggaagagcacaaaggtgacggttctatgactggcaccaataacactaggtcattggtgctgaccaattggtgtcggctaggaaaccggcacctattacccgttcccaaccggcacctataggggaatatgtgcttcgatgcaaagcactacacacgagtacacggtacatggctatgttctttcccgatctttcctaactcaccttcttcgttttttgcgcgcatgcttcccaaagtactaaacggtgcgtattttgaaaaaaaattctatagaaaagttattttaaaaattaaattaatctatttttaaaatttatttcagctaatatttaataaatcatgcactaaccgccactctgttttgcgtgttgggagctagggttgtcaaccctcactcacttccgaactcagccatacagggcagttgctctgctcagaacagaacagcatgtccagcaaccaggcttcttcatcaaagaatcaaccaggcaaggcacctgcaaaatctgcaatcactttcagctttttacagagctgctgctgttgaaacttcgttcttgttagttaacttctctgaaaatcctgaaacttggtactcacatagacttaaatctgaatctgtgtacgtttacgcggtacatgacgggatgcgttttaagcattctcataattataaatttataacatgcagagaggcctattatgttttattatacatgtaaattggtttttgatgatgaaagtgaagtgaactgaaccggtgtcaggatacgcgttgacgttgtactactcgtacgttcgtagcgtgtggctgcatatgcaattgcatttatagtatgctatattacacgttgacacgcctatacccacgcggacttgtattccgtcaacgggacattctctcgatcgataaagctccacattaaactctatccattttttaatatatgatgccgttaattttttttgatacgtttgattattcgttttatttaaaagaattatctaattattatttattttattgcgatttgattcatcgtcaaatattcattaaacatgacttaatatttttatatctgtaaaaaagttttgaatatgacaaatagtcaaacatttgtcgaaaaatcaacgacactgtatattaaaaaatagaggtaatatgatgtcagttgccaaagatcgatgttctaattgttgtctttagtattatccataaaaggtagctgtctcaagtgttgaacatactcatttacttagtcctacataaatcgtgcacatgttgacttcgtaaaataatacacacggctgtgttagatagtgcagaaatgctgagctagttagttgcacgggaaccaaaacagattgttaacgtatgattaattaagcatgaacttaaaagaaataaatactaactattatttacttgcaaaataaataaatttatttttgaaacagcttctatataaaaagtttttcacaaaacacaccatttaatagatcggccgggaaacatgcttatgataaatgaggaagtagcccactcaataaacggttaaaaacacaatctaattaagcaagaacagtatgaatgttattttttctttttttcttccttcattagtataacatattttgaaacagaaactgtatgctttaatttcacaatattaattagcccaagcctatggattgctcaaaatcaaggggtacaccaaacagataaagacaataagaaagactaaacatatcttgacacgatttctacgtatatgtaagcatgctttgctttcgtcaaaatgtcacgccccgaactagtcccgaccggaactagcccgtgacgctccaaattaacctgttaatcgataccagtcctaggaaacagtgctggtatcacaggaagacagaatatcacagcaacagaggtctctttaatatagagaaggagtacagtcatattgggctgcagacagatcccgagctcacaactgcattacaaaaggaaagcggaagccaagagttggaccaaacaacacaggcgcgacttgggaactaggccgaaaccctaaaactcaacgtagccggcttgctcctggaagaactcctcgtcagcgggatccgcttcatcttcttcagcaactgggggggagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaagcatcgatcccctttccacaacagcaatttcacaagcagtagtcaaacaaaactacgctaggaatcacctcacatccgcgcatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggagtcctctctgacaccaccccggcgaatccacatgtctcttggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagatgtttttttttcagattttaagtttgaaggcggccgtcgatactcgtgcagagtgcacgatttccgaggcgcaactgggtggttacaagggaacatggtataacaattaacaaatgaaggatcaaatgcaacaaattaggtaggtccgtcaatctgccttgcagacgggacaagcagattaagtgcgatcctatcaatgcataataatctttcaagcaatataattaagttcaaatataggctcaagatattcaaaggtggcttgccttgctcgagatctggagcttgatcctcgaaatcctcgcactgcgggtcttcgggctccgaaactacacgcaaaacgggacaactcaacaaacggcgaaaataaagcctattaatgacctctaagcgtgccattagatagatctcaagatttgaggaattttggaagttgaacggagtcaaacggacttacggttggaaagatattgaatttctaagattattggatttttggtctaaaggaaaaggatttacttaattcctttttttgaaaaagaaaagaaaagaaaagaaggagggggaaaattagacttccctcgggaggctagggcgcggcccgagagaaaaggggcggctcggccgagctaaatgggccggtcggcccaacaaggcggcccagagcgcgcgcgcgggcggggaggagagagggagccggtggaccgggctcacctcgcgtggtcccgagtgggacccgcttgtcggtgacacggttcaccgagcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagcggggccgtggggagcggctaaccggggtcggctcgacccggtcttggccgagctggcgccgacgtggcgcctacgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcacaagcactacacttctgaaaagggggaataatcgcaatgctgagta

SEQ ID NO: 32433 - DNA, 6029 bp, Oryza sativa
caccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacacaagctggtcgatttattacccaaggttgacaaagaacagatatcaagtaaacatggcacaagcgagcagataggtaaaccctgatcccgtgtaattagcaaaacatgcatatttatttgcaaacagtaaaacatttgtaaattaggatcaaaatgctcaaggggaatgtgtgacttgccttgcttcttcaaacaatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcggccggcgccgacacgcgggccccacacgtcagcgagtcaaaggggcggcgcacggtggaccaagtccacacgtggcctcggggcgtgtccaccacgtggatggcccagatcggcccgaagccgatcggacggccacgaggcggcgcggctagggcacaggcacggcatgaaaccggctcggccgagcgatagcgcgcggcggcgtgcggccagacgaccgccggcgacagcggcgcgtcgcggcagcgggcacggggagcggcggaggaggaaaaagggagaagggacggtggggattcttaccgaggacggcgacggcgagacgaccacagggaggcggctggcggcggaaagggatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgaaaggcggctgtggctcggtgcacggtgggaatggtgctgcgggggtggaaggggaggacggagtggatgccggggtgtggcacgacgcggcgaagctgttggaggcaaaagcacggccgggcgaggcggcgctcgccggcggggagcggatggaggcggctaaaggcgaaggtggctcggggtggcggtggaagcggcgttgcggcggtggattggcgaagaggagcggtggacggggtgcgcacggcgactgtggtgccggggagggcgacggcgcagtgcggggttggcgagaatggcggctaggggcggccggagctcgccggagagcggcgacggctcgattttgcgtggggagggcgggggagagtgcggggagtacgggaaaattggggaaaagggggagggtggcacggggatcatttttataggctcggggaggagaaatcgtggccggacgggcggcaacggccggcggagtggggaggtgaagtggagctcgtggggaggtcaaaccggcgccgtttcttgcggggtgagtgggggagatggtggaggaaggggatgacgtggggtggaccgcgcccacacgcgcgcgggaaccggaagacgcgcggggaggggcggcgacgtgggcggctcgggcggccatggcagttgccggcccgggctggaggttggggatgaccccgacaggtggggcccacctgtcggtggctcgggggaaaggagagaggaggagacggttggggggacgatgacaggtggggcctcgggtccacctgtcggcgaggggaggagggaggaggctgggggttaagtggacttggaggagggggagccgagctgggccggcccacgcggagaaaggagggaaggaggaaagggagaatgggccgagcccaaagacaaagaggggaagtttattttgttttctttttatttaaattggttaaatgatcttcgtgactttaaaactatttctcgagctccgaaaattcacggaaaaatccggagagtattttagggcacaaagaatattacaaaatattcccggccaatgatttttaagggaaaatttcaaattctcccattattccacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggagctggcgggcgatctaactgatttgcaccctgcactgttcctttctgattcaactgaacgattcctcaatggtccaaacctgctcgactgaactgaccggcattgaccattctgttcttttgctccaaacaactgaactgactggcctcattggattcgaccttggagttctggcgccccacaagactgaactctgtacgagtgatctggctggtttcagctctgcggtcctgttgctcccaaaactgaacagattggttctgcttgaactgacccagattaggactgcggatgctcctgaaacttacttatcttggactgaactgttgaggttggcaattttggtaacctgagaactcaccacgctggctatgagaggatgaaaattgaatctggcatttgtaaatcatttaccctatgtccgcttggattggtcccaactcaaaagacaagtaattccaggaaacctgcttgacccgtcttttgtctgaactgcaaccgtctgcttgacctgtctaagctaagcggttgaactggcctcatgggtgtaccttagaattcaacctgttgacttgagattgggagactccgctagtggctcgcaacggactcctttaattactaaccaaattgctacactgggttgaacattcaagtgaaatgccgacgaggtaagccaaaagtcatctctgagacctaccctccttacagtgggtagtcttactttcgcctgactgaggacctttgaactgttgttcttgaagaaaaatcgacacttctcgaatttacgaatggccctggctttgaaaatagaaaacttcaacgatcaatcaaaataaagcaatgacgatgcacttccatccaggacaagacttggaacttaacccttagttgtcgataggaaattccacataaagaaattctcatttagctcgtgatcttactaactcttgactacttccccatcagttctattgctggcatatctagcatgcttcaggcccgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgacgaacaaccttgcaagaactgaccttgtaaaccataaccactataggtagcacttgttgcctctgggattggtggtgacttagctgtgctagtctgctgaagacttggtggcgtactgtctgaggttgcaggtgcttgctcctggaaaacaaactgactttcgctctgatcctgattccggcttgcatctgagcttgtacttgttggtgaagacattgtcgttgcatttgctgctttggactctgcggttgcggtatcaacatctgacacatccatcattagatcttggctagccaggatcttaccagagcgtggtgctccgactcagctggtagtttgtcgtcttgaactgatccactgactctgactgcaacacactactgctagagttgcttccgctacattcgaccttgcatcgggctttgcatcaatacacccatcttctgatcctggataccaaatgttgatcacgagcagggattcttctagcatcgggagtaccttgtagctttcgactgatccattgatctgtgactttcatacaccgttgttgttgctcttctctctgatacagaccatctgctaccagaacggaggagaggtggaagagaggggtggctaaagataaggtactaaaccacttgcctattgatctgctgtgagtagatttttatggtttaagttgcttaagcaaacaacctagtatggtcgcatccccaccaatgatgcaaaccatacccctgcacacaagcaaacaacacacgatctagaagctaacgaaactactcttctgggacagattgggtttaggtcatctccggggaaactcttctttaatcttcgcagaacgacgactctgaactgatcttctcgctccttgcacgaagcttgaggctcgacctgacttgacttccgaacagacatgacgctggcggtttgtcctccaggtttgacaactaaaggaattggaggggcagggaggagaattttgaaaaaccgtttcgcaaagaaaagccgaagggcgaggggaggcatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatcgcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattagaatagttttactctgatcagaggtgtacaactgta

SEQ ID NO: 32434 - DNA, 30043 bp, Oryza sativa
taatttctagaaaatgtattattaattgatttttaaacccgaacgaaaatcggggcgttacaaatctacccgaacgaaaatccagtggctcggattcgccggagggagctcgacagcggcggattgcggcagcggcaaccggcggagagaaaagaggaaaacgacgacgaggtcacgaggggccgattcccggtggcgagagcatctacgcggctacgggaatccgtcccttgtgccggattaggaggaaacgcatcgagggaggccggcgacgagaggcgcttccgagcttgggcggcgacggcggcgagcacacggcgagcggcggcaacggtcggggcggcgctggctagctacgggaaggctactcgtgctactacccgagtctaaggggaggaggtggaacgaggaggatgaacggagggaggcactaccgtgcgggcgggcgcagtgacgagagccgacggcgcgaaacgtgatcgttttggcctcgggccgaggaagaggagggggagggcgcgcccggagtccccttccgcgtccttgctcgtgccggctcctccgacacgcgcaacgacgaacggggacggcgaacagagcacgggaggcggcgacaatggcgtggcggcgagagacgaaaacaagggagattggaggagggaggagcttgggtttataggggcgacaatgtcagtttgggagaggggaaccgacattggacggtcaagccggcgagctggcgcccggctagcggccaaaacgacgacaggaggtgacgccgacgagaggaggaaaaagaagaaaggaagagggaaagggggcttgcctccttgccgctttgggaaaaggaggagggagcgggggggtgatgcggcagagggaggaggagctctgcctcctctccttggaagctagcgcgtggaggggaggggccgagtcgatgacgacggcgatgacggtggggcggtttggagcggggcgacgacacgggcggcaggcgcgggcaggcgcggcagaggctgatggcggcggcgaccaggcggtcggccaccacggcacgcgcacgcggaaagcaacgggcggcgcggcggtttgagcggcgcggctcggtacgcgtgctgactcgcggggccgagcgcctgcgcggctacaggcgcggtagggcagcggggccgggcggcgcagacggcgcaggcgcggcacgggcggcgaccacgcgggcgcgcgcacgcgagcaacggcgcgcgggggccgattttggggcggggagctcgctagggatggaggcagggagagggagagcgagggggaggggtgctcggcgcggcttacgcgcacgcgcgcgcggcgcgcgcgcagagcgagggagagagggagagagagagagagaaagagagagagagagccggggagggaggggaagatgggccgagagagatttggcccatcgaacccgagggaggcaaaatagacttttgcggaggaattgatttgggaaggatttggattcgggattgaactcgacgatagatcggggatttgagatctgagaaggcacggacacttgacaacaagcaaagaaacagatttcgcaaataggatttttaagagataatttttcccgctaggcgccacgacggaacaggcgctacacaaaatcagttattttcaagccattgaaatataccaaattcactctgaagaaaacaatataaacctctctgatgcaatcccaacacttgccctacctcactctgcatgcatgtcgtaactgacatcacttttcctctcctaatgagcgatccagactggtcaagtgtgatgttgccaccgaagctcattaattagagatggagaaggcaacttttggtgtagtaatcctatagatggccaaatgggccgcccgaccaggcacggcccaggcacgatcggcttgggccgaggtcagtcggaccggcacagcctgatctacacgccgggctgggccgtgcctgcccacgggctgcacgcatggccaggcatggtccaataagtttcgggttgtgtcgggctggctcgaaggcatgacagcctattgcgcttctccatagaataagtctacttctcctccctcatctctttgggctgtgtttgttatggatggaataagtctattttgtatccctcttctctttgggtcgtgccttatatatcttatgtaagtctattttggttccccccaactatttttctttgatcgtgttgggccgggccggtccaccgtgccaaggcatcggcccaggcacggcccaactatcgggtcgggccagcacgggctcgacaccagttgtgccgtgccgtggttgggccgggcctagggcctagggccttgtggccatcttgaaggaatcctatagcatcgtgggaagattggaaattgaatgacctaccactcaaaatggatacatgtaacacaattatgcgattaacttttcatttgtgtggttatttggaattgtatctgtaacatgaagaaattggtgtttcttgttagccaacttaccctctaagaaattatgaacactctccctccaatggtgtggtggatcgcatctagcctccttgtagatctgtcggtgcccacatgcatgctggtggaacgacgatctttggcctccctcccattttcaatccgtcagtcctcaccttctccatggtgtgttggccataggtaatgttgccagctagagggaagcggtggtggacaccctccaaggctatcattgttgtcaccaccaaatccacccttgagttcaggtcaactggatccaagaccactaagcccgtggtgatcgggatctaactccaagcttgtggtggtcaaatttgaccgcctctaagcttgtgcagggctggccagaggaaagggaggtggtggcgccggaggagaggggagtagtggcacgtcagtcagattcggatcatagagaggtgagggcactcaggacgctaggtataggacatagagaggacagagaagaaagaatagaggagagagcggtgtcatgttggcttaaaattttctagtctcggcctccacctcgtcttgttcttacttaaagtgacgactatacttgctttctttgcagcaatggcctagtttcactctcagttcaatccttgaactggaaatgatattgagtaacattgtcagttcatattggtttggaaaaaaaaaccagacaaccaatagtaatactcttacatcaccgtactagtacggaacaagacatctgtgtcgggaaccttcatctgtatcggagggaggctgcgtcacggattattggacagtgatgtgaaaagttatctgtgtcaggcactcaggctacataccatcaccaatgatagtgatctatgtcgggccgacacaaaagaccattaccaataggtttgacccaacaaaggagtgaaactagagcctgtcacggatgattcatccgtgatgatcccctactacaaactgataaagatgtttgtcacctttgtcgatatggttttgagaccgtcaccgatgacttattgggatggtttctgttttagaaccaacgttttttatgcgcacccgtgacgttgcttttttttaacccgtcaccgatgagtaatttaccaaaaaaaataaatttatttttttggctagcgtcaagcctttgctagccatgcctgctgcaaaataacaaaaacacagatacatattaccattcctagtatccccaacatcccagcattcccagctggagcgcggactactagtacctcgttcaggcagcgacgaggtgaagaggaggagtgaggagaagtggtggaggcggctagtagggttttgctgcccgagctatccctcctggagtgatgcaaggttcttcgccaaaattccctcttgtccataataattgaataggttaccgatcatttaaggagaaagtgtacatatattgtatttagtagtcttaaagactactacttttattacaactatccagctatgacaactatgccatggcatattattttggtacaagacgtattatttggtacatatttattttagggccatatatgttggcacacatcattcacatagttcatttagataacagtcctatgggtgcccaccactataggcagatccagaaccgcttccagagccacttccatatccatggccacctgggccactctgccctccgccgccgccgccaccttgaccacctgcatgagcatagccaccaccgtagggcccgtatgaaccagcttggccgtaaccagatccagaaccagaaccataacctgatccaccattgtatccaccgccaccaccaccaccttgtccgccaccctgagcatatgctccaccatgaggaccgtagccaccagcctgaccatagccagagccagatccggaaccatatccagacccaccatttgccccaccacctccaccaccaccttgaccgcctccttgagcgtacgcaccaccatgggacccatatccaccagcctgaccataacctgaaccagatccagaaccatacccagatccaccgttttgtccacctccaccacctccaccgccaccacctccactagcatatgctccaccagagcctccagcttggccataccctgagccagagccagatccccacccagaaccattccctgacccaccaccacctccgcctcccccaccgcctcctccagcgctcacatacctagctacccttgtagcattggtcagtccaatgccaaggaggacgacgaagctaagagcaacaaacttgcttctagccattgttatctcacagatgtgaatctgaaggttgagatgagagtacgaagcgtgtgtctctatttatagtgctggaggccatacaaagtgagtgtaaaaaaaaagaaaaaagaaggccatacaaagttgctgtgcaaatatgcaatctgtgccatttggtcactggttttatcaaagcagagcagcgttgccgtgtgcttcgtgagtacaagtccaagaagaggttggcatcgtatgactattgggacaatcaaacgcaaccttttctttgattctgcttgactacatgtgtgtacgttgtaaggttgggcgcaggtatatatgccctatggtcagggaaagtagcctgtcgatagtcgataccatgttctatgagcccaggcatttgaccatccattgtactccagcataggacataccctacaaaaacacagtcaagtttatattttagtggtacactggttgtcgtttaggtcagatacgtagagagcattggaagttgcaaaagaaaccaaaacactgcagcaatctgcttgctttctccgtgtgcacgcagatgctgactagttgattccaacaaccaattttatcttgcgttaagagatgatcacggtgagacataagccaaactaataaactatcttctggatcgaaacactatcaatcatcaaaacacaaatacacaatcgatcaatatataggagtatatgtttgcatagaccaattcacctgcatctgtttgttcttgtctaaaacgaaaattctccaacatctgcatggctaattaactagccagaattggccagaataatcgtagatctctctttcagtgacagaatactgttccattcatttaactgaatttgacaaggcgaagagaagtataaagcgcctccgttcaatcagccacgaggccgccgtctccgcctcgccggcgccggcgccggcgccggaggggatcagagaatttggcccacaaacaaattcggcctactacctcttatcctcgatacaatccagcccatatataaatctagcccatctcttctggacgaaagaattcagcccattcagcccgcaaaagaaattgacggccgaaacgtgggtccaatcttgacggcccattgatttaactagaggcccacactgagatggatcgctaccatattgggcctcgtccatgccggcccacagtactaccttgcccattagcagacgcgggggcggagacgccgccgccggcgtcggcgacggtgacctcgtctagagccgcgccccctcccgcggcggcgccgaacgctacagcgacgggcggtggattcgccagcggcgcccacgccgttgttgacttcctcgaggttagtcttcgagtgtttctgtatttacccccaattcgtagttctgttgattgcttcgattgaactcacccatgcatcggacgattcaatttggatttgaaactcaccggtggttaggaatctggagggtgtgtgtattctccgtgccttcatggtgattcactgtattatattacctccacagaaatgttgttgaatcgtaatgtaacattgaattcccacggtaatctggcatttgtagacagggttgacagttgcattttagtagtgagacatgaacctgagcactagcttgggtagcttcggtgaaaattcttccctatgcaatctttagctgtttattgttaattgtactcgctgagatagtttttattttgtgatgttagaaatttataattgctcagacactggctctctgctgtttttcatcccaaaaaataacttggtggttagtagctagagtctgtagatattgcagggcgaactagaagctcaagataagttcagaatgcattctttccatgcccctttagttaactgataaacagtacctggtctggaattcacaatgcttagctttgttccttgctgttaaattaaccaatcatattcctgattcaaatttaggctttgagttggttgcaaaatgtggaactttctcccggccatgatgtgctgtatgtatttccaaggatgagatgacggaacgaattgcatggtgcataatgacattttggtcaatagtgttcgacaggaagcttttgaaaacgcagtgcacccatcatcatctctaaagataaaggtgagttccagcagaatgtctattgaactggtactaatctgatttcaaacaatccaggaacttccataacattggcgtctcgtcgcaaggctcatttttagttttgggtcatagggcggggcaaatataggtataaagcctgggcgagtgtctttgtccagcgctttcactaggggtacacacaactctggacttgtgcagcgcgaacatacccgaccggacgtagagccaaaattcgttttttctttgatgttcgccaaaacaacttacttttctttccgtgcgctggggtgcgagaacgagtaggaagttctggtcccacccggaagagtgcactgatagcctatctatcaatcttctacagccaatgacataagataggaaatgatcccaaatgacaaatgaataggtgtggaagttataattgtaaataaaccacgatcgaatcagttttggagaatagtgagcatatattgcagtgtgcttcaggaataaaaacaatagccggagtaggtaagggatgactcgctaaagccagcgtttttctcataaggcttgactattacgtccagggtgtttaagatttgtctgacttttttttcgctaacgcacaaaaagaattgcacgtcggtatattagaagaaaacagggttctggttacacgacgcaaatggctagaaggccattgccaggggattggaaaaaaagatttgtctgattttgcagtttgttctctagttcagggaaagtatcaaaaccatggacgtacataagcccatgcatttgaccatctctagtttagttgcaagtatatatctgtacatggatatccctttttagtgttactgaattcagggaagtgaggttttgtcaacaatatcattaagaacgctggcagctagccctagctttttgtgcaacatcacaaagctctatgacgaacattgtcgtaatatttatactacctactgtatttgatattgtcgatattgtcagtttgtgactttgcagtgtaccaagctaggaaacttaattacgtggcaaaataaactgaactacatgtctacatgtgcagtgttcttgtcagtcaccccatgcaagcgctgactctccaacatgattagaccatgcacgagtccttaatctacaaatagaggtatgattactggacaaatatggctgcatgcatgcttaagatgtaatgaaaaaaaatgaacaacatataattttactccacgcagaaggaaaaaattggaaaaccatttatccagttatgataaattaagataatatttggtaacatagagtaaggtactgcccatcaatcttaaattaaatatgtaaggtaaaaaaaaatgatctacttatattaaaagggagaaaattaaaaagcctatttaactcctataattaagcaaattatctggctcactaccagatatatatatatgtcaattttgtttctcctgtggttctttgttttgaatattaattgcgagtgatagatgatttgtaattttagtgattgattgattgtacaaagtttggagcacatcgacaatttttcgacaataaggctgaataattttcagaatattatgcttggttggggcttggttctttaaggaggatattatctcttacatgtttgtaggatgaaataatgctctctcttagcttcctcattctttcttggttacaacatttgtaaacttcaattttttttgttcctttaaaacaacattcaatgtcagtgagaatctgtttatattttaaaatgtttcattcaaaacttctaaagttgtcgtccaaaaatttttttcactccactaggacctactaacataatagtttctacaatagtataagaagcataaggcaagaggttattcattgcaccagtaacattacatagtagtttacattaccactacttttattctattatcggttaccacataacaagggcctctttgatattatttaactgcataaaatgcagttgttcactatatagaagttctatggatgcccacccccgccaccgccgccttgaccgcctgcctgagcatatcctccaccgtaaggcccgtatccaccagcttggccagaaccagatccagagccagaaccagacccgccgtattgtccaccgccaccacctccaccttgtccacctccttgagcatatgctccacctgggccataactaccagcttggccatagccagagccagaaccatgcccagacccgccatactgtccaccgccgccacctccaccttgtccacctccttgagcatatgctccacctgggccataactaccagcttggccatagccagagccagaaccatacccagaccctccattttgtccaccaccgccacctccaccttgtccacctccttgagcataagctccaccggggccatagctaccagcctgaccatatccagacccagagccggaaccatatcttgacccaccattcaccccaccaccaccgcctccaccttggccacctccttgagcgtacgctccaccatgagggccatagccaccagcctggccataaccagaaccggacccagaaccatatccagatccaccattttgaccgcctccaccaccttgacctcccccgcctccactagcatatgctccaccggaagatccgccggcctgaccatacccagagccagagccggatccccatccagaaccatcctcggaccctccaccacctccccctccactaccgccaccctcggcgctagcatatctagctacccttgcggcattggctagaccaacgctcagcagaacaacaaagctaagagataccaacttggttctggccattgctaattaagtactctatgtgtttggatgatgagatgggtgcagagtgtgagggttgcttgggtatttatagtgttggagaccatgcagagctctagcacagagtgacacattcggtctctggtttatctgaatcagtgttcttcagggaacaaaaagaagaacgagtaggcaagatatgactctcaggccagttagttaagcaaacttttttgtttcaggcatggcttgactatcactttgtgggctatgtatgttgggttgaaattgttggtagctacatggtcagggaaagtatgaaaaccacgtactctgagtccacagtttgacaatctgttaatttattactttgtcacaacatatatacctccattctttacaatataacattgttgtcttttgtacaaacataaaaaatattagttatgtttaaagaacttttaataataattcaaatcaagaaaataaatattaatcatataaattttttaaataagatgaatggttaaagtgttttaaaaggttaatgacatcgtatattgaaaaaacggagggagcacatcccaataatgtgatggaaagattcagtggtaggcaatgtacctgtcgacaacgagacgcctgtggtgacttcgtcaatctcaatgacttgccggcccagtcttcgaagatgctcgtagaggtagggtttgcgtgcgttcatagggggtaagtacgcgtgcattgcgagtgtctgcgttgtattgtgtaattctaaaaaaaaataagagaaagaaaagagcagagcacgcgtttgtgacttgagctgaaacgtgtttcttgcagaaggcctgtacttagtcctctcggtaataacaagtgacccccactgtcttcacccgtagttattaggtagatttctgccagaatagcactttgcatctaatttaacaattaaaaaaacaatgaagtggcttaaaaatataaacaatgatctcgaagaatcatggaatgggatatgtacgttcaatatgcattacttttgggctaattaatcaagtgggtttttagcatgtgcgaatctaagcttatggggaaaaaaaacgaaaaaggcaatgaacactcgatatgtgtgtgtgcttcccaatcaaaacaatggatctaattaactgcacgatggatcatgggtcgagttgcccagagactataaacggggtgtcacgattatagttacgagcaaaacagtttattatttaacgattaaataatattttatgagtaaaacatttatatacgtgtttgttagtgattttaaaaacaaataaagaagattaaaatatattttgaaaattcaaaaaaataaatttaagttttaaatttaaattttcgtttatatttataagctaaaggctaaacgaagcagctttataaggaaataattatcgaaggaaggataggcagtgccagtgggggtatgcctgttagtgctgacaaaatgaagataaccaatttgccataataaatcgtcgatcaacactttaatgactcatgtctcaaagaaatacacatcacaatacacacaaaaaacccaccacaaccgcactttggcaagctatactattatcatgcccacacagaaacatgctatttcgcacgtgtgctctcgtgtcccgtgtggccatgcgccacacgagatgtgggcttctttaaaatttgatttaataattactttgaatatcttttaaattctagcacaaatttgcactacttagttaattttttaaattaaataacaactttcaataaaaagttaattatttgatttttttcatagaattttaatttgctctaaagagaaaaagaatcgatgctggattaaaagttcttaattttcagttgatttttttttcatactgggtatacgttgttatgtagaacattgttctatggaaattaaagcttttatccaaaatggttctagagagagtatttctacggaaataattagtacgtttctagtgtaagtcatacccatatagtcaaaagcctaaactaaaagttcagatatgaaaatttaagggcaattgcttatttgacctcgttttaaaccctaactaccaatttgaccctacttttcgaagtttgcttgtttgacccttcttttcaaaaacgaagctcccgtctgaccctgtttccactagtccgttaaggtttgatttaaaataaaaaaagaaatgcaactaatatttataatacccagaatacccttaggagaccctatccatccacccaaccttatccacatttctctctctttctccttcctccttcctgctcgctcgacttgtggcggcggtgctagggggcggcggcggtgactgagggggtggagggagggagcggcggcggcgacggctgaggggcgcggagggagggagcggtggcggttgaggtggcaccggcgcggcagctgaggggcgcggagggagggagggagggagggagcggcggcggctgaggtggcgccggcacgggatgagggaggcggcggctgtggcgctgagggggcggagggagggagcggcggtggcggcggctgaggggcgtggagggagaagatccacgccggctgaggggcggcggcgactgaggcggcgccggcgcgggatgagggaggtggcggtggcggcgccggatccgctgaccgcagctcgagctccaccgcccggactcaccgccgccattcctcgttgtcgtcgtcaccagggccggcgccgtctcgcctttcgtcgcctctccctgtggtggatacgtggaggagaggataagaacgcgccgccgccacttgtcgtcgtcgtcgtcatcaccaaggccggcgtcggctcgccgtctcgcctttggccgcctctccctgtggtcaatccgtagagaagagagaagagaggagaggagaagagaactgacgggtgggtcccacatgtaatagggtcaaatgagtaagggcagaagagacattttgtgcttcagttaacaccgttagatgcccttaacagaatagggtcataccgtagcttcgtttttgaaaaggagggtcaaataagcaaacttcaaaaagtagggtcaaattggtagttagagttcaaaactgggtcaaataagcaattgccccaaaatttaaaatctaggtagaaagctatgcgaatagcaagttttagtgtcatatatataaaaataaaaagtattgattttgaaagggacggaggatgctaaatgcatgtgagtaggacctgatatgcgttccatgtgaactatatggcggatggcaaagctttttccattgctttgcactcatatgaagaaaggctaaaaagcaaaggaagaaaaaaaaaagggtatatagtgtgagtgtgctcacaagttgggtttcatgtagatccacaactaaaaaggggagggcaggggagagccgccaccggcctcccgctcgaacccgtccctggatctgcgcgggggagagccgagggggccaccaccgtcgcccacgcccactgtcgccgtagctatcgcccacaaccgccgccgctgccggtcgaccacacccaccatttcaaccgccatcgcctgtgcccgttgtcgggagggtggagaggggagaggagtgggctggggtaggtatacaagtgggagaaagagaggagtgaagaataaaaaataagttagaatagagagggtaatcactgctctggaaacctttttcgctaaacatatatggctgtatgctatgtggaccctgcatcgacggctgcatgtgaaaacgtattttcatatatgtccgacaagaccattcgtgtggcttaaggaagctaattactcgggttcaagtagttcgacgttgtcggcaagagagatggacctagagcacccataagacaccaatacaaatcaactatttttctgctcccctattgtttctcctatatatgtcttttagttaagctacattcaaaatttaaattttaaaactcaattcaaaagttatttttttatatttttatcgtagtttattttacttttaaatcgttaaaaccacaaagatttgttcttttaagtcaaacttatctgtccagacaaaggtcagcttaaccttatttgcacgatctttttttcatagtaacctaatgcctctccatgcatactgctgcaaagcacatgtatggagtctgatctgcagaagagcatgcaacagcaaccagagattcaaatgctctcttgactttaaagtatgacgcaacactgtcaacactactatgtattgatcaaacatctagttacaccggtgggctgtgtagaattgtggtgtacaatgaccagtacattttgttattacagtgtattcaacggaggccctttattacccattatttacgtaaataacacatctctcaaacatgcaatcagcacacatggcctgtggtgctagtttatttagattctacatgtttttatgggtgtccaccatacgcacttccagatccgcttcctgatccactaccatacccgctgccaccaggaccgctctgtccaccaccgccaccgccaccttggccaccggcctgagcatatccaccaccgtacggcccataccctccagcttgaccatacccagagccagagccatacccagatccggatccaccattttgtccaccaccgccaccttgtccgccaccccctccttgagcatatcctccaccatatggtccatacccaccagcttgtccataaccagacccagaaccggaaccgtatccggatccgccattctgtccacctccaccacctcctcctcctccgcctccactagcatatgctccaccgccacttgcctggccatacccagagccagaaccggatccccatccagatccaccgtttgacccaccgccacctccccctccaccgccgccaccgcctgcactagcatatctagccacccttccagcattggctagtccaatgctcaccaagacaacgaaggtaagagccacaagcttagccattgtgattgatctagataagtaagccaaggatggatgggatggatttcaagcgaacggctcgtcggtatttatagcactagcttagccattgtgattgatgtaaattaagctgtcaagcaagatgccactagcatgatctctagtcaattacgtagtactacataattacaaagtctacttcacaggggaaaaagagtgcagccgaattagatggactatgacttttatgcctggttatacatactttcttattagttggcctgaataaagataacgtgtgaattgatacgtataatattatatatttagatagctagagaaacataaataataataccacttactgagtccaagtaattgagcacttccaatgggcaaattaaatttaattatgggcaggatgatatatagatcacagctagctggactaagcctatagatacaatagctagtactacaatatatcataaaatgagtcgctgtcacatgttaataattaagttatatatgctacacgtacatacctttcatgtgtggtaatgtgtggctgtgtagtgtatgcatgcaagatgcatagctgtatgcactaaatataatttcttgcatgtatgacatctgattaattagtcttttccgtgttgtgcttatccaccctttgattttcgtagggcatattataattcaacaaggtgaacaatgtagtgctcaaggcccgaccattattttctagaatatacatttaatagtatagtgatagcaatattatgtgatagtggaatcaataccttgtatataattagtgcccgctagtaattattagaaactaaaactcaagatgcaaatataccacatcatcatctactagcaattactattgtagagcatcttaaatcacatgcaagcatgacacatcatctaaaatataatatcgtagagttcaacatataaatatgtgaaatcatcttcctcacattattttcataatatttcaacattatcatttctataatatttaacatatatccatccattcattccacagcaaagcacgggatatcatatagtattaatgaattggtataatcaatatttttttattacctacatttcttttggaggttattataaactttatttaaagtactatagaaaaactgttttgttagatcattttaaatcacatgcaagcgtgatatattatctaaaatataccattatagagttcaacatataaatatgtcaaatcatcttcctcacatcatttcacaatatttcaacatcatcatttctgtagtatttaacatattcatccattcattccgcaataaagcatgggtatcacctagtattaatcaactggtataataaatcattttttgttactacattttttttaggttattataaactttatctaaagtattaaagaaaacgtgttttgttaaaatttttaaggctcaaatttactactcaatatctccctcatcctaaaacgaatctggacagattacgtgtctagagtttggcttgatacttatgcttctagagtttctagagttggagaccatgcaaagctgaagtgaagagtgaaattttccgttcactggtttattacgagaaccactgttcagctaggaaggtatatgactcttatttaggccagtttgcaggaaaaccttttgtttctgataaggcttcgcctaatacgtgtggttgttggcttaatttgttgacttgatactttcttcagcaagaattaatgttcagtcgatactgtagctaactaatcagggaaagtactacgaaaacaacgtactctgagtgtcgcttgctagctagtactagcagtaggaatacatatatacttagaaaaatgatgctgctgattcgtatgatgttgaccatgtgatgtattatacgtatagctttgaccaccgtacctactgcgacgcgagcttttggtcaggtaaaaagctcaacattaatatctaaaaaaaaaaggtaaaaagctcaatggatcgacctgcatgtggcgcaagatcgactgttttttctttactctttgaaagaggaagctgcaataatatactccctccgtccaaatatttgacgctattgacttttttaaacatgtttgaccgttcgtcttattaaaaacttttgtgaaatatgttaaattatatgtatatataaaagtatatttaacaatgaatcaaatgatagaaaaagaattaataattacttcaaatttttgaataagacgaatggtcaaacatatttgaaaaagtcaacgacgtcaaatatttatggacggagggagtatataatatcgtttctattaaataatcattgctcatgtctagtggatcatgctgccaaatttacggcctctcacaaggatatataaatcattcatccagcagtggcatatcgatgctactgatcaccgtgatccctactcttattcagaataggtagaattaccaccgaaattccaaaccagctcatgcatccctgacatatgtgaccaaatacacgtacttttctgcgtacttggtactccctccgtcccaaattataggatacactttttttaaaaaaaactaaaacgtggtaacttttgactaataatcatactaaccatatatatttatgctaagtattatgcatgttactctctccattccaaattgatctacatatagttttttcgaggttattcctaaataatctacatatttgtgttcattcattaggtctattcgttatttatgcattagagtaaatggacattgatgcatccatgcacacaagcatttataacccacatgcaatatcttgatttactattggctacaaaatagtagggatggtgcatgcattaagtttgttgctagagtaaatatagtataagagagttattagtttttcttggtcttggtgtacccatgaaatatatagataatttggaatggagggagtatatcactatattcatattttaaagtaattttatgtgatgctaattttatatttgttaggaacataatatggtataaattaatggttaaagtatatcattaaagaccgtgtatataaatataggtcttataatttgagacggagggagtatatatatggcatgaactaagaagtcagcgttgctgccggtgtggttataccatctgcttccttcctcttgcgacccacttaacgtagcttgaagacaactcctttaggcctttactatatatatatatatatatatatataagaatcactcagagccaatcttaaaaaaaatcattatttttttcatgacaatttagatgaacacaaacttcatatatataaaagttatagctcttgacaggttgaaaacctttttgatttagagttattatatgctctaatattcattaaaactgacaatgaatatcaaaagacaatccataattttttttttcatatacatgaatttggacaaactttttatatataagtttgtagacaattacgaaacctagttaataactttttatttcaagtgatttatctacccaaaaatgtgttaaagttttagcaaggaagggccaaattaatgaaacaaatatgataacatggtatgttgagttataccggagatggtaaactggcgatgcatgaagggagctgtgttggtttcgagtcccatactcccatatactacatactactagaaaaagggtttttcatcgtgacacactatttttttactgacggccagactctaaattcacttgcacgaatacaatgaggggtggggggaaccgcgagcaaagattgatgggcatatgacttgtgacatgtcctatatatacacgagatataatatatttcttttttagtttggcatattaaaaatcaaatcctggaaactaattatcactactggttctagccatgattggtagcaatactactggtttttattatatgaaacccactgacagtttaagacgatcgatcatgcatgattcgcaattatgcaccggccgtagtgtgattaggctttctctactactagtgaaatattctctagatcatatatataggatacaatacactcattgatcgaacatttcaattacactgatgagcttacatctgtagtggtatacaagaccactttcattattacatccaagtgaagccctttatttggttattattcacgcaaactaataacaacacctctcaaaccaggcagcacatagtgtcagtactgctaggttatttaggtgaagcacttctatggatgtccaccgtaggcacttcccgaaccacttcctgagccactaccatatccgctgccgcctggaccactctgtccaccaccgccgccgccaccttggccaccagcctgagcatatccaccgccatacggtccataccctccggcttgaccgtaccctgaaccagagccggaaccatatccagatccaccattttgtccaccaccgccaccctggccaccacctcctccctgagcatacccaccaccatatggtccagacccaccagcttgcccatacccagacccagaaccggaaccatatccggaaccaccattctctccaccgcctccaccgcctccttctccacctccactagcatatgatccatcaccgcccgcctggccatatcctgagccagagccagatccccagccggaaccaccgtccgacccaccacctcctccctcgccgctaccgccacccccagcactagcatatctagctaccctgctagcattggctagtccaacgcttaggaggacaacgaagctaagagccacaagcttacccattgtgattgatctagcgagaagctagtgaaggatgagatgaattcgaagtgatggggctcgtcagtatttatagcaccggaaggcatgcaaagctagctgtgtcttgcagttaagatgccacttgatctctgatcaattacaagatgatgactggctgactgctaagtctagtttggcaggaaaaagattacagcggaattagatggattatgactttcgatggctatcaggtatgctgttttcttctctcttttgagtaggccaggatataatttggctaactctaggtcatgcagagaaacatgcatataccgtgtactcttaatccaggtatgtgagcatccaagaggcaaaatttagcagcacatattggattgtagctattgcaacacaccaggcatcctcaagtccacaatggctagtactactacattattgtcataaagtgagtcacccatttccacatattaattaattaataagttgatgagaggtattgtgatatatatatagggacaatgtttgcatttatatatacatgcaggatgcatatataagttaactgaatgtataacctcatttcgtctaattaatgacgtctaaccaataacaagatatgccggcccagtcttccggaggtgctcataggagtagggtgtgcgtgtgtgcgttcataggggtgagtgtgcgcacgttgtgagcgcctgcgtttatactgtgtttctcaaaaaatatatatatatattcttgcatattaatgcacccgatatgtatgttggtcatattataatttcaagtatcttaggtactcctatattgatctcagataaaaaaaagtatgtatttaaaaccaattaatagtgaccgaaagcgtattggaatgcaaatatattggtcatcatatctatatataatttgataaactatatattgagcagaataaactgaactagctagtgtctgtaaactactacaaatacgacctaaaaaacagcggatcgagaataagcatatgtgttcgtcaaattaattgaatgcgaagtgtcgagttggctcatgatcgaacttctagtacgtgtagccgcgtagtgtaggagaccatacaaagctaggtgtagagcgaagtgacattttgggtcacttgtttaatttagttaatttatccaaacaatcagtgttctcattgagaaaatatcaggtcggcaaggcacgactgttaggccagttaggacaactttttttcccttttatgattaggctttgcctaatacgcctcccatgcatggtcagggaaagtatacatatagtagtatatatgaaaaccacgcgtactctaagtgaggaaatgctagctggtgccaaactgcatatgcatgccaaccttggatgacatggatcaagtggcgccgcaggcatgcactccctccgtccaaaaattaatactacctctgtttcatattataagtcgttttaatttttcttcctagtaaaacattttcaagtttgaaccaatttataaaatacctagcaacatctataacacaaaataattttcattaagtctaacattgaatatattttgatgatacatttattttgtattgaaaatactactaacttttttataaacttggtcatacttaaaaatatttgacttaaaaaaaagtcaaagtgacttataatatataaaaaggagggagtattaacttctagctacaaattaaaaaaataaattgttttctgttttaatatcagcaaggacaatgtaaataaatatcaatgcattaatttttggtaataaattgtccgggtgcttcggacacttcaaacagtttgtgtctcgcccacagcctaactaccagcctgtagaatagaaaacatgtggtagtagatcaaaatacgccttattatttcaaatagccggatttactcgtgcttctataacaagctatacagacaattaaaatctctctttcccacccgtatctctctcttccttcccaccatccctctctcccttcctttcctacctttgctcctaccttttgactctctagtgaggcatcactgtaacaagcttaggtgtcatctttacctcggattgggatcctctaacttaagctcactttgagacactgacatgtggcccctctttactatagacccagatgtcaatgaccccaaaagtcacctgacttaagtcagaggatctcattcccttcacctaggaggtgcagatttacaccagccaaaacaaggaattaatactaatcaatgaaccaaacactagcaaaatagttaatttctaaaaggcatgttttggcttcaaaccgaaatggtcctcagtgtggttcgatcgtgaattatcatgcatttggaataacatattgatcaaacattcaattacaccaagagcttacaaccgcattgtggtgcacaacaccactctaattattacattcagtgaagccctttatttcttattatccaagtaaaaataacagtaatatatctgtccaacccagctttcaatatagaagctctgctaatgttggtggaacactactatgggtgtccaccataagcacttccagaaccacttccagaaccgctgccatacccgctaccacctggaccactttgtccaccaccaccgccaccaccttggccaccagcttgagcataaccaccaccatatggcccatatcccccggcttgaccatatccagatccagagccagaaccatatccagatccaccattctgcccgccgccgccaccttggccaccaccccctccttgagcatatcctccaccataaggtccatacccaccggcttgtccatacccagatccagaaccagaaccatatccggatccaccattctgcccacctccaccaccaccaccacctccgtctccactagcatacgatccatcaccacttgcctggccataccctgagccagagccagatccccagccagaaccaccgtttgacccaccaccacctcctccaccaccgccgcctcctccagcgctagcatatctagctacccttgtagcgttggctagtccaacgcttaggaggacgataaagctaagagccacgagcttagtcattgtgatggatggagccactgaagtgaaggatgagatgaatgttgagtgaagagttcgtgggtatttatagcaccagacagcatgtgtaacttgaagctgtcatgcaagacgcagcttctttagtcaattacaggataactagaaagtctacttcagagggcaagaaagagtactgcagaattaggtggaatatacgacttctgtgcatgcaaggcttgtcatgaagacatgaagactttgatcttatgagtagacttgaatataaatattacatgtaagttctaaagttcatatgtatatagtttagctatctcgatagatctaggtcatgcagagagaaagctaagcttgcataaagaacaataccgagtacccagtctaggcatgtaagggtgcagtgggcgaaattttatgggcgtatagtatgatatatatccagtgtatatattacaacacgacaaatcaacaatagctagctagcacacacatatcattatcatcattatataatgagtcaatcgtctactcagggtaatactccctccatctctaaatgtttgacgccgttgacttttccaaacatatttgaccgttcgtcttattcaaaaaatttaagtaattattaattctttttctatcatttgatttattgttaaatatacttttatatatacatatagttttacatatttcataaaagtttttgaataagacgagtggtcaaacatgtttaaaaaagtcaacggcgtcaaacatttagggaaggagggagtatatgttagatacacttgctaacacacaaagtgtatctttcatgcatatgcgtacgtagtatatatagtgtatagttcatggatgcacgcagggcgcatagctgtatcgatccactaaccttaattagctcatcttgcatgtgtaatgacgtctgttcaatatagtttgcatgcatatattattgcgtgtatatgtactacggagtatagagataagaagaagaaaagataaggtcaaaattgacggttttactccattaaaaatttgggggaaaaaacctaggcaaaattggttatatagcatcgaaagttcgcgtttttggttttatagcatcgaaagatatcggttcactttaatagcatccaaagttcaccctgatccaatttttaacacttccatcaattctcgatcgttttccgtccgccttgattgctattgatctagctatacacacgatatgatgtttctcccctcattgccatgcattttacttatacttgtgaggggtagaaacgtcatattgcgtgcgtggctgggtcaatagagatcaaggcgaacggaaaaagattgagaattgacagaagtgtcaaaaatggaaatgggataaactttaggtgctattaaagtgaacaagtatgtttttttgcagttgcagggttaattattaggccattgttggagtcttctctagcatatgtgcctaacttaaatttagtctctaactctaaaggtatgcggtagaagacacaatcgaactaatcaagggcttggctcatggtaatgatatagctatttctttttttatggcatcagcttctttaattgtccagtatgattaattgggttttgcttgtgtgccaaaagtaaaagggaaaattcaccacctggcacctggctttctcatccgaaggagtttcatatatacagctacagtgcaattgcaatttcttccctggttaaattattacccgctccattccaaaaacaaaaatataaagatgcaacaactttttttcgatgtttcataatatgcatacatgcaattaattactagcacccctatttcctctaaatttgttttttaataccctaccctctagatctctaataccatattgggtgcattatatgcatcgtatttattggagtaattcaaacaagaaggtgatactattttttcttaatctttacattagtggtggttgtgtcttatattttaggatgaagaaagagtaattagcaatataatatttcaatttaatttttgtttgtatttctgaggaattttttggccatgtctcaattctttgttcggtttaattttccacacttataaccctaaaagcatctatatccctcaactctcatgatctgatgagaattgtatttctgctttatgacgtttccaccatcgacatataataactcgatgtacatcttcatgttctagatgaaactttagtcatgtttaatttatatgagtatcaaaggttcatttaccggttaacggtcaaattttcataggaagatttcaacttctttaaagaagtatgcataaagcttcgagtatagaattcagagtgtttcacaagtttcatatcctgttgcaaaaatgttctatgaaggttttagagttttggaggactactttatacaagattatcaccatgctttagcaaaatttgattatttatttttaataatgaaagtgataattcatagccttcaaatcaattaactatggatgcgaaaccaccatttcttgaactacgaaatccatgaaagaaaggaaatgaaaacgaaaactattgaatcaaacatgcagccaggtgtgtcttaaagagtgtagaagtggccatttaattgtctgcaattgcaacaacatccaaacattcacaaagtgtatgtaacattacagcagctccacttctgttgataaacaaacacgcgagaagccctttatttagttcttattatcatccatatataacaacatacaaaactagcattctatataggcttcatccatatgtcatccaggtagtgcgtaaattctatggatatcctgcacttccagatccacttcccgagccactgccagatccgctgccccctggaccactttgtccaccacctccaccaccaccttgtcctcctgcctgagcatatccgcccccgtaaggtccgtatcctcctgcctgacctgatccagaaccagaaccagatcctgatcctgatccaccattttgtccaccaccgcttccaccaccacctcccccaccctgggcatatcctccaccataaggcccgtaactcccggcttgaccatatccagacccagaaccagacccatagccagatccaccattcgccccgccgccactacctcctccaccgccgccgccgctagcatacgctccaccagacccacctgcctgcccatatccagaaccagagccagatccccagccggaaccaccccctgacgagccacctccacctccaccgccacctccacctcccgcactagcgtattttttcggtctagcataggctactcctatgactaggaggacgaggaaggtaagtagtactaccttagagccagccattgtgaagttaaggggatatgatgactgaaagattagctttgcattggtatttatagtgctggagaccttgcaaagctgtagtgcaagaggccacttgctcagtaatatatcgaatctgcaaacctcagcgagagagaaaatagcccggttagggaatactatacatatctgttcaacttctaaacttggccttattaagctggcttctacatatgagtttgacattgtacaagtcaatccactaaacctagtgaagttagtccaggcattagacttgtgcgtaatataaaaattttgacggaaaataaacgctaaattaactagccagagttgttactaacttaattaccactgctactaggagaagcagcgcagttgattggcacaaatcatgtggcgctgagaccttaaaattagattaattgttcagctagctgccaagctatagctctcagatttgtggtcttgatcgatttcattctctattgcattgggttttctcaaatacttgcagctagctagatgatcatgatgtgtgccgacgtgctcgcgtgcatcggtgcatgcccagatccccttcaagaattcttctgcaaattttataaatggatggtataatctttattatggcatgtgtgcgtgttttccttttctttttttttctttttctggtctaggatgcatgccttcctgtgcagcagtgtgctagctagggctgtcaacgagccgagctcgagcgagctcgtcagcctaggctcgagctcgatacaagctcgagccgagctcgagccaagcctataaaatgttcgagctttccgacaggctcggctcgagctcgatcaagccgagctcgactaccgagcttgtaaaaaatatatatatatttcaaagataacctttaaaaaaattaatttctagtttatcatactaataaaagaggaaaaaagaataaaataaatatattatgtcaatataagacatacaaataacatatttgatctcctaatttattaaataacaataaaaatgatatattactaggctcgttagaagctcgagctcggctcgacaaagctcgcgagcttagggagatgctcgggctcggctcgtctggagctcgagccgagctcgaatcgagcctagaacgagccgagctcgagcagctcgcgagcctcaagcttttttgacagccctagtgctagccagtgagatatatgaccgttcttagcttacagtatatatgatcatcaaagttttggcccatcaagttaaaacaaatttcgaagacaaaatcagcccatatatgtgtctcgtactccggacggacagaaaaaactgggcccataacatatgtatccctgggcgaataagtttactttcgtccctcaatttatcgccgagtctaaaatccatcctacaccgaaataccagatagaacgggtctctcaattaacaaaatcggatcatctgatgtcctaggcaatattatgtctggttttaactgatgtggtaagctgattcttcacacatgtaagtactggccacttacatgtggggtacgcctgggtcccacgctgactcagctcgtcacgttagctcaaatcagacataaaattgtctaggatctcgggtgatccggcggttttgtaaattgagggatctgttatatctgtcgtttcagtttatggataaatttcagatttgatgacaaattgagagacctaaagtgaacttattcatatccctggtttatctatgcactgtgctatgatatgggccgaaattgtatggcggccttgaataaatgggtacgtgtatcactctactctcagcctcatctttgtccaatatgaaatctaggatattttctttttaaaattttcaaacttaattttacattttttatgatttttatttaatttcgttttcataatttatctttaagtctatgagggcatatatataaaatttttactcataaattattttttcttgcgaataaaccgttttgctcataactaatcagctcatggtcaaccggtggtgccttttatcttttatttgcctgttcgatcattttcatttcccttgtaagctagcaacgaacgaattagtaacagtcatatcagtaaaacaaaagaaaatgaaagaaaactatacttgcaatagagaccacaccaatgaacaaaacattatgcatgcttcaattcattgctcttgtagagtgtcatcacatctcatttccgcatgctgggctaccatgcatcttccattacaatgatggagcccattaattattaagaaaaactgcctaattaaaacccaagtacaaaccctagaaattaaacttcttgtcggacagcataaaatgacgagaccaattcatgcattgtctcggcctcctccggctctagggtttcccgcgacaagcgaaaacctaccggaaatttcaatggtatccgccgctaccggatccggatcccttgccgctgccgctgccgtagccgccgttctcgccgccgccgccgccgccgcccttgccgccgcccattcctgacgcgtagcctccgccggaggagccatcgctgccggcgtcgccagcgccggagccagcgcctgcgccaacgccgtagctcggagatgctgctgggcctccgccgtgcccgccgccgccgccgccgccgccaccggctgcgtcggcgtagccgccgttgtagtcgccgccgctggatggagacggcgccatcgctatcgacgagccgctctcgccggcgccctggccaactccggcgccagcgccgtacccgctgccgccgttggagccgccgccaccgccgccgccgccgccctcgccatcaccggtggcgtaattaccgccgctgctgagagcaaccggggccgacgccgacgagccggagccgccgctcgagccactgcccatgccgtagccggagccggagccggagccgtacccgccgttggtcccgccgccgccgccgccgcctccgccagcgccgccacccctcccgtagttccacgtgttgccggagtcgccgccgctctcgccgtatccggcgccggcgccggcgcccgagccggagccccacccgccgttcgtcccgccgccgccgcctcctccgccgccgcctcccccgccgccggagtacgagttcgtgtacctggccaccctcgcggcaccagcgaacccgatgctgaggaggacggcgaggcccagagccacgagcttggtggtggcagccatggcgatcgagagagagaggtggtggtgatcagcggataggtttgcgcgggtatttatagcgagcggcggatggcgggagatttaatttcctcttcatgagatcgacttggcgccatgtgcgacgatcaaattaaaggagattcgataaccattaaccatgcatggattagagcagatacaatagcaggctataagccagctataaatatattttaaaaatataaacaatagcatgctataagctagctataaacatattttaaaaagataaaggaagagagagaagagcagcgagctacagatctgtagccagctgcagcacggactccaagacataatgtgtgtatgacaggtagggccaggtattaatagtatagtaagcaattattgtatgaattggctattatattgactatatatgatttagagcttgtagttggctatactattaaacttgctcttagtagtgtagtgcatagcatctgttgattgttgagtttgttgaccaacatgactgcatcgatcaagatg

SEQ ID NO: 32435 - DNA, 1438 bp, Oryza sativa
ttaattgatgcagaagtttatataattcggtgtggagttaattagattagctagctgtgttgcttggtttcttcgaagcctagtgagctatactagattcgattcccttcatctgatgacaccgattagaaatttctcctactggaacagtgtgcctgtgcatctcaatccttaattatgcaggtaatgctaagttcacagtgacaattaagcggtgctcttgcactattaacttccctctaacttgaatatgcatagttgaggttaaacaagtgaaaaatccgtatgtattgcgtcatgctaaattacaaaattattcgtatacgtatgtaatgccagtcctgattcgagccagattatatataaacccattggccagctgcctagctcgatcaaagtgtacgtagatgttaagcgattcgtatgaatgtttcattcgtcggtgcagcaactcggtcgagttgagattatcttctgctaagtagtccatcgtggtaattaatcacaatgttgaccagcatatggattgcggatttgcacacggcgtgtagtgcatcgacctggggattcaacgcgtcgccgacggcgaagtcccggaaaattattagccacattggcagggtgagatcgatgagagggcctcatggggttttttgtttagtttttcctctgaaagtgtatacttaacgtgccttaattatggctgtgcagacaccgagggagtaatcagcgacaagtcgcagtgttcgagttgacctcgagctctgcatgcagtggctgcatatgcagcattcgatcgatcgatcgattctgccaaatagatagtacacgagatgtgcccccagaaaagatgaacagagaagtatttgaaaaccagcaagtatacttgatgaaaagaaagatccaatatatccatctttagcaatgggaatctcggatccgatcgttgaaagtacaacaattgcagatagtaattaaacaagtagtagcaacttgatcagtagactattaagctttattattgtgagcttttgatttggatttgactatttagctaacagtatatgtgggcaaaggaaaggaattggatcgtcatttctacggcagaggtacagcagcttgtatatatatatttaatatttgtacccaccattatgtggtaaatatcgagaaaaaagtaatctgtgataaattacagatccaaattaaatactacaattaatatttgccatggtcgtaatactaatttatgatcggtaaatgtgatctaaaccgttaatatatgtgcgaaaaatattatactaccgttagttaatttggtattataaatagataggattcattaaattaagaaagttgacggtctagattaattctaatatcagttaggaccatcgtaaaaacatcttatacagtggtaaattgatttctctctgtt

SEQ ID NO: 32436 - DNA, 44759 bp, Oryza sativa
  unsure (1)..(44759): unsure at all n locations
tgccatggtcgtaatactaatttatgatcggtaaatgtgatctaaaccgttaatatatgtgcgaaaaatattatactaccgttagttaatttggtattataaatagataggattcattaaattaagaaagttgacggtctagattaattctaatatcagttaggaccatcgtaaaaacatcttatacagtggtaaattgatttctctctgtttataacatatttataatatgttttgattttcttaaatcaaacctctttaagtttgacaacatttataaatatatatatatatatatatatatatatatatatatatatatatatatatatatagcaatattttttacactgaacaaacataccatcaaaatatattcaatgttcgatttaatgaaactaattcagtattataagagttgctatatttttctataaatgtggtttaaatttattgaattttgacatgtcaaaacatcaagatgtcttataatgtaaaatagaggaaatattatttataaatgttaaaatagaaagtaaattggtcatcgatctttctctaccagcttaaggtttttggttgagctaatcggtacatacatatatcaaagccaaatatctcgagtttagtcttggttggctgtaggagacaaaagaaaatcgatccagtttagcaaaatacagtaatcaatttaccgcttgtatatatattgccacatattgtttctctgcactaataacgcagaggatccatgcccaattgatcgaggcgaggagaccaaggaaattaacgcggcgtttggttaattacgcagttcgagatatatatgtggggtaaacatagtaggagtattcaatcgactcgttctctgcgttgaaattaaagcacgcatgcaacagtagcacccggcctcatcaattttcagtgatgttaatgtctacttgtcgcgagagatgatgaaattaatggcatcaaagtctcgtccaggttgaccgcgtatctgtgaaaaacaaaataccagttgatgtgattcacagataattaactgtgcaacagtatactgtagactgtaattaggtctaatcatgttgcttgattcttccaaactctgacatgatctatctaggaatctgccgtgcctctggctcgatttttgttgtagcctagaacgtaacacgccacaccaagctgcagcaggatctgtgcatgcatctcactggtcaaaaacagggttttgtacgtgcatctcaatgaccaacatggattgatttgatcgatccaaaataaaaaataatggtcaccttttttttaataatagaatataatattccggcttttgctcaagaagagctacagccaattattacagagtaacactcgagataagagtatagctcaaataaaaaagaacacacttaaataggaaaagccaaaataatgagaacacatttattccagtctatttatgaatctccatccatagttgacataaagttgcataaccattgtctccaacttgcgacatgcaactttcagaaactctccatcttcatcacacctttgtaattgtgcccaaaaccggagccaatgagttgccctgaaaattacctgcatataggaaatagatggtgatttgtcaaaaatcatatcatttctactcaaccatagagcccaacaaatggccgaagctccaacaagtatcagtttactctttttcttgtcaacccccaaaagccacctatcaaaaatatgagatatactaattggaagattaaaaccaaaagaaaactgaactgctctccatatgaattttgcataatgacaatccataaagagatgttgaatagactcattattcatacaaaagcaacacctcaagctgccgttccaaatccgtctcgccaaattgtccttagttaacacaacccctttaagcaagtaccacataaagatcttaatcttaagtagcatcttgagcttccaaatacacttatttctctcaacatagctattattaattaaagctaggtacattgatcttaccgagaatctaccgttctgatggtagttccatctgaaacaatcaaaagaacgattcaactggatatacacaatagaagcgcacaactcatgccaataatggtcacctagcaaagcaaacagagaatgggctggcttatgtgcacccaaaatgttgtgtgaagaagtgtgccctcgaaaatatttctcggaatactaaagtggatcgattttgttttgtctcctgcagccttaattaattacgagtatcaattaaatcatcacattatcaaatcgatctaagcttcatcagcaagccgaagtagtagttgggcttaggacaggcctaattttgtcttgctttgggcctctatgcctggtccaatccattttgcatctcacgtcctttagacgtggcttggaatgaatggataatttatggcttattttgctttttaatttctaccgagttttgccgtggcaattggtaaaccatcaacatttcaggcccagcataagaaaatgaatccatcgatctatattgggcttgctattcatcactcaactgatttttctaaaaaaatatatattagtcactttttgatacccctaaccacttctaatttttttaaaaagatattaattaactaactggtctcatctcactcactgtcgatcgagtactgatcaccacatatgtgcagcactatagcatcttcccctccctgacctcctcctatctagggtgctctaccattcgtcttgtcgtcaccaacacgagcgctagtagtgaagcttgtcaaccttcgcgttcccacgtcgtccctcactccctctttctgcttggttgtagtcggtacatctcatcatctttttgttgctcctgctaccagatctactgtcgctgcacccgcctcctaactaatcaaaagaatcgcacctgcctctaacactagcacacattcttccatccccgtggctttaacatcgccttgtcacctactcgtccctgctgctcatcatcggtcttctaccaccttggctatcgctctaaagttatcctcattatcccctacctcccacctggccaccacctctaagcctgaaacactaatccaaaggaagtttgtttgagttaatcgtcaccggtgggaccatcaaccctctccctctcctttcttcctatctcccccgtctaggtgttataacgatgcccttgttattaaattgtgatccaatgactagggcgaggtgtaacaaccctagtttgttggtagcccttgtagggatttgttcggttaatccatttcaagggggattgaaaggccctcattgagaagtgattaaccaaataaactatagtaatagtgtggtttaggtccttatggcccaaaagtggttggcgggtgaggatgagtttataaacctttatgctcccgcaatggtacctttagattaacccttttacatcatatacgacaggaggacgggaatataaatagggtactactgatagatgggcatgtttgacgtgtaaaatgaactaatgcagatcttaaagacatgatattagagtagctaggtgaatttcagtgacctgatttaactcttgctcttttttatgaacacaagaatggggtacaaatgcaacttcctcacttgagagctcagcacaaccatcaccacccccaacagaaccggagatctctacatatggtctttgaagatattatacatgcagctggttcaacatatatattagagcattaattgagatcatgtatgtgcccacgatttactgtgcggggacaggcacattattgtgacttcaagtgcagaaaattttaaagctgatttctagccattaagtgcggatactttgaaataatcgtgtggacatgcatgaggaactatatattatttttaagaaagcattacattcatgaaaaaaatccatttatttgttcctccctggcaggtacaagtttaacaaaacaaaaatcatgagataagaaagctaggttgagctagctccaatgtagctaagaacgatggcacaaaactaaagatctaagggtttgcatcaccataaccagatccaccacctacgccattgccattcccaccattttgaccaccacccgttccaccaccgttagcagaggcatctgcatttgcatatgatgggttcggcgaggagaagccgccagctccctcactagctccagatccagttccaaaaccactcccgtagccactggatccaacggtgccgcctccttgcccaccaccattgcctccgccacctccaccagcgctagcatccccagtataaccttgataatacccgctgctcgtctgactagagcttgaacctgcaccaaatccaccaccgtatccggtaccatagcttgttgcaccaccacctccacctccaccacttgaatgcgcgtgcgctccgtggccactcgtagccaccccgtacccgcttccggaccctacaccacccccattcagatacccaccaccattcccccctcctgaacctgttccctgagcattggcatacctagccaccctggcagcatgggttaagccaatgctcatgagaaggacaaagctaagcactgcaagctttgttacagccattatgaatatagctagctagctaggtgctagatggaatggacggcaaatcaagaattgtgtatttatagtgctggaggtcgttttacaggttctacatgttactagtatgataacatgatggaagtgtctagatggtgagggtcgacagtcaggtgtacctacagttaaatttttttaattaaccagatcgaatcttgtgttgactagcagaaatgataaattaactaactttgtaatgctcatcccaatgattcaagctagctattgttcagtggctgcctctgtttccaaaaactatggtacactttgtgaaatgcttactactgttaaaatgcctagctgtaagatatatgagaagcaaattcacatgtattacactgttcaaatatttcttatgggctctttctccttcgaattcgtttgacaaactcccatctatttgagaagttatgtactttttttaagataatgggaaaatttcattaataaatgaaattacactaggcttttgcatccatcagggatgcacagccaaaaaacaaaagagaactaagacagtctcaacaaattaagctcaaaacctcatcttaatgttagatgaaattagcataatcactcacatagaacgtcattatttttacagtcaatttttataatagtagagattaatggaaatggagggctaaggcccttcgataaaaaaaaaacatagaacgtcatagggaccgtctgtacactagaccagttttagttagagaaacttatctactaatttagcatctattaagcacgttatgaactatatactcggcatatgtaaggcatgatcaacagagcagctgtagaatagagcaacaaactagcaggttttcagtatatgattgattggctttcagtttcagtttcagtcatttgagttctaggtagaaaaggcaaataggcgatcgacgaggcagagaccgttgctgggtgtaaatttgtcgatgatgcattgtctttgtgactttcacaaagaggcaaggcaacgacatgacagttcagactgctgcaccagcgaagatgctcatgtctacatcacgttgtagctctgatctacatggagaagctgtctcaactctcatcacgagccatcagagctaccccaaggagacaagcagatcagagctactccacggcatattgggcacaaacagttacacaacccatacagatgacaactacttttacaacaagcagagagccaaaaggccgcaaattttgttcaatcgccatcaggaactttgaatgggatgctgctagcatgatttggctagaaaaagttgtcacactaaccgggggtcatggttcattcaggttgcgattacttggacttggacgatttgtgcttcttttttgggcgtgacccttcattacttgcaacataagactcgagtctcacattttcctgtgcttcactctttctgaattcctttgctttcttctgcaaattgagcagattcacatattatgagatgaccattctaattacggtaaacatgtcacgctcccaagaaattaataagaacgaaacagtgtttacctttagggacttagccatatcagcaatctcgtcgttgttgctggtagacttggcagattcgtatggagttgcagtgtcctcctgaaacaaattgttattatttagaaccaaaatgaggaagataatcctgaaaatacacaaataagaatattctaaacctttggaggaacaaatgcagcttctctctttcttttgttctcttcagctttctccgattgcttttccagcttctcttgccatttctttgcggacttctttttgtcactcatgaaatactcaccactctcaagttcaagatcaatctacaacacccagaatgaaacgttcaataaaatggtattgcagtacccaaagcaaatagccagcagtagctacacttgcactacaagcatatcattaggcaacgaggaaagaggaaaaacacatgacccatggatgctgttttcaccaaattataatgtagcaaaagaaatacactaatcttctatacaaataaaatgaatatgaacagagcaacctgcataaatacacaagttgtaggaagcaaggaaggactactaatcacaactcatatgctggtcaaaaccagtataacaaacagtacaagtttgacactacaaacgagtttaaacataaagaaattacttcaccttgctaggttgctgaggaggtggaaagggtgtgtatggcttcttctcctttgttatcggtttcttttgtttgacatttttcctgaggaacagcaaaagcaatgatgtataaggcctttagaataattgtcagtagcactaaacgtcttaacaaagatgatgcaagttccttacttcttaaacttcgggagaaacctgtcccagctttcattggctagcgcaggatttttggccagctcacgtttaattaggagttcctatgtagtttaacagaaaatataagtaataatcaacaatagttctgtaggaacattccttgaatcaaacatctgagaaacaaaacctgttaccttgatgtggtacacagggtgcttgatgttctttatgcagtcctccacaacccttcggacttgtttcaatcccttccaggaacccatagcagcaacagtgtttcccttttaatatagcaatagcaatcaaatcagttgatataaagagtaaaaaggaggttatcccacaatgaaaatttaaatgtagcacataaagtaagaagtattggaaaacctgaactaagatgtagcagccagtcaaaatctcgatggcctgcagttcataaaacagcatgagaacaaagggatgttttttctaaccttccaataatgagatgtatcaaaattgaacatattacaagcagtttaccttgagagtagataaattagggcccagaagacgttctctccttttaacgaatctttcctgcagatggcacattatgagcaggctgtagagtaagtaaaattcatcaagactgagtgaccgacaaacataggatgaagaggtgatgattgcattatttaccatatggcaagctgtaatcatgtaaaaaattacacaataagttaaatcagactaattaaagaaaccatatgttgtaggctgtagctcgttaaaccagtttgtctttttgtatttacaagacaatacagataacttagcacagaacccgtgaatatgtgatgcaggtgcttcagattacgtatttatgtacaacaagaaaatccataaacgtcagaatagctaaatcttggatcaaggaacagagtcctaatatgaaaatacaaagctgcaaactataaggtgaccatcttggcaataacatcatgggaaacattcagtaacagatgtagctatttggaaacaagaattgagttgagcctcatgaggaatgggcagaatgttttccaacatccttatgcgctcggtatcatgattatattacgtgactaacaaaagctggtatttaaacgtacatgagtggggatatttgcaactgatgacttactcaaagttaatattaggaggcaaattgatattaaaccatgatggaatagcctaccttgttccgtataatactaccaatcttgataatatcacagctcatctcatcgttgagtattttaatcgcctgcaaaattcatcagaggtttagcgacaaaacaagtcttacacaaagcaagcgtaggtcagcaacacaatattagcatcatgtggtaaggacatattatacctgaatactagaaatctaaattagctctcacattttcctataatctaaatgactcaatgcagtggatacaaagagagtgattaacacctgtggagcggggacgctcctcgacaacaattttatcagctccttggccttaacgataatgtagggatccctggtcttgcgcgtggtcgaaacggtcatggatccttccacctacacaaacatcaaaaaaggatatctcaaatctcacccgcagaataaactgaagaatatcaccaataatgtcttatcactcatcggctcatcgccgtaccagattgagctcgcaagcgaccccaaactccttcagcgcgcccttcacaatcggccacgcctcctgcaggtacttctctgcatccatccaatccggacaagcaaaacctcgtgaaattttcacatcatcttgggacttggggatttctatcaaatcgaatcgaaccgcgacttgcctcggtactgggggaagagggtggagaaggagctgacttcgagcatgccgccctcgttccacgaggggtcgaacttctcgatcttccagtggtcgatgttggggtcgtcgtcccacggcttcggcttgtcgtgcttccccttgtgccgcggcggcttcttcctccccacctcctccgccgacgacgcggcgttcgcttcttccccctcctccgacgccatggcggcgggaagtagtggaggtggcttcggccgaaggggtggtcggcgtcgagggggacggcggcggtggtcggatggtcggacggcggcggcgggggagaggagtgaagtctgggccttacagtgttacgaaattttagggttagggtagtgggtggtggtgataaagcgatgggccgaacgggcttttactgggctttctgctgaaatatggtcttgttgggcttttcggttaacagaggcatatgatcgaacaaatcgaaataagagaattgaggaaaatttgttggagatttatttcatatttattgtgatgtgaaattattctcactcaatctccaccgatccctctctatttacaaacaaattgtgctcatggggttaggggtagtgttttattttgagaacttgaggcttttgttagctttggctaggcttgaggcctaatccatgggagaaaaacaagtgactagcatgaagcaacattgtcaaatgacctttttatacctcaaacaaaaagcacaacgtgccatcattctcctagctctccatttccattcctcccagcaacttgaactagatccaagtaccatgccttcaaaattgcccaaacttaattggtgtagggacaggaaacaacaaaaagtggtcgcagtcttcatcaacagagtctcaaatgtggcatttctatcgatgaggcttatctcacgtgatgaggttatcaattgcaagacatcttcaatgatcgaattgccaaccaaatgaagaatttgactcaggtactctactactctagccttctctagtgtggcatagatggagtcgaccatcgcgtcgaagagacttttatgttagtccattctccggcactgtcatgcctagctagaaggtggcatagttgagctacatgttattctgaccactttcttagtcgtgtttgtaggtgaagtaggggtacacattggctagaagaggtgatcatgtgccggtggtcaccaagcacctcgcaattggcgtatgcaggcataagttggattgtgcatctatggtagtttacagttaaatctagttacgctcctgtttaatttggcacatcctaactcacattacgtcagtacatagttatatttcctttatttaactcgtagaaattaaatttaagcttgtatgattgttatttaactcgtagaaattaaatttaagcttgcatgattgtagagtatatatatcacatttaatctatcttgttatttttaaatttttttataactatttagcagatgacatgtacaatggatgttccccatagagattaaaagagagtttcccatgcttatggttgctgaagtgcttggactttgaaagatgagatacgcatttagagggaatattaactctacttcttcgcggctgttttgtaagagaatgattaacaacgttcagagatcagactggccgagaaagatcgaaaagggaaattaatcctctggtttggcgagaggatggatcatggatgacagtgacacagtggaaagaatgcagcaaaatatatatttgtctttttaggccaatttttttatttatagtaattaataatttacaaattaaatatgtggtaaataagagctcctatttagtaaaataggatggacgctaactctaatagcgtccaggagcggacgctgttcacctcgatgtccacctctggacgttgttcatctcagcgtccactgcctggcaccgcctcccaacctatatcccacaaaatacagaaagaaaaaactacgtatacccatatatctcgtcgctaacacaaacaactggagtatttggtaggcgacgctcgcctcccaggcaggatcggactaagcggcagcccttgaaattttccgtttgtcgcctgccgccctcggcatctcgctgtaatgaaggcatgaagctttcgtttccgccattcacctgtgccgccgatggcaggcccaggctgggaacaggcacaatgagttcttgtgcgttaatcgttattgaaaagctcacgcactgcctcgcaactcagatgaaatacagatgtaactatttttgtgggtattcacatgaagtagaagaaaaaaataaaaattatacatcacactcctaaataagtccattcatataattgagtatttcggatttcagaatacgtgcatgcttccaaacttcacactacagaagaatatcacaacagtaccaaacaatagatcatatgactataggcgtgtaagtaattcagtactagtacacatagaaccaatcaaacagaaaagagtcatagaaggtctgaactctcatgaatacacatacatatgcttctaaactaaaacacatctttgagctacaacagcaccattaactgcaaccccaagcaaaaattataacttagatttccactactaatcctaaaattacttgtcgtttccaaaagaactgatagatatggttcttgtgtccttggcggatatcgccatatcaggctcccgacaaggtggggacggcagcggcttcccacttcccagtctcctgttggatcggcggcagtaagccagtaactgccctaggccctagcctcgaatcctcgatgccgcaccagttctccctgcagggattcctcgcttctatttctcgtatatagaatggatatggctttgggatagttaggctgcacaacatagctggacgctgaggtgaacgacgtccagacctggacgctatggaaagcaacgtccttttttggacgctattagaattagcgtccatcctattttgctaaatagcaactcctatttaccataaatttaatctgtggattaataattactataaataaaaaaatcggctttttaggagttctatttcttccagtatagtgaggtgacgagatgcattaattgtttccactgtaccaaacctattattttttcgaaactaatcaagttgtagtataaaatacacagctataggtatttcaggtgatcctggttcacaatctatctagtcgtaaagcatgtggaggtagtcttaataaaagtggagatacaagtgcacaaatggaaagaagattcggagacaacatcatataaacctgatcacatatagcactcaaagatcactgtgacagcttttggcattcccttgaactctaaaagtgatacattaacttaactaattaaaattccttccaaaagagaaaaaagggtacaacaaactagaaatgatggagccctttattagttgctccctaatacatcaaaggataaaatcaaaacaaaacaaatactaccatatcaaggtgaatgaaattattaatgataacgtgggctccaatgtaactttggtcggcacatagaaatgaaaattttaagggttggcatcaccgtaaccagatccaccacccccaccgcttccgctcccaccgctttggccaccaccgttgccgttaccatcgccagttgcattggcatttgcatatggcggggaggatgtaggggaagcaccaccgtctgccgcagcagatccggttccgctgccagtgccagtcccataaccgccggatccatcaacacctccagcttgtccaccggcaacaccaccaccgcctcctccggcgctcgcactcccaccaccctggctcaccgagcccgagctcgagccttggcctgatccagaaccaaaaccagtaccattgtactgcgagccacctccaccccaaccccctcccccagcattcgcatgggttccgctcccgctctggctaactccataaccattcccgttccctacaccgccgccattcacgtacccaccaccactcccggtacccgagccttgaccttgagcattggctaatctagacacccttgcggcattggctaacccaatgctcatgaggacaacgaagctaagagctacaagctttgttgccgccatttttgagcttagctaagtatgcttagatgggatggatgataacccatggattgcttgggtatttatagggctggatggaggtgttcatagttatttttatgttagtggcatcactgcaatgcattgatggaagtgtctagaatatggcgagttggtgaaaatgtactaggtctaggagtgtagctagctgtagctagtgatacttatttttaattaaccggccggatccaatcttgtttgactgccacaaaacttattactataccccgtaattaaaatatgtgtgatgttgacttcgaatcgcttaaacctatagcttagtccaaattgagaggtgttgacgatgagcatctgaaattcatggagggtgttcggatcgtaaaggaaaagatctcatcggcacgaatgatctgatccgtaaaattcattcgatccgacggttcaattcactgacaactcttcgttagagcggtcggtgagccggccggcatccctgtacttctaatcagttgcacataagtgtgttaaatggttaaaccaacgaaaaccacttaactaaaataagttatgtatttacttattttgatctattagtgagtttgcgggttaaccagaatacattcttattgtacgttgtgcgagctgttcggtgcgctggtcgatccattgaacgctatctatatatcttggccgatgttatgtgccgtgccaccgctgacgctgccgacgatgccaattgataacatttttagtaccggttgataaacatcaataaggactaaagattcaccagcattagtcctgattggtgctaccaaccggtactaaagatgcatgtttagttccggttggtagcattaacatagactaaagatatttcctcggactttggcttttagaactggtactaaagagttttagtacttattcttaatacatctataatatttgtggtttgggacattggacaaaagatgagttctttggtagtgtgcgctagtgtgtgctcgcattcagttaagtgatcattttacgtacacttcatctgaccatcgagggaagagcaatttcgcttggcggatccggatacgtttgaagaggatttactgtgtaaatttgtatccactggcagctgtttttttttttaaagaggagaatgcgatgctgagacaatgggagactatgttttcacatacccgatcgactggctgaaataaatgagaaaaataccctggtttggcaattggacacaacgaaaacgcaaatggttttgctaaaaagaagtttcatattattatttttctcaaaacttttgaattttccaccatcagatatgctttaagatttgtgctactgagaggaaatatattagcgtgcgcgtgcttggaaggaatcaaatccagatacgttgcccgtgtggctgttgctatataatttacatgctaattttaatgtaattatgtttaaaagtttttcattaagaaactatcaaatataactcaaattaaggatggacaaggatatagtgaaaactatattgctagcatctggcctgaagctttgctaaaagagcacgtagtttagtagttgcagtgacccgagtagcacatcaagtttctaagtttaaatcttttttttttcgaggggactgagtttaaatcttcattaggagcgaatttcagattatattgtttgagggataatttaaaaagctggatatatatccgaatggatgtagagaccgggtaaaaaaaacccctttgaaaaaaaaaaggtcctaaggcgatgatgccaccatgagaccaacccactgcactttccaaccgaccaagttgctagctgtagtacaaaatcgagctagctagttgaccgtcgatctcattcttcaaacgaaaagtatcttcctggttcaatctagtcttaaggcatgtggagatagtcttaaagaagagggcgtgcatgtgtatacaaatctaaagatggtagcaacgtccggagacaacacacatgatccggatcattttagagcactactcaaaaagattgtcatttctcatagataatggatatttcattaagcaattactcagagatcatagtggcttatatagttttctcacttgtttgtgaactctaaagtgatacaataactaaaattcctcccaagaagaaaaagatacaacaactagaataatggagccctttttattaattagttgctctctgatacatcaaggataaaatctaaccaaatcaaatactacaatatcaggataaaaaaaaatcaaagatagtgtgggctccaatatatctttgattaactacataaaaagaaaaattttaagggtttgcgtcaccatatccagatccaccgccaccaccactaccactgccaccactttgaccaccaccgttcccattgccattgccacttgcatttgcatttgcataaggcggtggcgtgttaggggtaccattgtttgccacactagatccggatccattcccaccgccagtcccataaccaccggacccatcaactcctccagcttgtccaccgccattgccacctccacctccaccagcacttgcatgtcctccatagccagggtaataaccttcggccatctggccagagcttgagcccgccccggatccactgccaaatccagtaccattgtactgtgagccaccacctccccaacctcctcccccagcagttgcggtgactccgcttccgctctcactagacccataaccattaccatttcctacgccaccaccgttcacgtatccaccaccgttcccaccaccttgaccttgtccctctgcactagcgtatctaaccaccctggcagcattggctagcccaatgctcatgaggactacaaagctaagagctacaagctttgttgcagccattttgggctcaactagttaagaactttgatgggaatgggttgaatggcaaagcaaggattgcttaggtatttatagtgcccaatcgatagagtcttgcacttgcactgcagcacgcatgcatgatccaagtgtttggatggcgtgttggcgaaatataggtctatgagtgtagctagctatagctagtaaaacttgtgtttagtaagccggatccaatcttgtttgactgccacaaaacttacaaattaagtctgtgtgatgctcatcatctcgtatatcgcttaaggtatctatttctgcacctctttccaatggctagctaggcactgcacatcctgtacttccatatatactggctatatagtagcagggtgttactcaaaccaccggtaacctaaccgcgaggttaccgtagtaaccacgcttatcgtgcggtacggtaagggttatcggtggatggtaacgtaaagcctagctagtagttcgcatgcgagtatatatatatagtcctaatataagtctaaatttcattattagctgaatatagttttttcgagcaaaatataggcatataaactgattggccggcgaaaaaaggcatgtaataaagtgatctgatagcagatccagttttcaggaacaggaagttgtgaaccaaccaagggtgtgtttagttccacaccaaaaatgaaagtttgaagaaaattggaacaatatgacggaaaagttggaagtttgtgtgtgtagaaaagttcgatgtgatttttttgggttcaaactttgcaactaaaccgacccatttagctaaaccaaattctggaaaaaaaaatcaacatcacaattaatgtagcatcatatataacgttcctttaaaaatatataatgctaaagaaacaaatataatgctaaaggcacatcagttaacgaatagtaattcatcgggggttccgctttaaattaatctctgttgctacattgaacgatgagtagaggcgtggcttgattacttggatcatgtgtcttccggagattccccacgaaagatgagtcgatgccgcaatccctaccaatttgaccatccattcaccattatggagttacagctgaatgaaccgatttccgataggttccttcgtcagttaatccaatgcacaattaaaaactcatcactgatagagtttaccagatcagtaactaattaactgttaattgattaggtcgatcgatacgtacagtgtgtactccactggtgaaaactctgaacaattttgattaatatgcattacaaccttagacatactttcattaattgttcagcaggcgagaagacgtagatgtctgtaattaacttgcatatctactgttactgagttactgacacacatcatatatataccacaacgaagtaaaaactgccagatggttcctacttcatccgttttacaatgtaagacttttctaacatagcccatattcattttgatgttaataaatctagagatatatatgtatttagattcattaacatttatatgtatgtgggtaatgctagaaagtcttacactgtgaaacggaaggagtagaagaaattagctagtagtaaacctggccgatgcatgtggagattggaattaatctgaccattcaagtcatcgacaactgtagcaaaaattaagaattctacattcaataaatgtacatatgcaaattttatatatacaggtgattccagatcataagctagatcatgccgacgagatatgaatcggtgactggctgactgatgcaatgcaaaacctacgcgatcgacgtgcattcatgccggtcgacaggctagtgtacgcgtcaacttggatgactgattttattattatctgcaagtcaaggagattgcaggcgaggctagattctgctactcatcaagttatatctgtactgaggtctacaagtatatataatatatactacaagatataaacaattgataccaagcaaccatgcatataataatccaagggataatcactctgatttgaaatacatgtacgtgttagacttgtacacaaatcaattaagaaaaatcatcccaaatagcttagttgttgtccataattcactctagattggaagcatgaaaaaaatagtatgttagaccaatgcaaatataaaattttatagggtatttaaaagaggtccagattttcggagtaacttacacttaggtaagagctgagacggccaaacaacttatattggaattgaagggagtaaaaatgtttcacccttgcactaaaaccggccggttatatttcacattttcaccttcaaattttaaaactgaataaataataatataagctatattctatcattgttttgattgaaatatagtagtaatcttctatatatgaaggctaactattgttagccaagttttatagggtatgtaccaaattagatagtatatctacatcaacaaaatgagcattttattaagtgtttgcaccagtgaaaatcaccatcatactaataaaatcattatagatggtatgttttatctagcttttaaagttgtgagtaaaaagcaacattttttttgttcgtcaaggaaaattgacttcgagaagatcagttagagtgccaagaatagactttccatccatatgcctgaggtcaaaacgggctacccggatgccagcgctacctcctcaccattctgtcctcgtagtcaccgtcgtcggtcatgggaaatcatgcagccgtgaggatagcagtggcagggcctcctttttccatgccctcgaaaattttctcttggcatggcgaggttggcgtggcggatctcgccgttcgagatgggctagagacacagtggtggcacggctagatggagatgacggcatcgttacagcgggatagagacggcagtgtgcgtcggatggctagctcgcaatgaaggtagccatggcagaggcgaaaggcataggggatagctggagctgctttcnnnnnnnnnnnnnnnnnnnntccccaaacaaatctgatgatagtgaggctgtccacgattgcagaggtgacgatggcatagactgcgttggtgcaagtggtcattggccgacgaggcactggcgtatgtgccagcccagggtgcgttgtgtaggtgactttgtcacatattaggatgacggtggtcaggcggggctcaaggtagctagcagggaacatgcccgctagagaggtcgcaaggagaggctgcacagagaggtggggctttcgcctagaggagcgcttggagagaggcatctcggctatgtttcgaccgctaatgctactcgggtagccaagacaccacttgctagctcggatagcagggacacaatgagcaacagtgtggatggcggcctagacaacagcgagcgggtgtaacaccccagcccgtttgaagcctagtagtagtgtgtgtttggcccatgtggcccagaagtggatgtgtagtggtggtttagtaccacattggaagtttaggtgggtgagggcctgcttataagccttggtgctccaaccatggtatccctgggttaacccttttacacgaagcgaggataaaagtgtaagcaggataccatgcgaacgtgggtccgctcaacgtgtagagcgtactaatgcacattttggaggcagggtgttacagcgggtctcctatttccaggtggacctcttccctcccctaggagctaccctctctaatggctatggggatttagtttgatggaggatgggagaccttcgacatcatcagcgttttgagaaaacctatgtagaaggtgtaccgtttgttgaggtggtgtatgaggcttctgtggcacgactgcatgttggtttcttgggcagagtaagagctacttggcaccatgaccctcaacttcttacgtttttgcagcgctgagaaggtgtgataaatgtggcttatgcgatgtgactgcttgctggtgtgttggggcgaagatgagctagttgccggtggtggcaatcttggcaacgataaccgtcaactacttctgttctagtagtgctgcgatggttgtggaagtcgtggttggtaggtggtgagagcattgggcaaaagcctttgcgtggtctacccggttccgatgacgtcaacacctatgggtaccctttcccttcttgaaagcatcgttgtgttgtttcccactttttttttcaagtggaaacctagtttcggtgttcagacaagcgttgaaagcgttttagggtgcgttcgttcgtggtcaagattggattggatatgaccatccatatttgtagggatatgttgatctagttttttatttgattggatagatatggccatttagttttctgtttggttggatgaatgagaagaaatataatgcaaataaaaacatgctaattaataataaaatatgttaattatcaattatatagcgtaatctatactaattaacaacaaaatagactaatatctaattaacactaatgttgacaagctaattactaattaccaacaaaatatattaattattgccaatttactaatgattaatattagtaaagctggatatcctcatccggccaatttaacgaatacgctcatccaacattttagtggaatattctctccagaccgcccatgcacccttgtccaccaatcaaacacactcaaaaactggatcctcatcccctatttaagaatatattcttccaaccaaacacacacttagacattagttttctcatgcatggaaggtcctgttcctcattggtaactgaatttttctaataaattagattaactatcttattgttaatggaagcgcaggaactcctggtcttcttttcaggtttaccttttaaaaaatttgccctaatttgattaaataaatatataaaaatatcaaaatttttccataaacataaaaaatacatcaatttttcatagctttagctctcaaatatatagacaactagtatcttgtcacttgtcagagcttgcactagtgaaaaccctaggcatctaaaaaaaaccatcttagaaaaatgttgtttatctattactaatataaaaaggaggagttgccccctccaatcctactggtgaaatcacccggatcatccctaccgtccatccacatctatctactaatccggaccatccatcttcttctatcctaaaccgtttcgtcgtcctcctgatgagcggtggtcctcgcgcggctcttcctatcctactgccgactcccgcgatgaccgcgcgctgaccacgcctcgctcctcctcgctgattccaacagcgatagcgattccactgattccaccaattccgccgctgttggatctccactgattccatcaattccaccaatttcgccccgaagcggtcactccgccacacaaaacccagtcgcgatgactccgccgtgcgcatcctctctcgctcgaccagcgccgagccaccggcgcactgccacaacgccggatcagcgccgagccaccaccgcacaaccgcatccccttccgccggtgccacgcccgggactgcccccgacgacgacggacgcacgcccccattgctcctccgcaaatagctcctgagcttcacgcgaagcccgtgttggccccacgaaagcctctcctccgcgaatccctccccatggaagccctaagctcctctctcttcctcagggagcgtcgccgatccgtgggtcgctgctcaccctcccgtcatcggctgccaccctgcgtctatcgccgtcgctgttggatgcaggtcgttgtccggcgtttgactgctctcgctatcggatcaaggttgtcgcccatcgtcgggcatcatccactgccaccgccgctcgccggctcgccgtccgatcgagcaggccagcacccatctccagcgcccaccaggtgagttcccacccttgcactgcagccaccctagccaccatgtccaattaccatgaaacattctctttcttccctctttcatgttctttgtaggtgaaccaggtatagaggatgtggtggaggcgtgggggctaatcactatcagttagattttcgtggatcgagcttattacctgagttttctcctcttcggtgatggagccggttcaggtgcgctgcaaaggaaatagttgccacacccccaaaaatcaagtagtttaaatacttctctgttgaataaactagcataaacgacataacggtgattcagtagtttttgttgttatagttgctatcgttgttttcttgcaggtgaatgtgctcttatcctaatacggcatagtgaatcattgtggaatgactgaaatctgttttactatggaatgagcaaaaaatgtttacttgcgtcgatgtcgagaaggttatatatgtcgggagctgtttggaaagggttttatcggagcaacgttattgggaaagtattttgcggagcagtttggaaagggttttatcagagcaattctgggaattgtacttttattggatcaataatgattggaaaggattttatcagagaaatcttgattaggaaggtatatgtacgtgtggtcagaaatttatccctttgcaattcaatagatgcattctctattttgctaacaggaattaatttgcatttttttgtaagaaaacagatgatgtgcattgaaataattattgttctttgagatcttgataatatgtttcttgtccaggcattcccatgagttgcaaatccaaggaagttaataacacgacctgtctacaggattacaagctaatcgatttatcccattacgagctaaagctcactggtatgtttttgtttctctgccattcaccattgaaatatggaatgccatattcttttttccttcgatgcgctcttaattgtctgttctaatttcttcaaccactaataatttgcagtttgatattgctttatcccgctgcttttccattagaaccaacaaaaggagaaatgcctttagctgaagttctcagattcaataccaaagttgattgtttgattctaaacgtaattatcatggtttcttgtggtcctttaatggtgatattaagatttgggcaaaattggtacaaaagcaacatgcccaaaataccttggtagcttccccatttctattatctctccaatttactcttaaattgtatgatgcaacattgtcaagtttcatagtagttattttggactcacctcttcaaagtacctgtcatctgggttgggaggtaatttctaaatctcagctctactatttgatgatctgacattcatattttactatatacttcttgtcactagaattcctgctgcatacgtactagctaggtatttcctcttacaataatggttgtcagaattagcagcatatcagctcaactccatgcttgaacaatctgagtttttctttactccagaacacctgagagttgacatatatgatatatttaacagattgtgttgattgcgcataaagaagtagccgaacatatttctgctatgcacattaacatattggtacatatttacaattctatttttacgaggcactatgctactgatagtctattgatgggctacagctgaatttattttaaaaacaactactgttttttttttcacctacgttgccattcctccgttcctgcatgtccactttgttgcaaatctagaattgtggagaaactcttgatgttcatcatatgccagttcatacttttctaaattgccaaattgaaaagagggttacatatttattcagtcctatctgcaggttggaaattgtatgcagctagctagatcactttcttatcacaactcacaagattgccgctttattagctatagtttgaatctaggatggtctgccataaggtgctttaattacttctatgaattttgttaaatcaaaattgatccatttgtggcttttattgtttgagattgaaaaaaaaaatcaggttgctgctcaagagcaaaaggcaataacatggggcagtgataaaactatttttgggcacagttagtctgtgaccatgtcttcatgggcataaatgaaagggaaactcattgttaaaaaactgaaatggaaacaacttttccatggtaatccgattgaccatcgctcagatattggatatcaatactgtaattcataaagtgcagaatacatgatttagatggagaaaggcaatacatgaggaagatgttttgaacaaaatattatcttaggttaaactaatgtttgttttcttatctggtgttttgtacccttactaataataaatttgttactataaattctatctcattatatgcttggcaaaacatatatcttattttggttgtttgatttgtattactaaatatttccgtagcgttagcacgggtagattactagtttggttttaaaagttagagatgaaaaagcagttttcatggtgaaaaatagcctttgagaagaattcaagcccaaaatggacttctccttttctccataatgcaagtcgtcgttgcaggccggttgattaacgagagcacacacatatggtccaacacagactgacaggctgcagctttggcactggattaacgaatccactaattgggtcttacacgttgtgacaatagcctcatatatacgcttgatactattacctacgtgtaactaaagcaagctaagctggtctttaatttgcatcgggcctggacaactaccgtacttgatcagaaattttcagtaacgcaggattgtgggcttgatttattgatcctacctggcctgcttgggcattgtactcctttcaggctgtggaatcgattgaatccagccggttttgggtttgggctccctccggctgcagagtgcaacctgagccatcagtttacatggatattaccgcagagtgaaaccccgcgcattgctgcgggaatttagtatgataacaaaaaaaataccgtataagatagttagataacatcagattaagtaaattaatgtgatttatgataatttaaatttaaatagtatgtagaatggtgattcaaatgtaaaaagtaagctggtataactttatgaaagaagaaaagtagggagatagtttgggccgtagattaatcatctgaaggctaaagataatttgaaccatagattaatcatttaagtactaactaagtgagaattaactatataagtatataggttatcataaaatataataacgatgtacattgaaacattatgtgaattatgttagatgataaattaacatgtttgtatttaaaaagctcttaaattataataactataaagatttagcatgcttgcatgatgtttaaatgtgatgattgttagtggatgatgatgtggcatcttgttagtggatgatgatgtggcatctttgcatgtcaagcttaaggagttagtgggggataactttataggaagataggattacaggcttacgtgttgacagggggactgtgcggtgcatatgtgaaacaaaatccagtttgattccctcgaatataggtaagatcgatctaattcgtatgcaacagtcacttcgactcctccaacttttaaaattaatttaaaattagtgactctctgatattgaacatggtattggcttatgtggtgtccatgttacatgttaacccaatcttaatctgacgtggcactcacgtgttacaataaaaataagaaagaaaaaaaaaataacggagggcccaaatgtcagtgtccctctatcttcttctcattccctcactactcttgctctctgcctctcatctcttaggttcagcccgcaaggtgaggatcggaggagaagcaccgagacgaggacaaactgtcatagctcgagctagagcggcttcccggcgttggcattatctgcacgacgtcgtcattcatctccgcctttgcggatggtgatgacatggtggaagccgtccatggaggctgatagcctgtgcacggcgaccacctcaattgagaagaggcagaccggcggctgcgatgaccaacgagctccgttgagctcgagttcgctcgctgatctacgagagaaaggagtcaaccgcggaaaggaggctgcggtagcggaggcaagctttggtggcttgacggaggattggcatcgatatgtagagaagatgttgacatcaattgcagcatcttgtttgttttcccctccccctcctaacctaggcggcgatggcatattttgaacatggcctaactcgagctcgagtgccaagccgcgctggcgccacccatcgagtttgatcaaagtggggtgtcggccggtgaggccgctcgaggttgagctcactcgcctatatgtaggaagagaggcaatggttcaggttgtctctgttgcctatctctactgtcgtcgcctatagggtgaccgatgcttgttctaccaccacccctctaccatcgatgtgtgcacaactctactgcaaccccgtcgccgccctgctgcctctcctgaacctcccaccaccggctgccgtcctacatccttgcggccgagaggaaatacagcggagagagaagcagtagggaaggaaggagagagaagggataatacgtgggcttcactctattttttaatttttatgatgactggactgccatgccagctaatctctaagagttattttatatcgttagaacgattgaggagtgcgaatcagattctaaccatatttagcgaagtaaagtggacttttttccatgacgtgtgatggagaggaacttggcccatgctgcctccggcgtgctccatccatccatgccactgccgccagcccgccaaccatcttgccagcctaacggcctcatttgtttgggggcctaaattaatctggcccatatatatgcttgaaagttaaactaaagtcatattctagcctatctatcgacctaacggctacatgttaccctggctagtttcgtcatcctcttgtttcagtgccctgtcagatttcaaccggattgcgcatcctacgcgtctcccccaagacggcaaaaagtttgatgggagtaacagaaagatgttcatgcgagagtcatcagtgttcatcactcatcacaccccaactcatctcgtgatcaaccttcattacagatttttacagagcccaattatttgtatatatgaatttcacgcctaaatgactgaatcgggagatataaaacaagagtaatttttgtgacactaagaaaaacagaacaattaatataggtcgggctctagctagttttatatcgtttggtactttgaagcgattgataagagacaactttcatggctctccgttgccatacgcagatccgctgcctttgccgctaccgctcccaccgttctgactatacccgtttcctcctccacggccaaaagcattagcattggagaaaacaccccccgggaagtcaccgttcatagatgcactagagccaacaccggtgccacttccagacccataaccactagatccatagtagccatccgctcgcccaccgccttcaccgccacctgtaccaccagcattagaagacccacggtatgggtctggaccgacctggcttgagcttgagcctcgaccagacccagaaccatgcccagatccactgtaccgtccaccaccattgccgcctccaccaccaccaccaccacttccgtggacagagcctccctcatttacgatactcacactagatccagtaccactcccggaccctccaccggccccgtcaatagatccaccaccctctccccatccggtgccatttccattagaagtactcgaagcattggctaacccaatgcccaacatcacaatgaagctaagagctacaaatttattgtccaccattgttagctttactagtgcgcgattcaagatgtcgaatactatgtatgtatttatagtggtgtttatggactacccccatgcagtccctctgtctttgtagtagacactgctacgttacaatgtggagctagctagctagatctccctaatcaagcgatcaggggatacaagtggaggcttggaaacagcaagtggtattatattcacgagtagtaattatatactataacttgtgttgtacttgaggctatataagcaaaaagtctaatatatagtaatgctcttgctgtagctacatatgcatgtatttcttttgttcaaatgccgttcaaatcaccaaattaaaagcttgaacgtgttttgtatcatatcgatatgttatttcatagctggattacgcatgcaccgacgttttctttccctcggaattgacgcatggtttgacatttacaacaagttggcactgcagtcttgcagatgcgacgaccttggagtccgtagtgttggttgacatgaatatcagtacgcgagcaactgaagatataggtactgttggtcttactactcatccgtcctaaaatatagtgttctaaaatatagtggattttagacgaataataggatactttcgagtacaacaaatttggatagggagcctgtctagattcatagtgctagaaaatataccatccatccaaaatcctttatattttaggatggagggagtacggtgcttatatttttatgattttttagttcgtatatatagtattggttctatttacagttataatcacgcacacaactacactctctccattttatatcataagttgttttggctctttttaaacttctcaaaacttttatcaagttaatttgtagaaaaatataccaacatctatagcactaaattagttttattacatctaacattgaacatattttaatattttatttgttttgttttgaaatattaatatatttttctataaagttcataaaatctaagtaagtataacttaaaagggttaattggatatatgccattataaatttgatggttttgaaaaaaacgccattacaattcacgtatttggtctagtgccattaccattcgcatatattttgaaacatgccactagcctacgttttttactcgtattggacaaaattgccctcacgtcaacctcccgtcttctacctcacgcacctccagcttcctattctctctcaccccagaggaggagctctcctcgggagctcggcgaacctctccctggcattgtcgttgctttgggactcggctagtgttcatcgacaaattggcattggaccggtgacgaagggtcaacaattccaccggatcaggtggtgacgatggtcaggcatggtggatctcagcctcgtccaatcgagggggcagcggcgcggatccggtgacgacggagatggggagaagtagaaccagcggcgacgagcaagaagggaacgggtatgtcctcatctttctcttcctcgttgcccttccccgccggttgccaccacccgccatcttgtgagtcaccgctctggaccgccaccgcattcacgccgctgtagacgcaccggaggacaaggcactacagcgaggagagctagccctctcacccacggcgggtggatcccctctcctccggagcggtgaatgcagtggtggtggtcagatccgtgtcctctgcatcggcgtccacctccacgactcgcaatcgacggcgtcgggaggacaacctactgtgggaggtcggctgggcggtgagggcggtcaggccaggaatggtgctgcctcagggctagggcgcgacgccggctatagaatggagaggggagaggttgatggaagacaaggacatttcatccaatatgagtaaaaacgtaccctagtggcatgtttcaaactgtatgtaaattataattgcactattccaaatacacaaattgtaacggtatccgtttaacccaaaatagtcaaaatgacttataatatgaaacagaggtaggaaaaacattatgttgtttaggcagcttcttctggtcgtgttcaaaataagattaagttaattttttttcgaaactttgactaccaataacttatcaaataatcagttcgagaaaattggatgcttagatttgatttaaaattactgtcatgatatcatgtcatacgctaattgatgttcaaagttttaaatgttttagcaaatcccactacgccacaaccctacatctgtgatggcacaccagtgacgggcctaaagattggtcacatatgatcgtcacctttgacgggtcgttaggtttgccatcatcagtgaagcatcagtcgtggcccgtcacaggtatcacctcacctgtgacaggccataattttaagctgtcacaggtgaggtagtgatgggtttgctctccaacccgttattggtttgacctcacctgtgacgggtgttaaatttgcaacccgtcaaagattagatatctcatctcaaacgagttaaaaaattatagccatcagagatgacttacaaaaaaatcccccactccacccccctgcgaccctattcctcccctcggtttcccccttccctcctcatcttcccttctcatcttctttctctccctcccttactctctctccctcatcttccttctctccatcatcactctctccctcacagatcaggctgtggcccccctcccaagcgccggccgctgacgcctccccgcctcccgatcgttggccgcaggatctggcctacgaggcgtggatccggccaccgcggcctctcccccgatcgttggccgcttcctcctccaccaccaccacatcgccaaccgccggatccggccatcgtagcctctcccccgaccgccggccgcttcctcctccgccaccgcaccgtcaaccgcggatcccgccaccgcgacctctcccccgactgacggccgcttcctcctccaccacggcaccgccaaccgccggatccggcctcgacaagattgtggggcacggatccggccactgcggcctctcccttgaccgtcgaccacttcctcctccgccaccgcatcgccaaccaccggatccggcctcgacaagtttgtggggggggggggggggagggtgaggatccggccatagcctccctcctgaccacaggccgctacctccgccaccgcaccgccgccagatggagttatcctttttgttattttcccagatgaatatgattgtgatgacttttgtgattttgttttgtgcccaaatgattgtgaatgtgaagtgattttgttctttggctagatgaatgtgattgcgttgatttttgtgattctgtcttgtgtcaaaatggctatgaatgtgattatttttgtgatttgtgatgcctaatggtctgcgaatagctaggcttataatattatatttttttgccctatttttgaggtttgtgacgggtcccaattcagacccctccgtccgaggtgaaggttacctgtgacagattttagtttgcagtccatcaaaggtaactcttacacctctgacgggtctttacccgttacaggtgactccgagtcatcagtgatcactgatctgtgactagcgcttaacccgtcacaggtaagggtatgagcccgtcagtagggttgaaactggtttggatagttttcgtccgtccggacctttttttgggatttggatagttttagtcggaactatccgaaaattctcggattcggaaacgaatttggattttttttctcggaaacaaaaacgaatacagtaagggtactatccatcggaatcggaaaacggtcaaaaactatccagatttttttcggatatccgcacacattgagcaaattttagaaaaatacgtgtgtgtgtgtgtgtgtgtatatatatatatatatatatatatatatatatatatatataactttttcatacggaatcagatgaagagaaactttatatcaacattgtagagctcgatgagatctacaactttcttactgactattttattatttgaggtcatttaagggtataaatattcattataatataccatattaatttttacgaaatctcagatctacaatttagaacgatatctgatggagatgtgttcttccatatcaaagttgtagagctcaacgggatctaccactttgtagtttataatatttgtatttgaaagcatttaaagtataaaacaaacattacaatttttgaagatgtgaagtaaaataaataacatcttcaatttatacaagggtaagtaagttatacatatagtaaagggtcttggggaatagaaaatgataatcatatttgcaaaaggatctcttagagaaatagccatgaaaatcgattttctcatacagttgtgagaccatctacaaaattgacgatataaatgttggagatgttgaactaaaataataagcggtatctcttccttgatcaagaaactcaatttgtggggtttttttatatacggtaaatattcgctaccgtattcgttccgtctcgtattcgctccgtatctgtattcgataatattcgatttcatttccgaatccgagttttcgattccgattccgattccgaaaaaaaaaatgaaaacaaatatgataaagctagtttccgtccgtttccgatccgttttcatccctacccgtcagagataatctgatccagcgaagtgtccagccatgaaatcaaatatttataattggagaaagtagtataggaatcttagcagagggcaacaaatcaataagcaattaagcgagcagagctagctcaacaggttagtaattggtcaggcaaatatagctgattatgtgatagcctgattggtcgagtacatgtaagtagaccatccaagtgtcgcctaattaatcacgccctacttacaactaaataactatagcatacctgaacggctactgatgaggcatatctaacaaaatcgaggacagagagataaagagtttgtacgggagtagcacccaatcgtacttttgaagtgttgacttgtattatattatcgccaagttgatttctctgatctagaatataagagatttagtaattattaaatcgatgttactacgtatgcagttttatgatatactccatccatttcataatataagacacaaccattttttaatgtgccataatataagacatgcatgcatgtaggcaattaactatggcccattctccattaaattattatatttttaaatcctccactcttatgttctctaattctattggatgcatgcattatatttattaggatgatccaaactacaagatgataataattatttcttgttctttgggttaggggtggttatgctttagagcaggtataatagcaggctataagccagctataaacatattttaaggagataaaagaggagagagtagagcagcgggctacagatttgtagccagttgtagtacggactccaagacgcagtgtgtgtataacaggtgggatcagatattaatagtgtagtatggaactattgtatgaattggctattaagtcgactataggtgatttggagttactagttggctgtactattaaacttgctcttatattttggaatggagtatctttcattgctttaaaaatgggcatcgattatccaagctcaaaagtcagcaaaattgtagtgacaaaagttgttctaccacacaacataattctatgcatagtaatagtgcctacaaattggagtatctacactcatcatgatgtccaaaaccattgaagtactaatcaatttccatttgatggcaaactcttgagtagtacaacagtatattaaaatttccagtgacacacataaagcacttacaatcttctaggtcgtcgctgcattgtcaactccagcctcttttcgttgatctatcatccatgcgtgcgtgcttacaaattaagctactttactacttcaggtgcagagataatttgttaatccacaagttgagcttaattacttagttaaaggtttagaagcatcctggctaaggcctcggccacactataagtacccatgcaatctttcgctcccaatttcaactgaactactataactgttgcattcactcacaatggctaacactaaaattgtggcacttgggatttttctagtcttatgcataaatggactatcccatgctgcaagagtaattagatattctagtgctaaaggtgaaggagaaggtggaggagagggctctggatctgtaagtggtgctgggtcgggttctgggggtggctttggtgctagcaacactagtagttccgggggctattttgggacaagtaatgcacatgctaatgctggaggtggagggagtggtgatggtggtggaccattaggaagtgttgggtctggttctgggtctggttctggctctagctcaagtaacagctcaagcgtaatgagagcatggtatggtggtggagaagctaatgcgggtggtgttggtggtggcaatggtgatggatatggcggtggttactcagggtcctctggttatgggtcagggtttggaaccggtggaggctctagcgcagtggctatggatggcttttacggggcacatgcaaatgccgatggtggtggtgatggtactggagtgggacatggcgaagctggtgggtacggcaatggtggagggagtggatctgggtatggtaatggcaaatacccatagttccttattggatttgctagtagtaacactcctttattcgatcagttggcttagttgaagcccattttggttgtttacactgtgtcacagaatgaattaatgttatggttcctaagtaagcatgtgtcgatgagctagcatgaaattaataaagggcttcgttaacctttaggttgtcaaattgttttaacatttaagcatgtggcctagatcagatgctagactacgtgtgcatgtatgtgataactgataaggtgtaatttttatatgtgttgttccatgcgaatgtgttgtttgtcattctaatatggcatattctcaatgtagtatcatgattcatgcatgatacttacatggaaaaacaacaactcccaaatataaacacaggcctactttaaaaagttaaaatttaggatgactagattatacactaagtgtcaatattccccaaactaattagtaattactagagcgggcaagcaatttatatgcacaaggccagttcactagagaagcaagtaattagtacagtctttatggcaattaatactcttgccacataggattttagatgatgtggcacataattaaataaggaagagagcgagatagcaccttgcatgagacatagtttgaacacaaaatctaataaaaaaagacactgtattgggaatgagaaatgtcttcaacaatatgaccaattgtgagcagtaagagaaaaaaaaagaacgatatcatatttattgttgtctacttacatacacaccagtgatatttacaagttacaatgaccctttacataatatcttatcgaccacttctctcgtcacttgcgcaccacaactatatttattaattgactaggcccatctcggaagtgtctccctccacctccacgaattagcacttaaccctagctttattttcctctataaatagctttgtacattctcaaaaacatttgggttttgtttagttgaattttgccaagtgccattcaccttgtctctagtcctcgctcgattagtcggcgactattgattcagagcccccaatagttggtgtattgatttgccgggtcgattagatctaccacttcaatcgcaactatttctttgtgcttaatcacctattcgcaatatttagattgcatcttatcttgttcttgcagtgttctctcgtttgcattgcatgaatcatcaaccgcgcgtcacggttggtacgacatcgtttgtggtgtagcgattgcacggcgttctggacttgttctggttggtagccacgtcgcaaacgtcgcactcgatcaaagcgagagttatcccctcaccagaagatcgggccacgagagagagcatcatcagttggtatcagagcttcagttgcctggtgaggattttagttttgtaattttttcccatcatccactatacagccgcaccactttttcctttaccaaacattagttttgagccttgtaattttcattcaattttgctttattgagttttggtccgctgtcgtgtcagtgctggtttttgttctagcttcgtctggtttgagttttgcatcttggttgctcactgcctgtacgttcggttgaaggagaagaaaacattagatctgatctttttttcatcctcctgtgttagtgcatgcatgccgtggaattctggtacgttaccaagtaaatagcgcgtgaaattaggaagctaatcgtgtttcaatatatccgaagtgcatgtgccaaaaaaatagcaattcccagtttttcttccttttgagctgccacgcgcaaatagaaagtatataaatcaagatcggttcccatattccttgcgccacaaaaataggaggtatccatcgttttctcttgtgaccgaggtatgcatgcaacacaatcgtgcatatgtgcttgagttaattacttgaaaaagaaaaaaagaggaagaaatacaaaaaaaaaaggcagacggtgcaaaaaaaaaaaagaaaaaaaaaagagccgcaccaaaaataataataataaggagaaaaaaaaagtgtggaaattttttttaggctattggtgtggagattatggataccccatatctacacggcaatgatatttgggctgaatacaggataccgaatatacatagaatatcttatttgtatctcgggtttgtttcttaacttgtacatcaaggaaacaccttgagacttagtcggttacgactgtattttatctgtatttgcatattccgttagggatatggattatcttttgtaacacggactccttcccatatataaggggggtccgggtgcctctaggggcagatgttgattttctctaaatcatacaatcaatagtacactcggcggattcatccccggacaggagtagggtattacttcttgaataagaaggcctgaacctgtataaatcctttgtctccaaacccatacactttttgtcacgtcctgataaattcatcccaaaataaaaatcatcttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattgaaaagaaataaacaaagttaaaaaggtttataaaaagaaaatcctaaaagaagttcttttcccccccccctttttccctcttgggccggctcggcccatttccctctccctctctctctcctctcccgcggcccatcggctccccgcgcgcgcgcacgccgctgacaggcgggcccgcccgccactctcgctgacaggtggggcccacctgtcatcgccctcctcccgccgcgcccgccgccgcgcccgtgccctagcgccgccgccgccgcgaatctcgccgtttcccgccgtccccgcgcgccttaatgaggggggaatcactccccgcgtttccctctcccgattccccctcttttccctctctctctccctcggattcgtccggattcatcccgcgaagttcgccggcgtcttcaatggcgcccgagatctccgcgcgcgttttccttcctccccggccgccctctctccctctcggcgctataaaatcgtcccccgtgctcttctcctccgtttccgccgctcgccgctcgctctcgccgtcggattcgtgcccgcgccgtgctcctctctctccgccgtcgccgccgacctccggtacgccgccgacgccgctccggtcttcctcccggcttggcgccacctccctcggcatcgccgcatcgccgtcgacctcgtccgcgcctccgtttcgctcgccgaccgtcggagcgccgccgtcatcgtcatcccgaaccgtgccgccgctttcctccgctccggccgccgttatcgtcgtcgtcgttgtcccggggtgagccgaggaccgccgttcgccttccccctcccctcctctctctcgggcgccgctccgccgcgccggtggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgcgggacccacggcgccgaccgccgccagccgcgtgctctcggtccaccgtggaccgaggggctgacgcgtgggccccacttcccgtggacccggtccgcgcgcccgccccctcggctgacgcaataaatgggattttaattaaaatttaaatgaagaaattcgtaaatatccatttaaagagcatataaacttcaaagggccatatcttggccgtttgaactcggaattggaccgttcaagtctctaatttttccttaagaagtaaagaacccatttttgtgctttgtttctgcttgttatgtggagtttattagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctgtttatctttgttatgaccatattattattgttattgttattattatcaccttgttcaccctagatcaaacaaaaccccaactagtggactctctactcatagtaccactagtataattttaggtagatgcttcgcaagttaactaggcaacattaggtggttttataactctagacttgggaaattctcatatcacctggacactttggaattgttggtttttggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtctcgacaagctggtatcagagccatctcgactgtaggataagccaagtggataaaacccaaggacatattttataaataaaaattatttgcgaaagttcctttttctccttcccctaatgctatttgcaaaaggtttactccgttcttcctccttcggattttcaactagtactagatggtcaggtcagtgaagaagaagatgtcgtcagttgtttgccgaagctccggaagactgcaggatccgctagcaaagcgaaggaagcagtgaagccagctgtgaagcaggagtgaagatcttggagaacccgtcgcagaacctaagccgccctatagggtagtgttgttagtcgtgtgttccttgcttgtgtgtgtagcgcgtggtttgcatcagtgggttgtgatgtaaccatgctaggttgtttgcttaatcaacttgcagaataagcctaacatacatcataacagtaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgaatgaatgaagcaccagacaccagttgtgcggcagtggtccaacacctgattaaccagaacaaattgcttatagagatactacagcagcctcgaatgccgattttgaacccgagtcagatgcaacctcaagtgcagttggaggcagtccaagcattcacaccacaagtcagcgcaccgccaacatcccagaaggaccctcatgccataccacatgttgacccaaaagaagcaagtatcatctgttttatgtgtgatgagcaagggcactatgcaaggaactgtcctcagcagaaaagaaaaacaccaatgcgaaccgaagatgaagtccgtaagatgatcattactagcacagagtggcctccaccaggaatgaccagacgtcagagaagaaataccttccgaggtgcaccacagttgacagagcatcttttagctaatggaggtagagtgtctgatagtgaagattcagatcaagtctcctcagatgatgaagatgaaatggaacgtaaggcatgctctcgttgtggagaaatcggtcatgtcgccagctcgtgtgccactatatgcgttcattgtgagaaagaccatccacccgacaggtgtccaacgagcaggatcacttgtttcttttgtgaaggaactggtcatgtaccaaaagattgtcaattcagttttctgctaacaaagaagatggccaaccaacccgccagttccaacggagaggagcatcaaggcaacacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctccggctgcacctgactcggcaataaatcatagcaaccactctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctatcacatcatcacagaaccaatcgaggatgccgtcactagaacaatgccagctatatctctccagaatcaaaatgagcagccatgtttgtggttttcagttcgctacttatcatggtgtaatcgaaagtttgcagcaatcatgtaattcataaatataatcatgtctgtaaacagtgagctcgctatgtttagagatgattcatgttgaggatacaatgtaccgatgttaagcaccgtccctttttgtttaaggcagtgcctcgtattcatgtaatgagggagaaatgtgtaatacagacaagttccaggaggattcgtttgaaagatgcggatatgtgatcaggtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagtcggggataggagtttggatacgccttttacagatcaagataaggattgttggatgaaacccatgagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagataacaggcaatgtatttccctgaaggtagtcagtgcagcttttgacgaaccacatcaaggtttcactgaaaggcagcaagccaaaggacctcatcagccccagaagcgtccgcaatccacattaaagaataccacctgttagagataagccgaaagaagattgataaaagagattggcaaagatgctctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaagcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaagatagcggaaagtaaactgaacataaagaaagtgaatctgagttgcttgttcgtgggagctattcccagttatgaaccaagtgatatgttcgaagatagtctgcagaggtcagtttaaaagcacatgtaacagcgaagcctcagatttggcaggataatgattagacaataacaaatccagcagtaaagccatttgggaagacgtcaaagtatatcaagtaggataagttggctctcttgggaagcataattcaaaggtaaagttatcgacccttgcatcaaatagccgaagtagctatcacccggagaccagggaagctaatatgaggcagttggtggcgagttagaagcaaataacaagcatggtatcctagtaatgacaagcaggttacgacgcatgacatgaagttgataacttgtccgaggttgactccgaagatatgaatcatgagaagttctggaacggaagcatcactgaactaccgcaacctagtctgagtcagccaaaaggtgcaccctggtccaagtcaggtgaagagaagattccatccgcaacaggaggtcaagccaagcagttccgagtggtaaagttttgctgaaagttcgtcaagacgcaacggaagaagtcagacaagaagagaagaccgcccaacctatcttcttgctagcctcctcgaatctcggggacgagattcttgtaaggggggtggatttgtcacgtcatgataaattcatcccaaaataaaaatcatcttctaaaaggaataatagaattaattaaaattcgaaaagaaattggcaaacactaaaatacgtacaagaaaaattcaaatgtggcccggagaatttttgttaaa

SEQ ID NO: 32437 - DNA, 9738 bp, Oryza sativa
  unsure (1)..(9738): unsure at all n locations
caatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtctcgacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccgcccgggcagatgtttcggttcggcagcctcgacttcgtcaccaacaacttcggcaagatctctctccttgactcggagtcggaccagtcgggagagaactggatctcagtcccgtttggactcccaaacgcggctgaaagttactccaagaccatctcaatcgagtcggcttcaaaccactcggctgagattgcatcttctccaacgtcaccagatcaagatgatggggcttacccaccgatcctgatgaagctccccgacgatttggcggccatctccatcacgacagcgtctccatcccgtaggcctaggcggaagtcggcttcaacaccgatttcacctagcttcagggaagtcggtgtcatcctccaaccactcggcacggtttcgacggatcagctggatagccactacagctctcccaccgtcgactcgcgtcccaccgacgtcgtggagtacgacgagttttgctctcgctaccacgacccggatctcgacgacttcgacggaagcctagatgacaactacaccccactctactttggcgtcttcatggccaataacgagacggaggagcaacgccaagcccgggagaccgaagcgcgtcgcgagactgagcgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgagctcatcggccaacaagatgttgaagggacaccagttttccgcacccctcaacagaatgcggttgccgcgatcaccctcctcgacaccctcctcaaggaaaacgagctcaatcaatccaatcacgtcgtcaacatcttgaaccagacgaagaccatgattgcggcttcggtcccagttaactccgaaagcgtccacacgccgactggtagccgagtcccccacttccgatctcatgactaccgtcatccaagcctcagcatcaccggcgcaggatctaatcgcaggagcaggggtcacgacgagcggtctgttcactcacctcccgaccatcatagggagcgccgagtggaacggcctcgctcaccgcctcgtcgccgccccgtcgatcttcgcgatacaatcatacagcgccgagcagctcgaggccttcatcattcgccggaccgccacgacgacgaccttgacggagtagcagccttcaccgacgacctgcgtcgagcggattggccagccggcttcaagccgactggaatagagaagtacgacggtactactaaccctgaatcgtggcttactgtctacggtctcgcaatccgcgcagcaggaggagacagcaaggccatggcgaactatttaccagtggctttagcggattccgcccgatcttggctccatggattgccccgtggtacaattggatcttgggccgaattacgcgaccacttcatcgccaacttccaaggcacctttgagcgtcccggcacacaatacgacctctacaacgttattcagaagtccggagaatcccttcgagattacatccggagattttctgaacaacgtaacaagatttccgacatcaccgacgacgttatcatcgccgcattcaccaaagggattcgccacgaagaattggtcggcaagttcggacgtaagcctcccaggacagtcaagctcatgtttgaaaaagtcaacgagtacgccaaagctgaagacgccgtcaccgcatcaaagcagtcgggtcccggttggaagccaaacaagggtacgccggctacgggaggaggtggaagtaacaatcataaggaccgcaagcgtaagcctgaggaacttgttgcaaccgccactcactcatctcgacagcgtccgcgcgtcaacacgttcgacaagatcatgaactcccaatgcccgcattatcctaactccaaccacgtggccaaagattgtttcgtctacaagcagttcgcggagcaatacaccaagtctacacggaagaactccgacgaagaacaaagcacgtcaaggaagaaggacgacggcgacaccccggcaggatttcaagaccaccgcaaggagctcaaccatatctttggcggccccctggcttatgagtccaaacggaagcagaagttgactgaacgggagatcaacgctgttcagcccgacacgccccagtatcttcgatggtcagagattgcaatcaagtttgaccgctcggatcatcccgaccgagtggtccacccggggcggtaccccctggtactagacccagtggtccgtaacgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcactctcccggtcacttttggcactcgggaaaacttccgcacagagaatatcagctttgaagtcgccgacttcgagacagcatatcatgccatactcggacgcccggcgttagccaagtttatggccgtcccgcactacacttacatgatgatgaagatgcctggtccccgaggagttctatccttacggagcgacatcaagcaagccgtcacatgcgacaaggagagttgcgacatggcccaaacccgcgagatggcgtctgcccgagaggacatccgactggctgcagccacggcgagcgaaggagaagtacccgctaccaagacttcaaaaagtggagaaagcgaagccaagaccaagaagattcccctagatccttctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtccaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcgaaagaaaacagggcaatggcgcatgtgtgttgattatactgacctcaacaaatcctgccctaaagatccttttggattgcctcgcattgaccaggtagtcgactcgaccgccggctgtgagcttctcagttttttggattgctactcggggtatcatcagatccgactgaaggaatccgactgcttgaagacttcattcatcacgccctttggagcatactgctacgtcactatgccattcggactgaaaaatgcaggagcaacttatcaacgaatgatccagagatgcttctcaacgcagatcggccgcaacgttgaagcctatgtggatgatgtagttgtcaagaccaagcaaaaggatgatttgatctcggatctagaagaaaccttcacgagcatccgcgctttcaggatgaaattaaaccctgaaaagtgcaccttcggagtaccgtcagggaagctgcttggttttatggtgtctcataggggcatccaagccaacccggagaaagttacagctatcctcaacatgaaaccgccaagtacccagaaagatgttcagaagctgactggatgcatggcggcgctcagccgatttgtttcaagacttggcgagcgggggatgcccttctttaagctactaaagaaaacagatgatttccagtggggacccgaagcacagaaggccttcgaagatttcaagaaactcctcaccgagccaccagtcttagcttcaccacatccgcaggagccgttgttgctgtatgtatcagccacctcccaggttgtgagcacagtcttggtcgttgagcgcgaggaagaaggccatgtccagaaagtccagcgaccgatttattttgtcagcgaagtcctagccgactccaaaacgaggtaccctcaggttcagaagctgttatatggtattctaattactaccaggaagctatctcattactttcaaggtcactcggtaacggtggtcacatcatttccactcggtgatatactgcacaatcgcgaagcaaacggacggattgcaaagtgggctttggagttgatgtctttggacatatcattcaagccccgaatctcaatcaagtcccaagcgttagctgattttgtcgccgaatggaccgagtgccaggaggatacccccgcggagaagatggagcactggaccatgcattttgacgggtcaaaacgactttcgggcactggagcaggagtggttttgatttccccgactggagaaagattaagctatgtgctttggatacatttttcggcgtcccacaacgtcgccgagtatgaggccctccttcatgggctgcggattgcaatttccctcgggataaagcgtttaatagttcgaggcgattcacagctggtcgttaaccaagttatgaaagagtggtcctgccttgacgacaacatgatggcatatcgacaagaggtacgcaaattggaagacaagttcgatggactcgagctcagtcatgttcttcgacacaataatgaagccgccgacagacttgtcaactttggatccaagcgcgaggtggcaccttctgatgttttcgtcgaacacctttatacgccgacagtacctcacaaagatactactcaagctgcgggcactcatgatgtagctatggttgaagccgactggcgagagcccctcatacgatttttgacttctcaagaactccctcaagacaaagatgaggccgagcggatttcaaggaggagcaaactttatgttatgcatgaagctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgctgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataacgctcgagacttcttcatcaacattgtgcatagatttggagtgcccaatcggatcatcactgataatggcacacaattcactggcggagtttttaaagacttttgtgaagactttggaattaagatttgctatgcctcagtggcgcatcctatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccaagtgaagttgaattcgagtctttgcgctttcgaaatttccatgaagatcgctacgaagaggaccgagtggatgacttgcaccgattggaagaagtccgcgaagcagctttgattcggtcggctcgatacttacaagggttgcgacgttatcataatcgcaatgttcgatcccgtgcctttctagtcggcgacctggttttgaggaaaattcaaactacacgagatcggcacaagttatctcctttatgggaagggccatttatcatctctgaagtcacccggccaggttcctatcgactcaagcgcgaagacggtactctcgttgacaactcttggaacattgaacatcttcgtcgtttctacgcttaagcttatcattgtacttccctatcttgactgtcaacatcaagttctcttcttgaagttgtcagtcgggggctatcatcataataatggagtgtgattttttatcaatttaatttgcttacttggtctatcattgccttgtttggttttttctacttagtctgcgaggactgaaagtttttaatagcttctttgggttttaggctcaacaaagcttgataaaaacttttaagaaatcaaagacttggctagaactatcaagcacagcataaatataccagtattgtacaaattgagcctccatttgttacattcatactcagtcagaatcagtcctttcatcatcagagttattgttgcttggctgaaggtcgttgttgcggaattgctctacaacgtcacttgcaatcttgtcagccgcattttgagcactactgataagatcaagagcagcttcttcgcttgtcccgtctgcaaagccatcaatggtgtcaatttcaattctcgggtacaaggatttggtcatcgccaatgccatgctagctcccatacttccagctttcttgatattcttgaagtatacatccggtgcaactctcagcttgtcaaagatttcggttgcgtcaagtgcactcggaccactgttattaaggaacatagcttggacgagtggtgtagcgacattggcgacttcatctcttgctccttcaagcctcttgatcttaccaaccaggacgtcaaactgagcttgagatttgattttacggtctacaaaacacatttatgataagaatctgctgcatttaaaagagagaagtccagattgttagctggcggtaccttcaacctccttcaaggccgagtccctttgtgcagccagttctattttgtcttttttcaaggcttcaatttgtttctccatttgagccatcctggcggcttgcgctgtttgaaatccaaatggttgaggacacagttacgacagcgtaaataaatgggacagatctagagattaccttttgatgaaccactcagctcgaaatttgaatcctggagttgagcaattcgctcccttaattctttttccgtctttttggcgtgctccttggcctcatgtagctggtccctaactgcttcaagggttcccaaatgaggaaccagcttttccaaagttgtagtcttggcctcattgcgaagatggattctctgcatgatggttcatggtttagttctgctaaagagagaacaaagttatcaaaggcagtcacccggaagatttacattcacgatgcgagtggcttctccaagtactttcttcagctggcacacttcttcatcttctttttgacgatttatgacgataccggcaacttgtgagttctcgtcccaccatttgagcaagataggaggacgagagtcatcagccgcctttatgcgaggaattgcttcttcgtcatcgcctggtgcccctgatgtgtttccaagacattagacgaataagttgaagttatttaaatcggcatcacttgagaagatgggttacctgaggatgttcctagctgagcgtgaggtgatctttgttctttatttggagacccaattatcgggtcgttaccagcctctggtccttgagaagttgtcgtctgcgtttcaacttcggggatttcttggtcgggacctgcatccgactggtttccagtcgggggctcttgtgttgttgcagtttcagctgctgccgactggtttccagtcggcggctggtcactcggatcgtccttgtcacctgaagcatgggcgtcagtcggctggctttcggtagtcggctcgggatccttggataaatttggctctgttgcagcttgatcaggatcttttccagttggatctatgtcggatggtttcctgcaaggtgttctttcaatattcagtattatttctattagagaagcatgtcgaagggaaatggtaccaagaggtttatacctggaagatgttctgatctttggcattggacggccagccagtttttttctgggcatggtacgctttgggggtttattaggcgagcccttgtcctcagatttgttgtcatcgccttcatcgttgtcaagcaccagttttctcttgcgagaacctgtctgtccagttggattggagatttgagggtgtggatctaatctgattgttggtcctccacctccctgaacagtgtgttggcgaggagaccggtgctgagcgattgggggatcagatttcatcaatacatattcctgaatgagatgccttcacggttagttaactcaacatgaagataagattatgttttgatcatgggttgaagatttccgatacacacctgtggaggcggattgaatgcgttatatggcacaaccggcagctgatgtgagtagctgacgacaatagcatttgagaagattttatacatcctctccttcatgattttaaagtccagagagtctggttcttcacgattgggatcatgcttgccgtcaaactcgaatgctgtacgggatctctctttgattggtgccaatcggcattttatgaagtgccgagtgatctgctctccttgtaagccttgttctttgagttttaacatgcgatccatcaattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32438 - DNA, 683 bp, Oryza sativa
  unsure (1)..(683): unsure at all n locations
gctggcacatacgccagtgcctcgtcggccaatgaccacttgcaccaacgcagtctatgccatcgtcacctctgcaatcgtggacagcctcactatcatcagatttgtttggggannnnnnnnnnnnnnnnnnnngaaagcagctccagctatcccctatgcctttcgcctctgccatggctaccttcattgcgagctagccatccgacgcacactgccgtctctatcccgctgtaacgatgccgtcatctccatctagccgtgccaccactgtgtctctagcccatctcgaacggcgagatccgccacgccaacctcgccatgccaagagaaaattttcgagggcatggaaaaaggaggccctgccactgctatcctcacggctgcatgatttcccatgaccgacgacggtgactacgaggacagaatggtgaggaggtagcgctggcatccgggtagcccgttttgacctcaggcatatggatggaaagtctattcttggcactctaactgatcttctcgaagtcaattttccttgacgaacaaaaaaaatgttgctttttactcacaactttaaaagctagataaaacataccatctataatgattttattagtatgatggtgattttcactggtgcaaacacttaataaaatgctcattttgttgatgtagatatacta

SEQ ID NO: 32439 - DNA, 705 bp, Oryza sativa
attcctgcagcccatatatatatatatatatatatatatatatatatatatatatatatatatatatatatatatatatatatatatatatatatagcaatattttttacactgaacaaacataccatcaaaatatattcaatgttcgatttaatgaaactaattcagtattataagagttgctatatttttctataaatgtggtttaaatttattgaattttgacatgtcaaaacatcaagatgtcttataatgtaaaatagaggaaatattatttataaatgttaaaatagaaagtaaattggtcatcgatctttctctaccagcttaaggtttttggttgagctaatcggtacatacatatatcaaagccaaatatctcgagtttagtcttggttggctgtaagagacaaaaaaaaatcgatccagtttagcaaaatacagtaatcaatttaccgcttgtatatatattgccacatattgtttctctgcactaataacgcagaggatccatgcccaattgatcgaggcgaggagaccaaggaaattaacgcggcgtttggttaattacgcagttcgagatatatatgtggggtaaacatagtaggagtattcaatcgactcgttctctgcgttgaaattaaagcacgcatgcaacagtagcacccggcctcatcaattttcagtgatgttaatgtctacttg

SEQ ID NO: 32440 - DNA, 635 bp, Oryza sativa
gtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgatt

SEQ ID NO: 32441 - DNA, 739 bp, Oryza sativa
tacaaagagctggagagaaagagcgtttgaactctagagaccctctccctactctttttttttccgtcccttctacgagctcaaatcttctccctcccatttttcttggtaggcatggtcctccttttatatctcaaggggataccacatataccatttctacctacccttcttttgggtggggacccatcctactttgatcaagatttggctcgtacttttgtctgacaccgggatagccctgtcctccctcattaatgggcggagatttgcaatggctgctgtttgaatgaccctccgatgggatgggtcataccaacctccactccgtctgaagcaggtgcaacgtggaagcacggttgtttgccaatgacgcgaccggcgtatgaccagtcacagaccggtcattcttgtccaccacgtgtcagtttagcatgctacacgtctgcccttcttcatacaatagcttccttgcaatgattgcgatgaagcctggaatgtatctggctggggctgacgtgccaactccaggagtccccacgccggctccgactagggacgagtgcctggaggctctcatcattccgacgggacggggcgaggcgtgtgtcaggccgcctgttgccccttaacccgcgatctgaccggtctgtgaccggtcacacactgcgacctgtcacggaccggataagcctgcgctatactgcattaaatgcggcgtgatgcgctcgtccaaccc

SEQ ID NO: 32442 - DNA, 2710 bp, Oryza sativa
tggttcatgggcccatgtgcttgtagtattttagtccctagagcctttcttatgctattattgttttgatttattaccctctgatattatttatgtattttcaacaattcttaaactgtgtataaattctatttttaatgaggccttgaaaagttgtctgaatacattagatgtctaaacaattggataggttaatattgtgattgcattggaagagagaaacaacaacaataaagaaaatgttcattgtggaggttactagtgtgttcctctatgtgttcaattggtcattcatgcatacgaccataatgattaatgaagagatcagtagtagtattgtaatacaattcaagtactttctcttttggaaaccaaataatccaaatttgcatgggttctaccctgtttattttgaaatacataatggacctaatttcccacctcgtagatttgctatgaggaaatatgctggtcatgtgtgatctggcatattttctgggcttagaaatgcccaatctctctgctatactgttgctggttttagtgacaatccagccgatcgtttttggtctataagggttgcttgctttactcctttacctgctgcctgctggaatgcacacatttctgctttctccaatgttctaaaagtgtcatgcttgttgtttgtaattgatgcatctatttggatcaatatccagactcctttgagtaatctatttgtacaaaattttcttcatttgtttgccaccttgacaattttctgcttatttaggtgtattacaagtatccttacaatcatgtctgctgagcaggatcttgtaaagggtaaagatacattgatgccattggttgattttcaagagaagaaacgtacaggatggaggcaactgaagatttcgccatctggagtggtgaaatatctcagaaatacatgctatgaacatttggcaaccttagaatcagatatctttgctagtttgatacaacatatccttgtaggtgattgttgatggtgcttatgctcttcattcaacactgaggtcactgcttgatattcgtgttgctgtggtaaaaattataattgccctaaatatttttcattatagaacagttattttatctcaataatttcacccatgaacttcaggttggtggtgttcattttagccttctgtctaaagtccagcatgatattggagattcttgctcgttggactatctgattgatagcatatttcccttgtttagaaagcatattgagccagacttgcatcatgctcaagtatacatcttgtaccttttttgcctttttatagtctgtaggtaccatttgattcttttttatttgagttgctacttgctagtgcagattagaatcgacaacagctttgtctgctcattccgagaaccatactacaagcttaaatgcaaaaacgaggtcagcattggtttccggtcggtagacaacatattatgtatctaactgaagctttgtctccttttcaactgtttaagctttatgtttgtttcatggctgtagtttatttaatgcaacaagtcagcaagcaaccacacttaatgcaaaatatgccaaagctttgaacagggatatatgatttgtagtttcttgaaatctacatttatattttttgaaatggaagcatgtgtttttattatttgaaatggctccaaaatgtatgaggtcacttcgtgtcagcatagtttgccccagaaattagcgttgaatgaggctctattttactttattttagtttttagtattccaacaaaggaggttctgcataagagttgacaatcaagatatgctgttactaatgcttgttttttgcaccgactattttcaccttcttttcttctttaactttgcttatgtctttgtagttaccagatggacataatttgtatttttttaatcaaaatgaaggagaaactgagaagtgagtcatatatatcacttaatacatttcttcatgaatgttcatatatacttctagatctgattggttgatattcaatccccttatacttttatcaagcttatgtgtgtggatatgtccattttcattttttttgtggggaatatgccccttcaatttgtgatagtttctttcttatgtattttcagctttattgagatgtaccttaggccaccttttgcttccgaggaaataaaaattgatgattggattaaagttaggcaatgtggaataagatattacttgtctcttggggatcagaggattgtggacaaatactttattatccgtccaaaagctgagtttgaggtacacaagtgatcttattatcttgaaatttggggttttacatacaagtgtaatgtttggacgtaaccaaaaacaataagggtgtgctgatgtgttttgcatatgtacttttagtttccttgcatttctctgctactacatattcattgactacagtacaattcttactccatgttgcttttacctccttaaatattaatattttttatattctgatactttggggataaatcagctactattgcataatgtaaataaacctattcgacttttcatcatcatgaatccatttgtttctgatctatcatctatgaaattcttcaaactaattctatactgatgatagcgtgtaggatcgaataattttcctgcattgtagttgaagtgcagaaccatgcagt

SEQ ID NO: 32443 - DNA, 4085 bp, Oryza sativa
tttcaccttttcatataaagcatattgcagactgaggtgtatcagatcacccttctgcgacattgattagaagaattgtcttcaattcattcaattcattaacatacaatggagttatgtaggttgctggagttttaccaagaaaattttgaaattggagttgaaattgttttttttttaattcagttgagttatgtatttgcagtgaaattgactgatgcataatttatattgatcttggttgataagtttatagctatgtaaattttctacccttatcttttgaagtgaataatatgtttatgaattccaaatgatcttgttctgttctcgataaaacttctatgttgcaacctttaggtttattttgatgtttgttgtcattgaactttggaaaaaaaatgaatatgtaactggcttgcataatttagattgttgcagcagaagctagaaagctcggtataaaggggccatggattacgaagtcataccttgaaatgatcctagagagcaaaggtgcaacatttttgttttcatgttttttattttcaataatttctatccactaataagtttcatgttggttgtcaggggtcccacgacttaatacgccaccaccaatctcaaggaaattactgactgaaagtcaagaaaaaaaaattgttgcaccaaagccaattcgtgtttcgaccgaaaatgttgcaaattttgatgactttgcacaaccatggacgaggtctccacccaaaaagtttgaccaggagcctgttatgggaaaatggcagttcaatcaaggttttaaacttgtgctttcatttatgatttttgccttgcatattctgttctttaatgctaaaacaaagggcattttctcttgtcattggatatcatgtgcagcccattagggcccatagagtggtctgcctctctagggctggtggtactgtgcattaatagtacctacttggttaattttcgtgcgtggatagttcatgtcaggtggtcttattagagataaggttagacttataagttagttattttcttaatactagggataggtttcttaatggtcaagctaacacatctatatgacggggtttgtattttactcatcaagcaagtaataaacaagagtatttagtcttccccttctctcctgcccttgtggcgtggctgcctcaatggcaccgctgccacttgggtccagggatacacaactagaaataggcgcaagtgccctaatcccaaccatgcctattacggagtacattggaaaccatatttatttattattttttctgtagaaaatccattgaatatattcttacacttttgcagattcttcttcaggaagtaacatccagttagctccactgccagactcctatgacttagataggggtcttctcctatcagttcaagcaattcaggtaaatgaaaccacattctatttttttcatcacagttacgcattactgatctgtaacatattccattaattgttgtctttcaggcattgttggagaacaaaggatttcctgtcattgttgggattggtaataacatctttaccgttaataaagtagcagtagttttgtgtttactaagaccaagcatctgcttgctgtgaatgataaataactaaaacaactcactctactttgctggggcaacttaaaatcatttagtcagacatctgcaccagatatcccttgtgacaagtctcacttgcaatgactaccagtttcattaaagtgatatcagagcatctatatctccaaatttcacatgatccagtttttaatgtgctataatggtatgcttgctgtgcaaaaaagagtgcctgataggttgtgcctaatctattcctatacacctgttattttaggattaacttgtattacaattctctgtgggtttgttgtaccagttgctggggctacatgtcatgccttttttgtaatatatttaagttatggggcaattgcacgtttgacgctgttttgaaagctaactaccagtttgactattttctcaactttgcttatttgaccccgcttttcaaaaatgaacattagctatgaccctattctatcaggccaacctaacggtgttaacttaggggccaaatgccgtttatacccctgctcattttgagtatactctctgagtttttatttatttggcttagttttgtgtactcggtgtatgtgatgaaagttttaataaatttgacttggaattgacaaattgtgtgtgaatttgagttagatttgataacttaagcaaagatgactgaattttaataaaactttggaaatatattatccatccaattgcacgctgaagaaagaaaagcatatatgctatttcacatccaacaattgccccaagcaaatcacgaagctcaaatttgtgtcgaccccaaagcaaaaaaaaaaaaaagtgtgaaattaatacatgtaaaacaagagagattattcaatcagatcagcaaaacaagagcaaagcaacttccagatctagtagaacaaggtatagagaggaggtgtgggtagagcaagagcgagcaaggatgtgggccacatgagcgcctcacgcaggacctgtgcctccggctgagccaggcaagcgttgcacgcttccgtccacacggccacgcactccatccacacagcaagcgccggcccgcgcgtttccccatcagcgccgcaccatccgctgcttatccacgcatcgccaccaccgcctctacacgcgcccgcgccgctgctcctcttccctctgtgcgccggcgtcgccgctcctccttccgcgcgccggagctggccctccctcccttcctccctccacacggcagcagccgtcgccgcccatccctcctccctccacgcggcaacagccggcgccagctccgctgctcctcctgccacgtgctggagccgtccctccctcagcgcggcaaaagccggcgcgctgctcctccgcgaacaggcgccgccgcctgtccgcgcgccggcgctgcccctcccttcctctctctgtgcggcagaagccgccgccgctgctcctccatacgctggcgcccactgccgtccctctctttgcttgccagcaccgctgctcacctgctcctggtccctccacgcgccggccagccacgccaatgtgggataaaggttgggatgaggggtattttggtcagttcatgcgagtaaaattatttttttttctttttctaactgaaaccctaacggactagtaaaaacagggtcagatggtggcttcgcttttgaaaaacagggtcaaatgagcaaacctgaaaaagtagggtcaatttggtagttcggcttctaaatataagcaattgtcccttatttatggcgaacaaccatctattgtgaaaatgtgtgctaaagcagacaataaacataaatgggccttctggcagattactgagcgattatttgcgccccatctgtttttttactagtccatgtatgtgaatacaagaattcttctaagaattttatattgtatggaatagattgattctgtaataataattctgttaaacttgtgcaaaaatgatatgacccacacacccagcaaattacatttactgactatgctgtcgctgtttaagttgatacactgtttatttgtaggtggccctagtggatcaggcaagacaagtttagctcagaagatggccaatataattggttgtgaagttataagcttggagagttattataagcctgaacaagttagggattataaatatgatgagtatagctcattggatataggtttgcttactaaggtgattcctttttatattgattccttttctgtattatcatgtgaattacaaattcctgtgcataactactagaatcttaaatatttcaagcatgcttccaaatttctatcttgttctaaaagtcgatgcaaggcgccgcctaggcacttggtagctgccacgattaggcattagatagtgcattaggaggctaacctactttgggcgctattgtgttgctatttttctctatgtaatatgcttgataatttcttgg

SEQ ID NO: 32444 - DNA, 870 bp, Oryza sativa
ttggtggagtacattctcatcttattgcaagaatacagagagacaagaatcgtgcaggcttttctatttctcagagtgaaattatgactaccgtgtttccgctatttcagcaatacatagaaccacatcttatcgatgctcatgttggtacaagaaacatgaatttgacctatttgatatatatttatcatttatggctttccattatcatgtatttagtaacttgtttggactcacgcaatgttccttctccacgtgctttgcagcttaagattcaaaatgactttgaccctgtgctctctcctgaaagctcacttttcgtactaaaaagtaaaaaacaggtaagtttgagctttatattgttcatcttattattacgttggtgattatttatctatttttgtttcatgaataggtatcttatcaagacatattgaaagtactcgatgctagtaaagcctgcagctgtgtccagaattttactgatgtgtatctaagacttcctggcataccgttgagtggacagctgacagaaggcgagtgtattagggtccgaatatgtgaaggaagatttgcactgttaatacgagaggttagtttaccttttgcataccatttatctttgtgttttcatgagacagtcaatgacaggctacgtttttcctttgttcatttaatggtagcctataagggaaggaaattttattatccagccaaaggttgattttgacattagtgccagcactgtcgcaggacttcttaagcttgggtaagtgatatgctttatgatgttaattattaatttagctgattttctagaggtctttttattgagattgtatgttttatcaaaatgtgtaagtcattcta

SEQ ID NO: 32445 - DNA, 4315 bp, Oryza sativa
ttttaccattgttacaactatttaatcctcctgatgggcaactctatctcaatacttctgtgtccaacactaaatgatgaagtccctaacattcttttcatgaagtccctaacattacgtgtccaacactaaatgatcaaagaagttacctagttggatcaagtaggaactaattagttctgtataaatccctagcatttttttgatgaagtccctaacatttttttttatttatgaaatccctaacaactttacaaaacataatattgtggtttaactaatgtttgggcgaccctccaagaaacatcaaacttgataaataggtgtgattgtagattagtcattagtgactgtctgctgatactctgaaagataactttgatatataagaaaattttcatgcactagggcatatcttgaaatttgctcatatgcttacttccttttctaatagttaccgagctgtggcatatattgaagcttctgcaacgatttaccaagatggaaaggttattatttccatcaaatctatatttcttttcattctttctgtataataagttatgagtacatgcatttcatatgatcaatgtgtgatgtttctttatgaggctcagttcctttcagctactggttactagattatcatgggcccacttttcaaactgctaaagttgtcacagaataattgtatatctaccattcaaattttgtcccaaaaaaattgtatttgtaataaggtgatacccatccaattagttagaaggagatattctgccttctgccctcccatcattccttctccatctgcctcaacctttcttttgttctatgcatgtagggttattgtggccatttgtgtagaaatacaattattttgggacggaggtagtatatggaagttccttcaaaaatttaagcaaattcatttttcatgtttgtaatggttaaacttaattaatctagcactcattgggtgtcttcgctggtaagccaacgagctaattgctctaccatctgaatagaatgaagcgtaagtcttatagtaattgttgggcaagttattataaatgaaccatgggatgtgctgttataggtgcatttccttgaactgtgggtagtgtcccctcctccggtaaactcaaaaaggcaggatacaatctttgcgctgctgccgtagtttaaataatgtatctttggagacactctttgtctactttctgatgttttggctgatatggccaaaaaattgtcagcaagtgctgggcctgggctgctggctaatattttcctcaaagatattgatatatagaaatcatggaaaatttcacctagtttgatgcatttttatgaaattttagacatagtacctaccaaatattccttcagaaatttttgagtgcttcctctgtgtgtatggttggttctgatttatattgtgaaacagtcaaatgaatggagtttaagttactgttgttgactcactatatatagtataaaatgatgcggtttgaagtatttgtaaattaaaattgttttggttaacagttgtgcctcaacctgtactctacctgtattgatatctatgcagaaaactatagtccctctgtttttaaatatgacaccgttgactttttaagatacatttaactattcatcttattcaaaaaaatgtatgtaattattatttattttattgtgacttgatttatcgttaaatgttctttaagcatgacttaaatttttaatatttgcacaaaaaaattgaacaaaacgaatgatcaaacgttagtcaaaaagtcaacggcatcatatattaaaaaacggaggtagtagtattcatatctgttgaattgttgaaagaaaaagtttattcaatgaaagttctggtatgctttaggaatagtgacactcgttgtatatgaataaatttattatgtatgtttgggtcgatggaataatatttatttgcattggaataattttcaccacttttttttgagtgttctcatacttgttgggattaggacattgttgagtgttctcatacttactgggattaggagtcagatcaggacattgttgttcccagttgcacagaatttgaacagctaatatttttctgatttgaagctgctttatgataatgcctactttttccccatatttctcatttcataattgtaatatttttacagaagttagttaacattatgatgatgccagcggatttcctgtttttgcaattgtcattggttctggaaccactaacttctaaaacgtttgtttacttgattgaagattcttatagaggttgatagtctacaaggtgagacaaatccgtatcttcagattaaaggaacgaacaaggaaatagtttcctctgctgcatctgcactcagcttagatgattcatacacgacaaaggtctcctagaaaatcctagctagttaaattgattaatttgcacacacattattgcatatcagtttcatgattttattctgctctgcagagctatcttcaaattattctggagagtttgccagcggatgaaaatgttcatactggtattcataaccaacaagctgctaggctacaagaacttgttgagtttatccagtcacaagtatgttaattcaaaccaactagttgtaaatactactgttacattatgggatattttttatggctatgatttagggtagtcagaacataagtatttgttctttacaactgtttgtgggagaacatactagcaaattgccttttgtgttggacgcggttatgtttcgtagtgtggtcacctggtcggtggtttaaaataggccattgagcatggttgcttgattggttcaagtccatgtagcatgcttatccatacattatttaccaaacatcagacagttaacagatgattttccaaaggctgtatcatgtttaactgtagctattttcatctaaaaaaaatgtctattggtcctttaaaagaagttagtgtcagtggtagtatcttcctctccacatcttatacacttatttttatgaattcaatgttacttttattgtatgttgtaaatgtctccatcagctatatgtatgagtatgtgcatgtatgctatgacgtgcaccttcctatatcaaaaagttatgttacttttaatcatttaatgtatgctgtaaatgattccatcagctgtgtgactgcatgtcatgcgctagttttgatttgaggattctagttacttcgttttgtttagtttacaacttgtagtatacttattcgagattttcctcgacggaactgtaatagcagatgtgtttgtatgatcagattctatggctaattagctattgttctttcttaactttattctcatatattgaataattctgtggtgcagggaggtagcttcaattcagatttatcttcacctacaagagaagtttcttctacagatagtgtgcttgatgatgtgcaatctaggttaaggaggcttgagagatggaatacaattaatatggtaatttctctttattttcagatgctgttcaagacccatattctttctcaactgccttaagatttaattcagtttgcatgcgttggcattatgttcgattaaacaattaaatattgcatatcatggttcatcagttaaaaccccttgtgttctgcaggttttatggactatattactgtctgctcttgttggatactcactcttccagaaaaagacgacgctaaggcgctgacaattcatacatttgaccccaacttgacctcactagtgctgctttcagcactaatcctaataaggtttgttttcacgcaatacctgtgaccggtctttcagaaaatgtgctgtcgacatttactttgatcattttcaggacttttcgctctttgatgcgatgtgatgagaagaatcctcttgagttagcaggtggactgacttgttcaatcatgcatactacaggtaaccgcagttttagttgcaagttactaacgaaaaagaaaagatgtatatgatacagttgaatgtttgctacaaagtctattcttgggagggtaccggtttctactgagctttgatttgttgagtcccatgccacagttttcagaatggacttgtatcgatacgagtaccacatggttaattggcgatggaaaaacagatgggatatgttgcgtccgtaggaaccaggatcctctaacttattaccctctgacttaactataacttcaagtgactgatatatgagcctcagttcgtgggagaggctcatatatcaacccacatgagaggaaaaa

SEQ ID NO: 32446 - DNA, 3075 bp, Oryza sativa
aaatattgtggaactcacatgtcagtgagtcggttaccctctctctttgccatcttctctcccttcctcttctctcgcatcgtcggcgtcgtctgtggcgacaatggatgcacctgtcccgtcgaggcgagtgagagaggtggcaccaggagctgagctcgtgggcgcacacggtggcgtacttgaaccatggtgctaggtcggtgtacaacatgagcaggtgccacctcgctgcatccagggtggctccgccacgaccacccgctcctcctccccaatcccgcacctgtgtcaccgtagcgcacctggacgatgtggccatcgctcatggttagggatggcaacggggctgcgcccgtcgggtgcgaccaccccgtacccacccccgcagcagaaaaaatcgaacgccaccctccccatccccgcacacgagtgtagatttcccccgtccccgtccccgtccccgcaacgggtacggggcacccaccgggtctccacacacaacagcaacaaccacgacagcaagccgagcagcgcagaacaagaggaagcggcgtggtcgagcacgcagtgcgcctggggccgccggtcgtcgatctattggctggcatcgaggcgcaggtgcagcacggatggcggacaaaatggggtcgcggcaggcaggcaggcggcgcagtgcagaggcggcggcggcatgtccgcgtgtggactacagcgagatgagagaggaaagaggagaaacgaggaagggaggcggctggtcaggacttaggaatgagattagggttgcgttgatttttactggagagctcttctccgcatgggccttgggccaaacaatgcatgtgaaacgaaattctgatgggccacctattaaacaagaactgcatatcagccccatgggttaacgggtacgggggcaagataacggacctgcacccgctccacccgacgggtgacacttttgcccgctaagagacccatggggacaaaaactgaaccacaaacagcccctaatagagtaattacccgtcgggttccgggtttcggggcccattgtcatctctaatttaccccaactaacggcagcaaatatattcaataaaaccagtgaaatacacagagagagagagagagagcacattatacaatttgttaacagctttgtcattgatctttgatcgaagtctctacaagtaacaacaatatatattactccctccgtccaggtatataaggtattattgcctaaaatagcataaattaagaaagagtaagcagtacaactatgaagtttgaaaaagcatctttggcacaataaacaaagtagtactggtaagtagtactttcaagtacattctttgtaattttttaagtttttggcatggatggtactccctccgtcaaaaaaaaaaaagaaatttactggatgtgacatattctagtaaaacgaatctgaacaaatgtatgtagcactaggatgtgtcacatccagtactaagttggtttttttggacggaggaagaatgaagtagtagtagtaatatcagaccttttcagcaattgattgatgggtggctggcagtcctgattgctttgggaggagacaaatccactatgggtgtgtttagttccacgccaaaattaaaagtttgactaaaattgaaagtttgaagaaaaaagttgaaagtttatgtatgtaggaaagttttgatgtaatgaaaaagttggaagtttgaaaaagttaggaactaaaccaggcctatatttgtgggcatagctagggggcaaaatcccctatacttttagacagagggagtaaattttagttagttacatgcttcaaggccaaaaggctttaactcataaaactcataaaagttatatgtagatcataatattacgccgactgatgaacccctaaaattaattatgcaggttagattttgacttagtctaagctagatgtggatatatataaaagtttgggttatccgaagtgacacaaaggtaaaaattaccttagtacaaagtagacatatctatctatctatctattatatactaaaagtccattaaacttcctacaaacgctctcaagacgccacatgggattcctacaaacgctcctaaatcgtcacgtggcaatctaataaattggtggacccattatttcttactatttaatttatcaaatctatcttaacaaaaaaaacataacccacctccctatctttcctgcccggcccacacctacaaacgctcctagatcgtcacgtggcaatctaataaattggtggacccattatttcttactatttaatttatcaaatctatcttaacaaaaaaaacataacccacctccctatctttcctgcccggcccacaccttccaatgtgtaccgtacgacgtacgtaaggtacttacatgcctcctccctcccctcctgctctcccccttcttctttttctttagttattaaaatattaaaaaattaataaatttaaaataaccataatttataaaaaatgtggttaatttttaattacacataaaactttttattcttccgtattattctatccattgtggtccattaacgattcaaaaggcaatataatctgtaatttaacttgtaagaaatatttagtttttatcatatccatgctattaaaattattatataaaatagaaaaacatgataatgtatcatttcacaaaacatgcataaataaattagatctactatacgaaaaaataaaaaacttatccatcacatggtattctaataaattagagaaaaattctgaaaaaaaatatataaccatcagttttcatttaaaatggtggacccgataatattaaccattagataaaaaataaatctccttcacccttccctcctagccggtactaaaagtccattaaatttcctacaaacactcttaagccattatgtggctttctacgaacgctcatacatcgtcatgtgatgcgataaaaaattagagaattctaagaaaaaggtaaaacatctaatacttaaactctggattcgttattttggaccatta

SEQ ID NO: 32447 - DNA, 4693 bp, Oryza sativa
ctacaaacactcttaagccattatgtggctttctacgaacgctcatacatcgtcatgtgatgcgataaaaaattagagaattctaagaaaaaggtaaaacatctaatacttaaactctggattcgttattttggaccattagattattattagatccattaaaatataatctctcacttctaatatacatttctatacgagagaaaatacgtaagtactatccatctgaaagaagatcgaaataaaaaacataaaaaatcagaaaaattacagattgaaaagaaaaattaacagctaacatataaaacgtccaatccggtaaaatctgctcactgctcaagcatgtatatgcagcatctgttcttttttttcgtaagttgttgagagctaaagcatatataataaaatattaaaagcatttgatctatatcaccaattaaatatagacttctatggttacatttatcgatgtcctcttcatggagagttacatgcatgcgtgcatccttgcatgtattaacttttaaaaaatatatgttggttttatgctcaggttaattcttttattcctgacaatctacccatctatctatcaattatatactgaaagtccaataaacttcgtataaacggtactaatccaccgcatagcatctctataaacggttctaagccgccacatagcatctctataaacgcttttaagctgccacgtgacgctataataaatcacataaattctaagaaaaaaagcatttaactattgattttcatttattttggtagactattgttttatccattacatctatcttaaaaaactaccaattaaattatctctaaaagtccccacttcaaggtgcacataagtatgtacccacgccggtccgatgttcctctctttcatttttttttgtgaaatccaaaaggcaatacaccgttaaaaagtttgtactcagctcaaaagtatagttgggatttaaaattaaaattcaaagctcctttagattataggaaaaaaagtatgcgattgggattcctattgattgcatcttttgatttgcacgaatacattatagtaagtctgatgaaaaattcaaatcctatcgataccatgcaaaaataaacatagaaaagttaaagtccattaaacatcttatgaacactcttaaattcatacatgatactataataaattagataaaatcatagaaattatgagaaaaagataaaatattacatgtttagtagtccgggaaacgttctcactataaactagatgggtaccccgcacattgctgcgggagatttgtgtgataaaatagtagatatgagctgtagaaaaaaaaatcttatttactatatgattttctttcatgtgcttgtatattttgtactttgatcaattattgaaaagttataaatggttgagttgtatggtgtggcttttggggagaagaaatgcaatttgcacccttgatgaatcatccaagggctaaaaacaattaagatgatgtggcttcatgagagaagagagaattagcattagctgcacttagtgggatgaactttacagatatattggacaagggagtaccaatccgataagctatttagaaagctactaaaacgcttaaacgcttaatatgtatactatcaattataacttatgaggtatatccacactaccactatctgctaatccccaaatcatattgcttacgaggtatccatgcacggtgcacctaacgattagctgatatccaaaaagttgcggtatatctcaatggcaataaaattaataaaatagaaataagatgcatgcgcatgtttttttccttcgcatgggatcgagaaaatcaagctgctgatgcaaaggttgtttggttaactgcagtttatttatgcaatgaaagatgatgatttcatctatgtgggttaacaaattttaacattcatattattgctgtactctgtaaaaaattcgtttactgtccaaaattcatttattcgttgtttcacacatgcatttctaacatgtttctgacttatatatttttttcaatcatgtgttggaaagaaccttcaaattctttcaccgagagacaaaagtcatgatattcaaaatcctaataacaaaaattatgatagtttaaataagatgcccgcgcaactgcgcgggctaccttcctagttggataaaaaatggtcgaagctgaaattttagtaacaaaagttgatccaaaccataattcactatatatatatatttaaataaggggtattatttatacttctttgaaacagaggagtggtggtggtttcgccacccccaacctcaccaactgcctactatttgctatactatttttaaatgttggtaatagtggtgacactgaatctatcaccatcacgtgtttcacctttgtatggaccctataatgttggtgaaacttttttgcttctcctatgattaatcaaacagaaatagctctatgcctctactctagctaattcagtaagcatcaaaaactcatggtgaagtatagcttgataggtagatagttttaggatttaaaaatgaatgcaaaagtttattttctaaaaattcagtagtaacgcacgagcaaatcagctagtaacatacggggttagagagcttacatgtggtgaaattgtgggtaataaacagaatgcatcacatcgtggagatggttaacaactagcaaatataaacttactaccatgtattagcactttatgtctggtcccatctattttttaattgtagcatgactcatgtttgaagaatttttcagatgggtcccaccttattatctactttacacatatatatattgtggtgcctcttcatcctactattaccacatggcacgagtctaccttactacctagtttacaataaacattgaggatgtctaaagaaaaaaaaagtcatgggaccaaagaatcgacatgtcagtaataaatatatataaaaagaaaataatggcaacaacatactaacattacttctcttttacataaaattttgttgcaaaacacagtgacacggataaaaaggagtacaccataagtatataacctaacatagagttactttctccgtttcacaatgtaagttattttagcatttcctacattcgtattgatgttaatgaatctagatagatatatatgtctaaatttattaacattagcatgaatgtgggaaatgctagaatgacttacattgtgaaacggagggagtattagctagtcatcatttgttctcttcaccgaccgaccggttgggtcaacctttctatgtacgctcttatacacgatgtcgtcattatgtgattaacacaagaacgcttgttcgtccctcgcctacaatgaaaacagaaactacaggacgcaggtgactagctctgcgtgtcgccatggtcgcgacaccatgttattttcattaccacagaacaagcatttatatgcatatatatgcccgcattttgccattcatcctccacctctcgccgccaagcagcttcaacaacagcagaagggcagacgtgagaacgatatatacatatatccaacatgcagaggaagtcgagcggcggcggcggcggcggcagcggcatgtgcgacctgccgatggactgcatcgcgtgcattgcctcgctgacgtcgcccggcgacgcgtgccggctggcggcggcggccgcggcgctccggccggtggccgactcggatgacgtgtgggggagcttcctcccgccggagtgggccggcgacggcgacgccctggacggtaagccggggggccgcgagggggagagcaagaaggagatgttcctccgcctctgcgacttgcctgtccttctcgacggcggcaagctggtaatcaaaagccatttaattccttatctgcgttgtttgttaattctttttttttacctttggttccataattattgaagttttgaacacggtttggtcaaacatttataattttgactatcaataattttataaatatttagtttataaaggcacttgagcaatatatatagtagtactatataaaaataaaaatgtatttatttattctatataatataatagaaaaacatagttaaatatatattttagaaactatgtcattgttcaaaacattaggccatttccaatccaatgactagaatggtgtcatagcattaaataaactgccacctaggataaaaaatgaggtgacaagtgaataaatgaggaaagagaaggaaaccacgtcttgcatgggacatagtttctacacaacatccaagacatcatgtgagataagtagcattaaacttaagtatggaatagtgatgtttggaagagtagtgtctagtattagtttcttaattatgtgaagtttatggaaactatatctagtgtcttgggttgggaatagccttatggaaccaaaactagagggaggaagtactatgtactactattgcctcttttgtagggcctgttaagatcaatttgctgtggtaaatttttttggtaaaagttttggtggcaaaagatttggcattgaagtttgttagttggtgtctagatgacttagatgcatggtaaagttttaccattttactagtaaagacagatagagcaatgctcccaacgtattttttgg

SEQ ID NO: 32448 - DNA, 9862 bp, Oryza sativa
tctaagtcaaactttattaaatttgatcaagtttataaaaaaattagcaacatctaaaatattaaattaattttattaaatctagaattgaatatattttgataatatgtttgctttgttttagaaatactactatatattttctataaatttgattaaactaaaaaaagtcaaatgacctataatataaaatgaagggagtaatagactagttcataccagttttgccttcacactaacagtactgggcattcagttcactgatatccctgctctcattgcaccagagcttttcgttggagaagcgtagtggtgccaagaaatacatgatgcgagcaagagctctcggttttggatggagcggctatccctacggaggtctcgtctggatacaaaaccatccggattccaggtttgtggttggtgcacaaaaccaatgaagaaatcccacattatatgtgttatttttgcaaggctttacggaattaaatttagaaatatattgtttacctattttttatttaaattgttcggggtgtaattattttgggagaaatatattatcaatatcgcttcgcgaaaacgaggacgtggacagtacgtggcggcgcgagaccgagcggtcttgcgcagccataccgcgagaccccgctgaaccagtcggcgatcccggactgccatgccaattcatatggttaattaattagtgattaattatcatcataaatcaggtaattaatcactaattagacggcaccgttggacaagaagttcggtctcgttggttccttatgcgagaccgttcggtctcagctgtttcctcgcacaagaccgtgcggtctcgcatctttgccgtgcgagatcgcccgtgtcgttacgcctacatcatttttacgcaacggttatgcgaggtcgacggtatatttccgccaaaacatttacattccgaatatttataagaaaaaaacaaatcaacagtatgttttcaaatttaattctggctttatgtaaatatcatttactactatctccgtcccaaaatgtaacacctttggctatgaatctggacgcacggtcatccagattaatagctaaaaatgcttatatttgggacggagggagtacaaaatatcatgcatttccttcttgaatactaagagtattatcatccgtagaaatgatcttaagtgttgatttatgaattctgctatcagtagatatggtccatattgattagaaaatctagattggttctactaccacagaacattgtaaacatgtctttttttttgtcatgggatgtactccttgttgatttttctctcccataaatagcagacaacccttctgacgattatatgtccattattttcccttctttatttctaggttttctgaggtggccatcctctcccacttgtgttggttggacatctatggtatcttcaacacaaagcatctctcaaacggtacatcctacggagcttatcttgtgtacaatgtccaattcttgcacacagaagatcaaaatggaggctacaaagaacaagatgcaacagcatctgggtcatcatccacctccagcatttgcagtcatgaatgcaaccatcttatgccgcagaaacatctgcgctcactgttgttcaacatggattatgatggatcatcatttgtaaaaaccaacaataaccagaagaaagaactgaaatatgtaggcatttgtgtaagaagtgatggatggatggagcaggaaattagtacagagatatcagtggtaaaacagaacaatgaagagaatggagacatttctattgagtttaggggcttaaccggatcgcaccaatgccaaattattgtagaggggatcgaaattaggccgaaaaactaacggttctccagttcatggataatcatgtcagctttcctagttggcgcagacgccaaaaatcttgggtactttcttatatatcatgaaaggtttatatttgggtaatctttggaaataaaacagttgatgatctaaaagtagtggagtattcattttgatgatctctacctttctctcttctttgttcttccaccgctggagaagtgatcttcagatctagtttacaacgcctttagtcctaggttacaaaccgagactccgatgagcattttttaagtaccggttgaaataactgggactaaagattcatctttagtcacagttggtggtgctaccaactttagtccagattggtgttaccaaccgggactaaagttctttttctttctttttctattgttctttgctgcttgcatctattgattttgagccgaaatcaccgacgccgtcaccccaaatccccacaaatcatccacaatttataggcccatctataaaatcatccacaaatcactggcccatccacaaaatcttcccaaatctaaaaaaatctataataaaatctaaaaacaaatcagtcatagccagcagacgggggtgaggaggaggagggccccgcccggccgccgccgccgcctcctccaccgggctgccacccggccaccctcccatcctatcgcctcccctcccgccggatctggcagaggggaggccgccgcctcgtgcgccgttgcccgcctctcccgccggctcctctcccgcccgatccgacgcaagggagggtgtcgccgtggagatgggagagggagaggggaaggggaggaggggatcagacgagaggggagggggaggaggagtggaggaggaggagaagaaggcgtgaagaggggaggaggaggaggaggaggggataaggcgttgttgccgatgccgagataaggaagagagagagagggggagagagagtgagagatgccaatgacgtgggagagagatatctaatcccggttaccaaccgggattaaagatataattttttttgtcccggttggtaacgaaactagactaaagatggacttttgaaccaggactaaagatgaattagtcccagtttgttgaaaccgggactaatgtgattgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacctgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagttacttcaagaccatctcaatcgagttggcttcaaaccacttgggtgagatcgcatcttctccaacgtcaccagatcaagatgatggggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacatcgtggagtacgacgagtttagctctcgctacaacgacccggatctcgacgacttcgacggaagcctagatgacaactacacccctctctacttcggcgtcttcatggccgatgacgagacggaggagcaacgccaagcccgggagaccgaagcacgtcgcgagactgagcgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcaacagaatgcggttgccgcgatcaccctcctcgacacccttctcaaggaaaacgagctcaatcaatctgatcacgtcgtcaacatcttgaaccagacgaagaccatgattgcggcttcggtcccagttaactccgaaagcgtccatacgccgaccggcagccgagtcccccacttccgatctcatgactaccgtcatccaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagccgaagacgccgtcaccgcatcaaagcagtcgggtcccagttggaagccaaacaagggtacgccggctacgggaggaggtggaagtaacaaccataaggaccgcaagcgtaagcctgaggaacttgtcgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaaaaactctgacgaagaacaaagcacgtcgaggaagaaggacgacggcgacaccccggcaggatttcaagaccaccgcaaggagctcaaccatatcttcggcggccccctggcttatgagtctaaaaggaagcaaaagttgactgaacgggagatcaatgctgttcagcccgacacgccccagtatcttcgatggtcagaaattgcaatcaagtttgaccgctcggatcatcctgaccgagtggtccatccggggcggtaccccctggtactagacccagtggtccgtaatgtcaagcttcgcagaaccctcatcgacggtggcagtgcactcaatatcctcttcgctaagaccttggatgatatgcagatccctcgctccgagctaaaaccaagcaatgcgccttttcacggagtaattccaggattatccgcaactccactcggccagatcatcctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatctcaaaaagtggagaaagcgaagccaagactaaaaagattcccctagatccttctgattctactaaaactgctgtaataggtgccgagttagattgtaaataggaaagcgcgctcatcacctttcttcagaacaataaagatatctttgcgtggaaaccatctgatatgcccggtattcctagagaggtgattgagcactccttacatgtcaaacaagatgccaagcctatcaaacaacgactccgccgattcgcacaagacaggaaggacgcgatcaaggaggaattaaccaagctgttagcggcaggcttcattaaagaagtccttcatcccgactggctggcaaacccggttctagtacggaagaaaacggggcaatggcgcatgtgtgttgattatactgacctcaacaaatcttgccctaaagatccttttgggttgcctcgcattgaccaggtagtcgactcgaccgctggctgtgagcttctcagttttttggactgctactcggggtatcatcagatccgactgaaggaatccgactgcttgaagacttcattcatcacgccctttggagcatactgctacgtcaccatgccgttcggactaaaaaacgcaggagcaacttatcaacgtatgatccagagatgcttctcaacgcagatcggccgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgatttccagtggggacccgaagcacagaaggccttcgaagatttcaagaaactcctcaccgagccaccggtcttagcctcaccatacccgcaggagccgttgttgttgtatgtagcagccacctcccaggttgtgagcacagtcttggtcgttgagcgcgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaatggacggattgctaagtgggctttggagttgatgtctttggacatatcattcaagccccgaatttcaatcaagtcccaagcgttagctgattttgtcgccgaatggaccgagtgccaggaggatacccccgcggagaagatggagcactggaccatgcattttgacggatcaaaacgactttcgggcactggagcaggagtagttttgatttccccaactggagaaagattaagctatgtgctttggatacatttttcggcatcccacaacgttgccgagtatgaggcgctccttcatggactgcggattgcaatttccctagggataaagcgtctaatagttcgaggcgattcacagctggttgtcaaccaggttatgaaagagtggtcctgccttgacgacaatatgatggcatatcgacaagaggtacgcaaattggaagacaagttcgatggactcgagctcagtcacgttcttcgacacaacaatgaagccgccgacagacttgccaactttggatccaagcgcgaggtggcgccctccgatgttttcgtcgaacacctttatacgccgacagtacctcacaaagatactactcaagttgcgggcactcatgatgtagctatggttgaagccgattggcgagagcccctcatacgatttttgacttctcaagaactcccccaagataaagatgaagccgagcggatttcaaggcggagcaaactttacgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctctttgtggccattgataaattctccaagtggattgaagctaaaccggttgtcacaatcacagcagataacgctcgagacttcttcatcaacattgtgcatagatttggagtgcccaatcggatcatcactgataatggcagataattcactggcggagtttttaaagacttttgtgaagactttggaattaagatctgctatgcctcagtggtgcctcccatgagcaatggacaggtggagcgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtttatggggcagaagcaatgttgccgagtgaagttgaattcgagtctttgcgctttcgaaatttccgtgaagaacgctacgaagaggaccgagtggatgacttgcaccgattggaagaagtccgcgaaacggctttgattcagtcggctcgatacttacaagggctgcgacgttatcataatcgcaatgttcgatcccgtgcctttctagtcggcgacctggttttgaggaaaattcaaactacacaagatcggcacaagttatctcctctatgggaagggccatttatcatctctgaagtcacccgaccaggttcctatcgactcaagcgcgaagacggtacacttgtcgacaactcttggaacattgaacatcttcgtcgtttctacgcttaagcttatcattgtacttccctatcttgactgtcaacatcaagttttcttcttgacgttgtcagtcaggggctatcatcataataatggagtgtgattttttatcactttaatttgcttacttggtctatcattgccttgtttggtttttctacttagtctgcgaggactgaaagtttttaatagcttatttggttttaggctccaccaaagcttgataaaagcttttaagaaatcaa

SEQ ID NO: 32449 - DNA, 3043 bp, Oryza sativa
  unsure (1)..(3043): unsure at all n locations
attcctgcagcccatgcctccatttgctacatttatactcagtcagaatcaggcttttcatcatcagagttattactacttggctgaaggtcggtattgcggaattgatctacaacgtcacttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgatcaaaatctactgcattaaaaagagagaagttcagattgttagctggcagtaccttcaacctccttcaaggccgagtccctttgcgcagccagtcctaccttgtctctttccagggctttaatttgtttctccatttgagccattctggcggcttgcgctgtttgaaatccaaatggttgaggatacagttacgacagcgtaaattaatggggcagatctagagattaccttttgatgaaccactcagctcgaagtttgaatcctggagctgagcaattcggtcccttaattccttctctgtctttttggcgagctccttggcctcatgtagctgatccctaactgcttcaagagttcccaaatgaggaaccagcttttctaaagttacggtcttggcctcattgcgaagatggattctctgcatgatgattcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagtcacctttatgcgaggaatttcttcttcgtcatcgcctggtggtcctgatgtatttccaagacattagacaaataagctgaagttatttaaatcggcatcacttgagaagatgagttacttgaggatgttcctagctgagcgtggggagatccttgttctttatctggagacccgatcatcgagtcgttaccagcctccggttcttgagaagttgtcgtctgcgcttcaacttcgggagtttcttgatctagacctacatccgactggtttccagtcgggggctcttgggttgttgtagtttcagttgctgccgactggtttccagtcggaggctggtcactcggattggcattatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctggaagatgttctaatctttggccttggacgactagccagttttttcctgggagtggtatgctttgggagtttattgggcgagcctttgtccccagatttgttgccgtcatcaccttcgtcgtcattaagcaccagctttctcttgcgagaacttatctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaatatgaagacaagattatgttttggtcatgagttgaagatttcggatacgtacctgcggaggcagattgaatgcgttatatggcacaactggcagctgatgtgagtagctgacgacgatagcgtttgagaagattttatacattctctccttcatgattttaaaatccagagaatctggttcttcacgattaggatcatgattgccatcaaactcgaatgctgcacgggatctttctttaattggtgccagtcggcatttgatgaagtgccgagtaatctgctctccttgtaagccttgttctttgagttttagcatgcgatccatcagctccaaggcttgggctgcttcatccccaatcggaagcgagttccaggtatcttggtacaccggaggaagacaagagtactcgggaagagcaggctcaggattctgaatataaaaccagtttgcatgccaccctttgtttgaggtcttgaagggcatagagaaatacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtggactatggaatttgggtttaggtgatgcaagctgattccatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatt

SEQ ID NO: 32450 - DNA, 742 bp, Oryza sativa
ttcccccatttgtatccatccatcaactctattctccaacaacaaccactagcccaccctatcaatggtagtagtacaatggaacagagcattcaagcccaccatttgtcacgccattctgacctagtgacctgccattaaagcaagcaccctgcacgtatccaatccccacccctccaaaaaaaatccccaaaatcgaaggaacgtgcgggcacggacctggaggttacgagcgagggcgtcgaagtcgatggcgtcaacgtcgctgccgtcgtcggccccggccaccgtgcggtagtcctccatggagacgatcacgacgcaccccagcaccgacgccaccttctccgccaggctgcgcccggcacaaagtgcacaacaccaccaccaccaatcagcaacagcaaccagcgcgcggcgggaaggaggggagcggcccgtacctggtcttgccggagccggttggcccgccgatgccgacggtgacgacgaggccgtccttgcgctcacgcagctcctggatcgccttgacgaggaggtagaagccgcggtcgaaggactggggatggaatccaagccaagccagcacagcggattagaacagcaaaatggaggaaggatcgagaaggttggggagggggagttaccacgtggagggggagggactggaggatggaggaggcggcggcggcggaggcggaggcggaggtgggggagggaggggaggaggggtggtggagga

SEQ ID NO: 32451 - DNA, 12330 bp, Oryza sativa
ataaaaaatgctccaaataattaagttgtcacaacttcttaatttattgtatcaaaattggacctgccttaaagttattgtatttatacgatcacttataaagttcttatactaaattgcaccttcttgccaagtggttgcactagaacgctcattttttaaattattataccaaattacacccacctaccaagttgttgcactgtgagtgcaatttactcaaaaaactataatagactcagttgaaactcgtctttgccggattgccaagccacagggctaggatatcaaattaatccataccttagcaaaataaaagatgacacggtgtcttttgttttattttaacttcattagaatatgttttatattcagtaacgccggctatttctaattcaggatacatactctatgtcccattttggttctgattaaggtgcagattcttgaggccataatagtataaccagcgatggattagaactgaacttgaaaaagttaaggtttagcccgtcaaggatattatatgggatgctcaagctatagaacaatacaggtaaaggttttcatatatcttatatgtagtgtcgtgtgtatgaaaagcgaaatcaaatttggattggagtcaaatttccatatggcacactctaaattattttgtttatatattttcatgcgacgtcgccaactctcttggtgggcgtccacccgtgcgacatcgccgtggctgaaccagaaggccaccaggcaatcggcatcagacccggtgatgatgtctgctcgacaaccttagccgcgtgtaagttttttaaggctatatgtttgtagtgactatctatatatatttgttgacaaacaaatttgtcagatgtaaatatgatataatattagcgtaattacatgtaattataatttgtgaaattgtatataactttccaaatttctgtgataacatgttatttccgcgaagcggttgtcgtggaaccgaatcccctcacccataagtgtgcaatgatttttttcccttctcaaaattttgaaacaaatccgatttaaaattatatgaaagttatattatagttacaatataattacagaattatgttgtatttacatttgacaacgacaaatgtgcaaaatcgcttttgtattttttttccgctatatccacacaaacttcacaccgtttctgcaatgctgatatactaaagttctctgcatattggccgtttctgcagagcaggcggtagattatattgcgctggatgaatggatccaacgctggtatactgcatagtgcatacatattcttctctaacattactatggcaacttgtactgatgtgctttgacctaacattacatttgacaacgataaatgtatagcaaaatcgcttttgtatttttttccgctatatccacacaaacttctctgcatattggccctttctgcagagcaggcggcagattatatttgcactgaatccaacgctgatatactgcatacatattcttctctaacattgctacggcaacttgtactgatgtgctttgaggtaacattattttccgacattttcattgcgggatataatgaacgaacaacatgcatattaagaagctaacaattatcagttataataacaatatgtaatcaaactgtttcacgatccagattaataagcattgatattcaaattaagcgtggtcttcctctataggatcgatcttgcaaattactgcgattttacctttcttttgtttcttgaatagagagactcgaagccaattttctttcatctctggttgtttccattctctaggtaggatattgcactgcacccttctcagagtataagtccaaagccctggatgcaataggagagacagtccacgatcgtacacggctcaaaacggtccaaccgtgtacgttcgatgcttccatctgcaaggctataccgttctaagtttccacagtatccgaagtagatggtatcagcagcgacaaatggtaaggtctccgccgacacggagatcgcgcgggacatgctgatgaacagggcgcgccagttgaaaccctttaccgggacgaggatcccggcatcgaaatccaccctccacgcctcgtacttcctgctgcgctttgttctgtagctaccatcgtcatgagcataatggtctggccaaagcatccgctgcaccagaatcagctccccgcccttgtcaaccaagtgaagggtgctctgcaacgctcggctggaatggatcaatgaactctcaatcgccatccgcatctgcggcggcggtttccggcgatcatccgaagcgatatcgagctccattattcccctgtcggtggcgcggtagaagcgactgacgaatggcagagccgcgggggaggtgttgtacgtgctgttgttgttgtcgtctattaagttgcatgcaccagccagttgcacctagaagcctaagctgatagggaaaggcggacaattcactttatacactccaacactccccctcacgcgagaccccctcaagtctcaagcgtggaatattggagtgtgctgcaattattttatttaattgcgcgccagccaggatttgaactcgagacctctggctctgataccataaaagtgtgataggctcaacacgatagattggattatcacatatggtagagtacatataggcacatgccttccatatctagcaaccgatttatagaaacaatatcggagaagattaaggaaggatggcaagggataaacacaatctaacacccccgcagtcggaacgtcgtgggaacggacattcagactggaccgaaactccgagaagatggcactgggcaaccctttggtgaagatgtcggcaaactgtgacgtagtaggtacatgtagcactcgaacagatcccgcagcgacgcgatcgcgaacgaaatgtagatcgatcttcacatgcttagtacgctgatgttgcaccgggttagaagagagatagacagcactaatattgtcacagaaaaccaatgtggatcggctcggaggggtatggagctcatgaagaagctgtcgaagccagcaagtttcagccaccgcgttggccacggcacaatattctgcctcggcactggagcgcgatacagtaagctgacgtttggaggaccaggagaccaagttgtcgccaaggaacacaccataacccgaggtggatttcctggtgtctggacaacctgcccaatcagcatcagagtatgcactcatccaatcagcatcagagtatgcactcaagtcaacagtggaggagcggcggatgtgaagaccataatcaaccgtgccacggacataacgcaagatgcatttgagagcagcaagatgaggctcccgtggatcgtgcatgtgaagacagacctgctggacagcataagagatatctggcctggtgaaagtcaggtactagagggcgccagaaagactccgatagtccgtgggatcacgaactggggcaccatcagcggcagagagcttggcgttggtgtcaacaggggtagcacatggcttgcaatctgtcatgccagcacgctccagaacctcgaggcagtactggcgttgactgagatgaagaccagaggactgccgagaaatagagatgcccaagaaatgatgcaagctgccaagatccttcatcgagaactccgactggagagcacggatggtccaccgaagaagtgcatcagaggaggctgtcagaacaatgtcatcaacatagaggagcaagtaaaccgtgtctgagcctcgacggtagatgaacaaagatgtatctgattttgcctcaacaaagccgagtgtaaggagaaagctggcaaaccggctgtaccatgcccgtggggcctgcttgagaccatagagcgacttgttgagacggcacacaaggtcgggcttggtggggtcaacaaagccggcgggctgagtgcagtagactgtctcctgaagtgtcctatggaggaaggcattcttcacatccagctggtgaactggccaatcgcgggagaccgccaagctgaggacagtgcggactgtggcaggcttgatgacagggctgaaaatctcgtcgaagtcgatgccggggcgctgcgtgaagccgcgaaggacccagcgagccttgtacctgtccaggctgccgtcggactggaacttgtagcggaagatccacttgccggtgacgacattggcgccatttgggcgggggaccaagtcccatgtacggttggcctgcagcgcagtgaactcttcctccatggcggaccgccaattggggtcggccagtgcggcacgatatgtgcgcggaactggagagagagtggtggcactcaagttgtagcgcttgacgggttggtgaagtccgtgcttgccgcgtgtcgtcatggtgtgctcattgatgatgggagagatgccgagctgcgttggcaatcgaatgccggggacacgcgcactgcgggcgcgtgtggcagcaccagtcggtggtggtagcaggggagctcactcggtgggcgcgctggccaacgaagcaggcgtcggtaggggagccagctcgatgggcacgccggctgaccaggcaggcgcaagtaaagacagcccagtcggtgcgccagctgaccagggcgaccgaggggcaggcggtccggtcggcacaccagccgaccgagtaggagtgacggttgggcccgacggcccagcagtggttgagcgcaccgaagcctgtgcggggaagctgcgagcggccggcccagttggtggagtggccggcccagttggtggagcggccggccgagagcggctatgctcggtgagggccgtgggcgtgcaggccaccgggtcagtgtgaccagggcggcggcgactgccaatcggcgcagggagaggagctgaaaaatcctcaagaaacttcaagtcagtagcaactgcatcattagtcatctcagcaaaaggaaaacatgtgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcctctaactccatcttcagatcaaaagcactacacttctgaaaaagggggaataatagcaagactgagtacaaccaccgtactcagcaagccacaccaacgatgcagacgtgcaaggggatacaaggaggggtttgtggctatttgcataaaggcagttgtaaaatattttattgagcaaaacagtaaaactattgggtaattaaagtaacattaaaaactccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggctcgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccactattcagtcgcattttagttggataattacgaccatgaagcatggccagatgtctcgagcacgcagctcactctgatactaaaaaggtctaatactgtaattatcccatcaactgagctagtggtaaataagcatcgctaagcatatagttctagctgggtcaaataagtaacatgagctagtcgatttattacccaaggttgacaaatgatagatatcaagtaaacatggcacaagcgagcagataggtaaaccctgatcccgtgtaattagcaaaacatgcatatttatttgcaaacagtaaaagatttgtaaattaggatcaacatgctcaaggggaatgtgtgacttgccttgcttcttcaaacaatcttccgaactcttatccttgcgaccgcgatcttccgaaacgacgggaactacacgctggcacgcaaaacgaggaaaaactcttataaaaaccaagcaaacagtacataaaaagtaaacaaacatgtagagctcaattttagatgaattttgcaagtcgacccggtcggacggccaccggcggcggcagcgcgtcgcgaggacgcccgggaggcggccgacgaaggggaggaaaagggagagggaggggagtgctcaccgagatgcacgacggcaaaggggcggccgacggcaaggaacggtggcgacggggctcctcaggaagacgacgtgacggagctccggcgacgggcgtcgctcgggatggggcggacgggctcggcctcgatcggcgaccgaggaaggaggagctccggcggatttccggcgaagaggggcggcggccgaggtcctcctcgtccttgcggagctgagggaggcaacggcgcgggtcggcgtcgaccgaagcggcggcgcgacgcggctggagtcgggggcggcagcggagagaggtggttcgcgtggctacggcgctacggaggtggagaggggaaatggagcggtggccgagcttgcccgggcggcggcaaagctggcggtggcggcggagcagggcggcggcgaccctagtgacgggaaacggcggccggagttcgccggagtgtggcggcgcgcgggagcggcgtggggaagagcgagggagagagtgccgggcccgggaaacaaggggaaatggacgaggggagcacgggggtgctttttatgggctcgggaaggcgggatcgaggccggacgtggcggaatcggccggcgaagtggggcgccgacgtggggtggtggaggggttaaccggcgccgattttcgcggggagagtgggggaaaagtggaggaggtggaggggatcgattccacgcgctcgtggggcggggtgaagcgcgggaaccgcggcgtcgtggggcgaaaccggcggccatgacggccattggggtgacgggaggttagggaagaagatgacaggtgggacgagagagaggggaaaacgggcgagggaggtaaagcagacttgagggagagagagagccgagcgggccgagggaggaggccggcccgagagggagagaaaaggggcgcgcgggccgcgggagggaaggaagacttgggccgaaaaaggcccaaagagaggaagtggaattttaattgtttttttttattttaattgatgcaatgatctttgtgctattaaaactatttctcgagctccgaaaattcacggaaaattccggagagtacattagggcgcaaagaatattacaaaatattcccggccaatgatttttaaaggaaaatttcaaatttcctctataattccacttgattaaattggtttaacttttatttaatttctagaaaatgtattattaattgatttttattcccgaacgaaaatcggggcgttacaaatctaccccccttacaggaatctcgtcccgagattctgggatggctagaaagaaagctggagctggcgggcggtttgactgatcggacggatccgcatactgcactgccccctttctgtctcgaactgactgattgactgattgtccagacttgcacgactgaactgattgattcaacttttctgttcctttgctttgcaagactggactgactggttctacttcaactgacccagacagggctgtggatgcttaaggaacttacttatcttggactgaattgttgaggttagcaattttgataacctgacaattcaccatgctgactcgaagaggatgaagttgttcctgaagcttgcatctgacctttgtaactcattgatcctacgtccgcttgaacgggttctgactcgagtgacacgtaattccaggaaacctgcttgacctgtctttcgtctgaaccgcaactgtcctcactgttgcttctctaagctaagctgttgacctggcctcaccggtgtccctcagaattccatcaagtgacctaggaccggcgtaattctgcatgacaccttgcaattggctccttcaactgaaacagcgacgaggtgagccagaactcatctctgcgacctaccccccttacaggagtagtcatacatttcgcctgactgggaacaattgaactgctggcataactgtcccgcttctagcctgacttcggtgtcgtatgcctaaatagattgcatacccactgatcacttaacagatcaaactcaaaagtccttctcttgacatgacattacacttcgtcgatcgtcctttgctgactcttcctgggtttacggactataggccctgcaattgttttcccaaaaatactacaatctgaacgactgccggaaattgactttgatactgccgagagtttctgctttttgatcataaccacttcgctttcctatcttcggtaaagatgattcgttaaaagggattctatgccatataccctgctaactacacatttctggacttgactctgtatacttctgacccaggtatggaacaatttctttttcaacttctgagaaacattgagatgattcctggagcttatactggctgtcttgaactaaggaaaaatgtaattgatccatgatcgcaccactagggtgtaaatttccgcttaccatcctctaacggcttccaaggtttagaggagttcccaagattctttatatgatgtcactttcaaatattccatcactcttttcatccgaataccattgatactgcctttaaagagatctcatcatgttgggtgttgagcgtctaaccattttcaatctgctagttaaccattcctctatttgctcgcaaacaggttttggagcttcaacagaattgcgatgagttagaagagaaactcttggtttcttgtgacaccgacagattcacattttaacttgcttttgcatgctcaagatgaatcataaaagaagagaaactgactgactcaaactttattcaatattcccttttcattacataactgccataaacatctatgtacagagagaagtgctataaggttaaacacttgtagactgctgctgaacttgaaacgtagggggcttggctaggactgctattgcttccattattcgaacctaaccgacttgtttctttaattcctactggctgaagtctcaccgggaatgttgctctgcttgttgatcttcgatggtggagtaacaactctcttgacagctgcagcaggtaggaacttcttgctcgcggggttaccgagcggtgatttgccgatgggcctttggattggagcaatacgaggtgcattgctagagctgacaactgctgggtgacctggggctgacgaagcttgccgcgggtgctggcgaaggagtgtactgcctctttgtagctgtagcgagctattattctcctggcattgcttaccttgctggcgttggtgttgtaggcttgaaacgattgccggtggaacaatgcgacctttgacggtgcccttgacgataatccgttggggcggaggttgcacatttaggtgtcgattggtgtcatgggcagtgctggtaacttgtgaatcacgacgaactgcctttgctgctcttggaagagggcaatcactgaaacaatgtcctggcttacgacagttgcgacaggatcgacttgcttggtcccagggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcattcaactgacagtccttaggcacatgatctgttccttcacacaagaaacatgtgaccttccttaaagggcatgcatctgagtaatgggtatattcaccacagcggcatgtggggaggcataaactagcagtgtgtccgactatcccacatctagcacatgctttgaacttcaactctctttccctgaaactgtcaagggtcgcatcatcattctcatcattatcatcatcgttgtcgtcatcgtcatcagcagaaaaccgttctcctgattcatcatcttcgggtctgggcggaccgtactttatgagatgacgggttagctgacgcgctcctcggaaggtatttcttcctctctgacgcttgggtatccttgctgcgtcttcaggagtaaattctgaaccggtgatgatcatggtcctgccattatccatcttccatatcactgtcctgttcgctccagagttgggctgcaaagtaccatccttcttgtcggtagactgacttggagcttggttactccctgggcactgcttctcgtctttttcaggtgacctggcgaacaccttccatggacagttccttacataatgaccttgctcaccacagtcataacaggtagcacttactttcctttggtctgacgttgacttggctgtcgttatcttcgggaatctggacagcattttgacaggggtcttcggtgccgatattgggaactcctgactctgactctgattcgggttccgggctggcatctgatctcgcacctgcggtgggtgacattgacgtgactcctgacattgtcgttgcatctgttgcatctagtatatttggtaccgacgtcgcatctgttgtaacaactcttccactgtctgagtttgattagccatgacttggggttgaggctgaccttcaagaggctgacgtggaatactattagaattgcactgagttgccccatgaaactgacggggtcttgatccgatgaaattgtccctcatgcggaccatctgctgcaggcaatagagagatggggaaataggaggggttactagagaggaggtactaaaccacttgcctattgatctgttgtgaatggattttatgattcaagttgcttaagcaaacaacctagtatggtcgcatccccaccaatgatgcaaaccatacccctacacacaagcaaacaacacccgatctagcagctaacgatactactcttcagggaaagattgggtttaggaaaactccgggaaaacttcacttgactctgggctgatcttctcactctttgcacgaagcttgacttgacttccgaataggcgtgaagctgacggtttgtcctccaggtttaacaactatgaggattggagggactgggaggagaattttgaaaaaccgtttcataaagaaatgtcgaagggcgagaggagacaatttgcaaatagggtttttcagaaaacttgtccttagggtttgaccatttggctcaacctacagtcaagttggctctgataccactttgtcacgcccagaaatttaacccaaatttctagactattttgcgtattaaatctctgtccaggaccagccagggtacagaaaacgacaagtaatatacagttccaaacgtaaataaagcgtaaaatacttacggaagaggcacttagtcctcacaccgaaacagaacgacagcagcggaaaaaggcgatcctagcggggtttcagctccactccacagtcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaagggatacaaggaggggtttgtggctatttgcataaaggcagttgtaaaacattttattgagcaaaacagtaaaactgttgggtaattaaagtaacattaaaaa

SEQ ID NO: 32452 - DNA, 4314 bp, Oryza sativa
ttccgaactcttattcttgcgaccgcgatcttccgaaacgtcgggaactacacggtggcacgcaaaaccgaggaaaaactctaataaaaaccaagcaaactgtcacatcctgattttcgtttcaggatttataaattatttaataaattattaatagaatttttgttaaatgttctttaatttacaagtgaagtaaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaagagcttttcttgtttaaaaatccttaaattataaattgttgtttaaaaggaattattagaaatgattttaaaagcttataagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagccggcccaaaacctctcttctctccctcctcggcccagccggcccagtccgcagccgcgcgcgcgcgttcggtcgctgacaggtgggccccgcttgtcggatccgtcttcctcgcgtcgccgccgccgcccgcgaaccctagcgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgccgccgttcgtctagccgtgcgccgccgtcgctacggtcgtcgtcgtcactcgggaaggccaccgtcgggatcgccaagtcgccgccgtccccgtccgccgcttcgccgtcgctgttgaccgccggagcgccgtcgccgtcgtcaagccgaagagcttcgccgcttcctcctcgtcgccggcgtcgtccgttgcttttccgccgttcctttggtcaccggtgagttcgccttgtcgtccgcttcatcccggtgctttccgttcgcgccgccgcgccgccgttcgccggcgagcgtgtgagcccgagccgccgagccgccgccgccggtggtgacgtcatcgctgacgtcatcggagtcgtccgccgtgagccgccgtggacccgatcgatctcggccgtccgttttggattggttcgatctcggccgtccgttcgcgtgaaccgccgcccgtgcgcccggtccaccgaaaccctagccgctgacgcaataatccccttttccttttcaaaaataattcattattgcgtcataattcaatttaaaccgatttaagtgttttaatccgatttaatctttaaaaattcatatctaattcatcttaactcagtttaatgtggttcaagttgcaaaagttgtttaaaataaagatctacatattaaaattgtccataaattgaattaaatttatttaattctttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagctatgattgcttagccatgcttagaaacattagcacatatttgggataactaatgtttcactatcacttatggttatatttaatggtagctcacgatggtcaaccgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggagcaccagactgagaagtggcggaaataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcggtttagttaatttgatgaatctgtatattaaattgtcagtttgtgtacctcggctgattcctggacgaggatttcatgcacaaataagttcggaaattactagtgaatttctgggcgtgacacaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattattatttatttttacagaggaaatggacctcgctgacatcagcaaaggggcggccagcgccgacacgcgggccccacatgtcagcgagtcaaagggggagggcgcacggtggacatggtccacacgtggcctcgggtgcgcgtccaccacgtggatggcccagatcggcctgagccgatcgggcggccgaggggagcggcagccaggggcacaggcgcggcacgaagccggcccggccgagccaaggcgcggcggcggcaagggggaggcggcaaccggctgcccggcaccaccggcaacggcgcgggcacggagcgcggagcgcggcggcagcgacccggtcggacggccaccggcggcggcagcgcgtcgcgaggacgcccgggaagcggccaacgaaggggaggaaaagggagagggaggggagtgctcaccgagatgcacgacggcaaaggggcggccgacggcaaggaacggtggcgacggggctcctcaggaagacgacgcgacggagctccggcgacgggcgtcgctcgggatggggcggacgggctcggcctcgatcggcgaccgaggaaggaggagctccggcggatttccggcgaagaggggcggcggccgaggtccttctcgtccttgcggagct

SEQ ID NO: 32453 - DNA, 5242 bp, Oryza sativa
agagaggaagtggaattttaattgtttttttttattttaattgatgcaatgatctttgtgctattaaaactatttctcgagctccgaaaattcacggaaaattctggagagtacattagggcgcaaagaatattacaaaatattcccgaccaatgatttttaaaggaaaatttcaaatttcctctataattccacttgattaaattggtttaacttttatttaatttctagaaaatgtattattaattgatttttattcccgaacgaaaatcggggcgttacaacatgtctcatcgaacaccacatgtcgcgaggtgatgaccttgttggtggtaaggtctagacaccgataccctttatggtggagggatagcctaggaacacacatggggtggatcgtggggctagtttatggggagcggtggcgaagaggttaggataacacttatagccgaacacgcggaggtgggagtaggacgggtgagcaccatatagggcaaaaaagggggtgtggtgttgaagagttttggtgggatgacggttgataaggtgtgtggtggtgtgaagggcctcgacctagtagggagcgggaaggttggcttggaagagcaaggagcgggtgatgttgttcaaggaacgaagcatgcgctcggccttaccattctgtggggaggtgtgagggcaggacatccgcaaggagactccattggtgaggaaaaaggagcgggcggaggaattgtcaaactccctaccattgtcacattggatgctgtgaatggtcgtggcaaactgtgtcttcacaaaggcaaaaaaatgagataatgtggagaatgtgtcggatttaaagcgaagtggaaaggtccacacataatgtgagcaatcatcaagaatgacaagataatacttaaaaccagacacactaggaataggtgatgtccacaaatcacaatgcactaaatcaaaatttgccttggcccgactagagctagtgggaaaaggaagacgaacatgacgacctaactgagaagcatgacataaagatgtagtgactttaggtggtgggatgacagatgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagaaacgggagctaagccttgacttgaactgcagcgggaacaccactccacaggcatcctcgacggcacggacgaagcctactcctcggagaacccgccatcggacacatactcgagctctgaggttgggggaaaagtagagcaagactgagtactacccactgtactcagcaagtcataccggaataggggtatgatgcagggaattaacaaagaagagctagagtggttcatttgcataaaaactagcatttataaacaggaattgaatgcgaaaacggttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccactgtgtgctagttgaactaagcatggctaagcaattcctagtccaaagtctaatcatgttataacccaagctaacaaaggagcatgatatccaaaagcatggctgtaacaataggtatccatcccatagtaatattataaaacaatgcaatatttgaaagaaaacaatagagcatttgcaatataggatcaacatgttcaaatgacaagcatgacttgccttgctctgctgctggagggacctcggcgactatctcgaagtacactggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgagggggcgcggcgccgacatgcggggcccaccggtcagcgaccgggagagagagaaagggggtggcggcgcgcgggcccactggtcagtggcacggggaaaaggaggggcggcggcgccacgtggcggccgaaccgacggcgacggggacctcgcggccggggcgcgcggtaaatgcggccgccggcgcggctcggcatcaaagccgaccggccggctgggttaaacggcgacggcacgcgtgcgacgacggcggctaccggcggcacgggaaacggcggcggcagtcgaaggcgacggccgacgactcgaagcggcggctagcggctctaggaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccagccatctcgggcgcgggcgcgagcgggagagagaggggaacgggcgcggggaatgcggcgcacgcgcgggcgtggtcgacgtggcccggagaaggcggagacgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaaggaggggaatgggccggcggcccatccgaaaagaaaaaggaggaaaaagggagggaaaagaaaaagaagaaaaggattttccctggaattaacaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacaacagacgcctacgccaagtgggtgagggcctcatgaccgaggtggccaaggtggcgatgccataggtcggtgttggtggaggaggcgacaaaggcacgagtggaggccgccgaggagtacgcatctgccgggagaggataaagagcacaggaactattgcacctgacgatctcgatcttggttgggtaatccttcacagagaggccaaaagggtcaagttcaacggaacaccaattatcacaagtaaaacggcgtgcggaaataaggctcttaataatctcaggagaaatgagaacattgttaagcacaaaggaagaattggggtaatgtaaatatgcgtgaccaacggaggtaatagggagaagggagctattgccaacaatagtatgagagggagtattgcgggtggggctttgggaagtggagagggtaccggtgtcagacgtcatatgagaagtagcacctgagtccatgtaccattcattggacggtggagtagttaatgtggccgtgttgtacgcgttggcgagggcccgtgggtcccactgtgagggccccgtccactggaatggagattgcacagcggcaacaagagttggaggcgccgtgcttggtgcagtgtactgggccggcctaggaagagccatataggccggcgggaggaaggcttgctgctgggccggcgcgggcgtggtggtgaaggctgtcccggcgaagctaggccgcgcgccaaggaggcctggaccggccacatgtggatgctccttgtccacgggttgtaggccgtgggccaggcctggttgacccgtggtgcagtctgtgccagacggagcatgccgtcgccgtgggagagagcacctcctgcataagagtagaggagatggagccgtagagccagctgaggacgacgcagtccatctgtgtccagtcggcgtgatcagggcgaggtacgtcggagaagacatgatcggtgagggcgtattttccaagcgcgacgaggaaaaggccttgccagcgggagtagttg

SEQ ID NO: 32454 - DNA, 16017 bp, Oryza sativa
agggagccttgaagaaggagcggacggcgtcgccgatgattttaatggtgtcatcaaggacggcgtcaacagtgagggaggagggagaagccatggcggcggcagggtgcgccgaccggcggctggggtggagaggaggtggaagcgagaaggaacctaatctgataccatgaattattaccagtgatagcatcatttattatggtgagtagtgtgagactaatcacgaaagacattgttagaccccgcccataaccgcgggcacggctattcgaatagttttactctggccagaggtgtaccactgtacccacaagacacagccccacgacatgtcaccatgcgcctcaataccaccacggtacctctgaaaggagttgtgacagtacccctcgcacaacacaatccaccacagcgcaccgttcctggatcataatcacccccttataaacaaggcatggactccccagcgacccccgtgggcttatctccgccacttctcagtctggtgccccgcaatgaaccatgctatacaaaaggtaaagtcgttgcctatgctggcttgtggttggcacggttaatgtttcacaaccgaaactcgtgaactggtccttaattgtcatgagcacgaccaacaaaaccatgtgctcacaacccaccattatcaggttttagttggcacattaattaattaaccaatcacgattagccatcgtgagctatgattaaatatccatcattaggtaatagtgaaacattagttatcccaatcgtgtgctactgtttctaagcatgcctaagcaattatatctaatatatctagctgaaccaatatataaagctcaactagtcaaattgtaacccaaggtatcaaaggacagagtaatcaatgcaaagtggccataacaaaggtatagtttcacaccacccggtgacattcgaaaataaatgcacagttgaaataaatagagaatttaaatataggatcaacatgttcaaaggaattgtgtttgggatctgtgtaacttgccttgcaataaatggtcttcaattaatcttcttgaatactcccgacgcactcacggactttcgaaacgatggaaacgacaagctaacacgcaaaacgtggaaaaagactaagaaactccaaataaacagtacatataaagtaaacaaacatgtagatcatgattttagattaattatgagacttgaacggcctcattccgatttcatatgaactagttacgaattttataagatttaattccaattaaacctattaaagaaaaagactattccacattaattaaatcatttacaaatgatttataactgagataaaacattaaagcaacctctggaaatagattagattatatttggtagatgatatatattaaaaagaaataatatgccactgaaaagagagaacatatttatatcgattttggagggctaagattaatcttgacatagagttgaccaagattcaacggatggcttagattgatctggcagcgagcctcacgagataccgactcaacgagtcaattctacgtgacacgggattacccaaatgatcaaccgaaaccggcgaacggaaccggcggctctaaacggctctaaactaaaggacgactcaacacggacaaacgaacgaagcacgggtaacacctcgttcgaacgaacgagcgaacgactcaacaatggctgcggctaaaccggtgggctagaaacgattcacggtaaagccccggtacggcaaacgataggccggtaggaatttagggatgcacctacggctagacaacttgactaccgagcaacggttaaagcggcggctaggttaaagcggcacacagctgcgacacggcggcactagggcgacttggctcggccaggcggcggtgactcggcggagacacgcggctcgggttagggcgacatcacagcgacgacgacacacagcgacggcagatggtggctacggtagcgggacggcagcgacttgtcacgcacgagcagcagcagcacggctgtagcagggagcggcacagcgacgactaggcggctagtgcagtggcgacgctagggcagcagctaagcgtggcacggcggcggctactcgacgacacaaacgagagattaaaaactaaaccgagggaacacggatagacgtctcaccgaaccaaagcgatcggagaggaatagatgacgacggtgaaccggcggcaacacatggagacgacgacgacgccatttattatggtaccaacttgtcacgcccagaaattcactagtaatttccgaactaatttgtgcataaaaccctcgtccaggaatcagccgaggtacacaagctgacaatttaatatacagattcatcaataatacaacgttacatacttacaaatgaaaagagaaaatagcagcggaataacgatctagcgaagctccggctccactgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaagataaaacgagctagccttggaagcttgacttcagcagcgggcgactccactccataggcaaaccttgacggcagcgacgaaaccaacccctctgagacagctccaactgagaagaacttcaactctggtgtgggggaaaagagagcaagactgagtactacccactgtactcagcaagtcataccggaagaggaggtatgatgcaggatataaccaaaggaggctaggggttcttttgcataaaactagcatttaaaagcagtagttgaaagcagtaaaacaactgtagtaattaatcaatattaaccaatcactgtccaacgctacaccacgttgcaacaggcccaaccaaccacctgaactacactagttcattaagctaaactaggggtgagactaatcacggtgaatctggttgatcgcccataaccgcgggcacggctattcgaatagttttactctgtccagagatgtacaactgtacccacaagacacgattccacacatgtcaccatgccccgaagtatcaccataatactgcaaagggggaaatcgtgacaagaccctccgcataaccctcccctaaccatccacaccacgctaaggtttcacctccacccccaacgggcagtgggcggtcccctcttgcgccgcggtgaatctggcagctggacaaccggacaccctggccgacccaactccattacgcccaccctcgccaccggtgcctaggaaagggtcgagctatacttcagatcaagcagttacccactctcgcttgtggtaagcacggtaagtctcccagggtttcccgtgaaccggtctttaattgccatgggtgcgaccagcaaaaccatgcacccacagcccaccattcagtgtattttaattaactaacaccattgcggtggcaccaatccaaaactatgctcatagtcaaagtctatgtaataatgtgatccccatttgtgtactagtggagctaagcatggctaagcatttcctaaaccaacatctaatcattttgatacccaagttattaatggcatatggtaaacaataaatggctgagtaataggacccatcccatatgacattgtaaaagaatgcgacatttaatagaaatgcgggatatttgtaaattgggtacaatatgatcaattgtaatgcatgacttgcgttgctctcgcactgatgagacctcagcaacgtcttcgagaaaccgcggatcgacgaaacggccgaaatctacgcgacaaacaaagtacacaagcaaaacatgctataagactaatgaaacaggaaacaaaaccatttttaatggattctttgcatttttatgaatttactgagacttgaatggacttaaacggagctcggatgaattacttatgaattttagaagataaaactgtgtttttactaataaagaaaaagtccttaatcaatttattgcgcaataatacccagggctgacgtcagccaaggaggggggcggcgccggcaagtgggccccatgggtcagcggctctaaaagggggggaggtggcgacggcacgcgggccccaccggcagcggctaaaaggggggtccaccagctggtgggccccaccgggcagcggcacaagaggagaggaagggtgcccggttggctcggctcggcttcgaagccgaccggcggccatggcgaccggcggcggcgcgcgagcgccggcaacaacaagcggcggtgcgggaggcggcggcggacggcgcacaggctggcggcggcggccgaaggcgatggcgagcacagagagctgcggcgcgtgcggcacatagggaaggagggaggaggggagtcctcaccagaggaggcggtggcggccggcgacgaccggcgacacggacggcggacgggtggcggcggcacctagagaaggggaggtgaggggttaggagtagggagagcgaccacggcggccaaagtggccggccggagatggatgaaaatggagagctcaccggcgacgcgagggaatcggagctccggcggtgatttgcggcaacgaagcggcggccgaggtgcgggcgggctcggtgagcgcgacggcagcgactgcgcggcgcggtggtggctatagtggcggcggcgcgtggccggagacggcggtaggcggcggcgcaaggggcgagcggcgcggcgaggataggaagcacggaagggcgcagcgagtgcgaaaaacgagagagggggacgcggggagcgatttataggtgcgggagggggcggacgtggccggggaggtggccgatttggccggcgacgtgggggtggagagagagagaatggggggattcaaattcgaatcccgcccctagcgagcgcgcgcgcgggccgggagatgcgggggagagggcggcgacgtggggaggacgcgggagcgacgcggcgtgggcacgggaggagcggaggaggcggcggcgcggcggtttcggcggcagcggttggagctccggctccaacggccggaggtgggagacgaccgacaggtggggcccacctatcggcgtcccagagagaggagggaggggcgcatgggctgacccaacaagaggaaggccgagcgcgggtaggagaaaaagggggggtggactgggccgacggcccaaaaagatggaaaaagaggaaaagaaaagcgaaaaagggaaaaaggggaaaggatttttcctgggatttaaaattgcactttggtgatttttaattggttaaaattatttccaaggctctgaaaatttcactaaaaatcaatcctgttaatgtattgtgacatgtggaactcaaggaaaatcccacattgccaattccaattattaaatgcctttattaattagggatttagctctaggttaattaagacaatttcttcggacgatttatttaacaaatttttaaagcaaggaaaaagggggaaacttcagggcgtgacatccactaccacaagtagctcaactggggtacaagccaaacgtcttctccttcgcaacttgtcttcaactgaggttcgattgattattgcaatgtgggcatatgacatactcagcaagccacacaacaaatatgcaagtgcacaaggataccaaagaatggcataatatatagctcatttgcaaaagcagcatttagcaaaacatttgagaattctaaaacagtagagtaattaatcatcaatattaattaacactgaactgcacacccatgctgcacaggcccaaccatcctgaacaactatacacggctgtacagatctatctctaaaccaggaatgtaccattccaaaccaggagctaaattaattaccatcaattaccacattattattaatgagtagtgtgagactaatcacgaaagacattgttagacccgcccataaccgcgggcacggctattcgaatagttttactctggccagaggtgtaccactgtacccacaagacacaactccataatatgtcaccatatcatcatgtgcccatgctgaacatgtcaccatttgtgtagttgtgacaagacccctcgcatagctcaactcaaagcagcgcacctttcctggatcgtagtcaccccctcaaaaaccaaaggcatagactccccagcgacccccgtgggcttatctccgccacttctcagtctggcacaccacaatgagccttgctatacaaagtgtccagccgttgcctatgctggcttgtgtttggcacggttaatgtttcacaaccgaaactcgtgaaccggtccttaattgtcatgagcacgaccatcaaaatcatgtgctcacaacccaccattatcaagttttagttggcacattaattaattaaccaatcattaagtaatagcaaaacattagttatcattaagtaaatgtgaaacattagttatcccaatagtgtgctaatgtttctaaacatggctaagcaattatatctaatgtatctagttgaaccaatatataaatacaactagtcaaattataccccgaggtaatcaagaaataggataatcaatgtaaattggccataacaaagaaataggttcacaccacccggtgacattcgaaaatagatgtatacttgaaataaatagagaatttaaatataggatcaacatgctcaaaggaattgtgtttgggatctatgtgacttgccttgcaatattcggtcttcaattaatcttcttgaacacttccgacgcactcacgatccttcgaaacgacaagctaacacataaaacaaggaaaaagactaataaaaaccaaataaacaatacatataaagtaaataaacatgtagatcatgattttagatgaattatgagacttgaacggcctcattccgatttcatataaattacttatgaattttataagatttaattccaattaaacctattaaagaaaaaactattccaaattaattaaacaatttacaaatgatttataattaagaaaagattaaagcaacattcagaaaagattaggttatatttagtagatggcatatattaaaaagaaataatatgccactgaaaaaagagaacggatagaagtctcaccgaaccaaagcgatcagagagaaagggtcgacaatgacggtccggctacaacacacggagatgacaacgctagacaaatcacggattagattatgttggattaagaccctagggaaaaacctacaccggtgaacggcataggggcagcggttgccggcgaaccacggcacaataatgcaaacggagggcaccgggaggaagagcacgagacgacggtccttaccaacacttacgcgatgacggacagcgacggaagatggccggcgacgagcttcgaagggcggcgaggtactgtccacggcggcgacgactttccggcgatgtgcggcaacaacggaggggtggccgggcttcacttcgcagctgcgaatccaatggaggcgacggcaaagcttggcgacgacggaaggagcagcagtggcctcgccggagatcaaaatgcggcggcgagcttcgggttgacagtgtcagcggcgctctggcgatcttcggcggaaacggaggacgggacgaggacggcgacgacctcgcgatgctgatgaaggagacggcgaccgacggcgacgaccgaagcgacggctaggggcggctggagcggcgccggcgcttggagagagaagaagagcgcggggagagcgattccgacgacggcggaagatggaacttgaggggataggtagaggacgacgagggggtcctttatataggcacaggagctcgggttcgggcccaaatcgacgggaaaaactcgggaaagtttaggatcttcgccggaaaaaggaaagattgatccgcgaaattggaaaggatttccatagaaattttggggatttcttggggaaaaggaagaggagattgagaggattccattcccacaactaatttggaaaaaggagcaacggagaggccggatttggaaggaggaggcggcggcaactgtgcacgggctggagacagtcggctctgtctaggggttgaagacaacactgtagcgagagggacgaaaagcagacttgtctgcgggctgagaggaagggagagaatgggctgaaaagggcccaagctgaggatgaagattttattacttttccaaataaattaaccaataagatgatctttcgattgttaaaaatacttccaatggtcaaataattccaagaaaaatcttgaacatacttggacaccctaagtatttaaaaacattgaaaccagctcattaatgattaatttaatatgtgaataattactgaaatgttctttgtattattaaaattaataattgagctccgaaaaatccgagaaaatttcagagagtataattaatcatggagaatttaataaaaattaaatccacccatgctttataattaggaaatttgatttcccacatttcacttcacttgtaaattaatgaacatttaatataaattctattaataatttattaaataatttataaatcttgaaacgaaaattcaggctgtgacaaatctaccccccttacaaagaatctcgtcccgagattcggaacggctagaaagaaaagggcataggtaaactgcagtctatcttattccataagtctgataattattctaaggctttaaagaaaactactactgctttgaaactggtggttgagctgtaacacttgaagacgcaacttgcactgcattggctcctgtgacgacaatgttgttgacttgaccttgcggctgctgatgctttggcttcgaacactctcttgcaaagtgacatggcttgtaacagttgaaacatacctgctgctcccttccattccactactattattttcttgagactggttctgctgaactggcactgattgagtagcttgcttgatgttaacttcattgcttgcattagtctctgaattgatctcatcaccgatgttcaactgttgcgactgttcttgagatgttagacttgattcatcaacttgggattgcttgatacactgcctttggctagtaccctgtgcttccttgaaaacaatcagtcttctcttacggttgtccatcctgttcttcttgacttcaagtcaaattgctttgtcaaccagctcttggaaatcagcatagtcatgagaaatcaacgtaattgatagttcatccttcaggccttctaagaacttctcctgcctttccttgtcagtacgcacatcttctggaacataacgtgctagacggttgaactcatgaagatactctgtcacggtacgatccttttgctttaatgtcctgaactcacgcttcttcaaagcaactactcctgtaggtatgtgtgtcttcttgaatccttcagtaaactcttcccaagtgattggttgtccttctgctctgttcatccggaagtgatcccaccattctgaagcaggtctatgcaactgatgtgaagcgaaaacaactttctcctgatctgtgcactggagcaattccaacctcttctcaatagtgtatagccaatcacctacttccactgggttggtggtgctagaaaaggtaggcggcctcacacgaagaaaagtcagctaacttgttctgtggcgttggaggattgtcgttcccttggttgagctggttctgcatctgctgcatcattatgttcattaactgagtctgttgagctagaacttgagcaagagttgggttctcatcattgttattgtttccacttccactagcgcaagtgttcaccatctgctataggtttggagaagatagaaggagaggggtgacactaaagacaagaccttaaccatgttaacattgatctagtgtgtgtaaaccattatattgtttaagttgattaagcaagcaacctaatatagttacacgctcatcattgaactacaccaatgatgggaatgcaaccttacctacacacaagcaagcaacaaacgttctaccctactaactattcttcaaagtcaatttggtggtttaggttctaagctaggatccaaacttcattccatcttgacagctggacactttagttcgaccatcatcttcatgtccctcgatccacttgacttggcctccataagtagaccccatcgacatctttgtcgtcacaggagccaatgtagtgccagttgcatcttcaagtgttacagctcagccaccagtctcaaagcagcagtagttttctttaaagccttagaataattatcatagttatggaataagatagactgcagttgaccaatgcccttttctttctagccgttccgaatctcgggacgagattctttgtaaggggtgagggtgtaacatcccggtctagggcttaataggattactagaatactcatatcaacaaattgcaacttctttttcggaagccgatctctaaagaactctgaggttaagcgtgcttggtctggagcaatttaaggatgggtgaccgaccagaaaattcttcccgagtgcgcatgagtgaggacaaagtgcgtagaaaagacttgtgttggtctgtgaggacagtcttatgacctatgaaagctaccagatgtaagtgggcctagcctgggaaaggcgggtcgttacaaaatggtatcagagctgactctcgcggtttcacgggagtatggttggtgtggaccgggagtggtcatacagcatggcacatgcgctggcactggacacacggacgtggccaagaggggacgttcctggcctggggttgatcgacgggggcgtcctcagattaggttccttctcgcttccgcctcctctccaccccagccgccggccggcgcaccctgccgccgccatggcttctcctccctcctccctcactgccgacgccgtccttgatgacaccatcaaaatcatcgccgatgccgtccgctcctccttcaaggctccctctggtcaggacgacgacaccctgaccaccgccgtcgctggcgacgccaccgatcgtgccgcgaccgtggcccgggcggccctcgcccctgttatcctcggtctccttccgacgactcctccacggtgcctccaccggttcctccgacgaccgcgccttcgacgaccgccatcccgccgccaccggcttccactccggctcccgcggcgcaacttccccccgagatcctggcgcttctcgcccgtctcggcatcaccacgacgccggccgcccccacgcaggacgccgccgcgccaccggcggcgcttgacgccgaagccgttgccaacctccacagcaaagccgtcgccgtcctcaacgtgaaggcgctcgtccccgtcaccctcgacctcgacgccaaaaactactcccgctggcgaggccttttcctcatcgcgcttggaaaatacgccctcaccgatcatgtcttctccgacgtacctcgccccgatcacgccgactggacacagatggactgcatcgtcctcggctggctctacggctccatctcctctactcttatgcaggaggtgctctttcccacggcgacggcacgctccgtctggcgcgacctcgagctgcagttcctcggcaacggcgagcggcgcgccgtcaacctcaccgccgagctccatcatctgcagcagggtgacctctccatcggcgactactgccggtgactcaaggtcctcgccgacaacctcgccgacgtcggtgaacctgtcaaggatcggtctctcatcctcaccctcatcggcggcctcaacgacaaattcgacaacctcaagtccctcttgcctctgcaagtcctgttcccgacgttcgccaaggctcgcgcacagcttctcctcgatgagctgacgaaaggccaccggccgcccgttactgccacggccttcctcgctgcttcctcgaccaccgctcgctcggcgacctccaccaacacctccaacaacaactcccgcaacaacaaccgacgccgtggtcatggctccggtggtggtggcggcgggagcaatggcagcggcggcgcaagtggcggcggcggacaagcacacagcggcggcgcccagggcaaccctggcgcatagactgcaccacgggccaaccaggcctggcccacggcctacaacccatggacagggagaatccacatgtggccgggccaggccggtctaggcctccttggcgtgcggcccaacttcgtcgggacagccttcaccaccacgcccgcgccggcccagcagcaagccttcctcccgccggcctatgcggctctatggtctcaagcaggccccacgggcatggtccagccggtttgccagctttctccttacactcagctttgttgaggcaaaatcagatacatctttgttcatctaccatcgaggatcagacacggtttatttgctcctctatgttgatgacattgttctgacagcctcctctgatgcacttcttcgatggaccatccgtgctctccagtcggagttctcgatgaaggatcttggcagcttgcatcatttcttgggcatctctgtttctcggcagtcctctggccttcatctcagtcaacgccagtactgcctcaaggttctggagcgtgctggcatgacagattgcaagccatgtgctacccctgttgacaccaacgccaagctctctgccgctgatggtgccccagttcatgatcccacgaactatcggagtcttgctggcgccctccagtacctgattttcaccaggccagatatctcttatgctgtccagcaggtctgtcttcacatgcacgatccacgggagcctcatcttgctgctctcaaacgcatcttgcgttatgtccatggcacggttgattatggtcttcacatccgccgctcctccactgttgacttgagtgcatactctgatgctgattgggcaggttgtccggacaccaggaaatccacctcgggttatgctgtgttccttggcgacaacttggtctcctggtcctccaaacgtcagcttattgtatcgcgctccagtgccgaggcagaatatcgtgtcgtggccaacgcggtggtggcttcgacagcttcttcatgagctccatacccctccgagccgatccacattggtttactgtgacaatgttagtgctgtctatctctcttctaacccggtgcaacatcagcgtactaagcatgtggagatcgatctacatttcgttcgcgatcgcgtcgctgccggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcacccgccggtggagacgttgaaaaagcggtggcggcggtgggtggcggcggcagtggtgcccttattgtggtgggccttgtcgagcatgatccagtgacgagggaggaagcggctgtctaggccaccatcttgcgggcgcgggtgcagcgaggaggagagccgccacgggcggcacacggcacggaagcggacgtaatcggcgacgtcgttggcgagggtgagctccgcgatcttgccggccggcccgtccccgaggttcgtccagtcccttgtgccagttttgctattgtggttgatagagcttggtagcgagcgcctgggcaccaccaccgccaccgcctgctcattgccgccggctggcgtggggcgggagcgtttcgcctgggttctcgctggttcggtggaggcgcaagctccccgcggcgattgtgacttattgaactggctggctggtcgcttttccatccaccgctgcaatccatcggacaccggcgaattaggggattagacgtagcttctccctttgtgcaggcgaagaagggcgcggtgaggggaggatggatcggcgtcggcgtcggctggagacgtaactctggtatttggtattgccctagtttaggtcacaactttttctttaaacttttaatttatccatcatatcaaatctttcctgcatacataaacttcaaacttttataaacttccaacttttttcttcaaacttttaattttagtcaaacttctaattttaacgttaaactaaacacatagattatcgagtcgagacgagtctttaattaacgtggttattatttattgtcgttgggggtcggactcgcgatgcgcgtcggatcgatcctcggatcgggtggtcagtcgtatccgaggttcgagcaatcaccggcaagttcttttctccccacatgtttcctcccaagagaggctgatgcggcagcggccgttgacggcacatgcagggatccacggcgctgtggatcagggtggtcgatcggatcctgagaggatgcaacgttgggcgttgagacgatgtgttggatctgtggacatgactcttcatcatcaagcctcctgctccgccgccactggacccgaccacgtcgccggtcaaggaaggaagggatgacgacagcggctccttttctccatcttattcatcgaccacagcagcaaagagctgacacggatgtgtatgtgggaaagtttgtttctttgcaaatgtttttcacctacatgtaaaaacatttactaattgaataatcaaaattttaatatttgatcaatgacgtataacggaatacacatacgtcaacttttgaaatagtcatccgatcgatttgtgaggctatagaaacgtgtacacaatgacgcatgcagcgaacacaacctagttcaatactatatataatttctgattttgttttgtctttattttgtttctcttgtttcagtttatcgtttaaattagcagagtttttatcgatcgtaaaaattattttcgcatgttacaacgcacatgcattctactagtaataacaacatgtaatcagatagtttaactgctcatggttcagattaataaatattgatttaatactcaaaagagtggtctttcctatatagtgcgctgcaaattataagtagttattgcaattttattggagaatcagcaggaaaaatcgggcgcctctatcgcgcctccagctcgcgcgctgcaagcctctagctcaggtgccgcccccaccacacaccctagcacacacgccgttgcaatatatcacccacatattttagaaaccatctattaagagaattcgtttcagtttgtttccacaaaaaatgtttcatctagtgtactacaatgtttcactatgtatagatctaatgctgcagtggattgaaacattcttttgcaacaaatcacccacatattatggaaaccgaattcatttcatttttttccacaaaaaatatttcacctagtgtacttataatgtttcattat

SEQ ID NO: 32455 - DNA, 3734 bp, Oryza sativa
tgtgtagtcttgttttaaagatttaattgcaacgaatttaatagtgcaattggatcatgatttggataaataatttaaaataaaaaaatagtttaaaatagttttgcgcgcatacatcttgctgacgtcatgctgacgtcaacatgacgtgggcgcccgattttcccaccccggatcgggcgcctgacgtgtagttgcctcccattttattgcttagagtgatgggtttctttttacaaagacacggagtcatcttttcccctcctcttcatttacattctctaggtcaaatatgaaaaattgcacccttctatttgcctaacaggccacacacaatttccttccaaagcccaaaatgtacggtttccgtcggcctaaactgcgaggttttcatttttccatcttcaagccaattcaattctgtctctcttatctgaagcaaggttttcattttcagttttgctcaaaaattcggccatgtcggtagcatcgaaattcccaaatttttgggattttgaagacttattggatcaaaattatttaaatttttaagacaatttgactagatttgaataaattttgatcaaattcaaagaaaaagaaaagaaaaaacaaaagtttcagctgagataatgacttgcccgaggttaccgaaattgtttttcactgatccaaagtagaatattagcagtaacaaaggaaaacgcttctgccgataaaggctccatttggatattgggttatacctattgggaaaagaaaatgatatgctggtagattgaggtgggagattatatgaaagaaagtcatatcccatgtttggtttgatggatgggaaatggaagtttctagagaaatgaccaaaatacccctccctacaataagtggtataacattcaaatgcagccaacgatcacataatatatacatgcacctcaccatcttcgagagccttcgtcccacgcgaggatctcggtggattgctgccagctgcttacaccaaagagcaccctcagatttgatgctatgagctgtggtagatgaatcaacagattatagaagggtcaaaatggcgagggcaatttggtaatttcacctggcaatattaccctcaatccagcatgattgcatatcccattcccaacctatccaaacaagggaaatatcaaaactggaaataatatccatttcccactctctttatcccattttccaaacacaatcaaagagattgtgtgatacatgctcatcaacacgtgtgcccgttaaagcccttggctaggacaagaatccaacttaaaaatccaccacacatcgtactttccactttatactagtataaaataagggattttgtccgtacagttacatactttgtattttacctacatctaatctcctcattttctgtttttattatccttctctaccaaatttctttcctcataaatattttttttaaattatcattaaggtgtgtctacaacaagtttgttactttgcaaatgctttttatctataggtaaaaaactttcactaattgaataatcaaactttcactcatctatagcaaaatacacatgcgtcaacttatataatagccacccgatcgatttgtgaggctaaggaaatgtgtacataagagatttttcgtgtgatgacacaggaagcgagcacaactgagttaactttgttttgccattgttttgttcatcttttctcggtttgttatttaaattagcagagtttttatgaatcatgaaaattatcttcacatgttgaaacataccaaacatttttgctagtcattttaaaaacagaaatgctacttaccgatataccgtttgggatcggtcccggacaggacaatttcccatggatcaaacacacaccctcacggatcagatacacaccctcgagaagcattgagacacctacagctcccaaggctgcggcggcggcggcggagcctgcttgctgctcctcctcttcagcgacgccggtgcgcacgaggtcagctgtgccaatgagagagagtgacgtaagcatgttgatggcggctgcggcggcggcgtctgcggcggagctggtgcgcatgatacccctttctctcattcctccttgatgaggacatcctccactattacccactggcaaagacgctaaagtcgggcggcgaccgtgtgagcctctgaataatcccaccttgcttagcttgggaggaggaatccaccttaaaagggagagccacccttcccttattagactagtcttttagggagattgggcattttcccgagtgagtgcgcctatgaactgttggggtccgggcaaccttaagttattaggcctcggccaaccccacctgggccggattattatcatttggtatcagagttgggcccttgttaagggggtgggaatgatgaggacattctctactattacccgctagcaaagacgctaaagtcgggcagcgaccgtgtgagcctctgaataatcccaccttgcttagcttgggaggaagaagccaccttaaaagagagagtcacccttcccctattggactagtcttttagggagattgggcctttccccgagtgggtgtgcttatgaactgttggggtccggccagaataatcccaccttgcttagcttgagaggaggaagccaccttaaaagggagagtcacccttcccctattggactagtcttttagggagattgggcctttccccgagtgggtgtgcctatgaactgttggggtccagccaatcttaagttattgggcctcggccaaccccacctgggccggattgttatcactcctttttcatcgatttcctgatttcgattttaacatctcttcatttttgtattttctagggtttgttgaatccccaacctgtggatggggctcgtcatatcacatccaaattgaaatcaaagtaagctaatactctctcttttttctatgcatttttgttcattcactggggatgtttgtaccagaggtgaggggtgtgtgtgtgctgaatcatatgatacttgatatgatacttgcagcaaaatgttcgaattggaatagatcgctaaaaatgcttctagttgtatattgatgggaaggcaaatattgcttggagcaattttgtcgttaacaagtacacactgtcttgaaacagagaaatctccattcaactagtagcttactgcttaggacttttttaggtgaactgaagtgtaaacaaaatcagagaaatccgcatcagtcggttgctggcttctagttccgggtatgctttgcttgtcaattgttatcctttttgtcatagagggcagcgcgtggcgacagagatggcagatgcagctgagtcatagatgcagatgatttggatttttttttcctgttgatgtttgtagatctcagtggctggctgggagttttctgttttaaaatgatttgatactttggttcaatctaagaagaatcaccattgaaatgatattttctttgtcctttcacacatgtgcacagagttgaaatagcattgccacctgcttcaagcgaatccgatttcatgcatgtttcaaagaagaaaaggtgctcttcaaggttgaacaagggctcagcttaacccccacttgacaaatctcacactgctcattcttgtcatccatgcaggactacatgaaagaatatcatagggagctatgcaaaaggttgttgtaccatc

SEQ ID NO: 32456 - DNA, 9721 bp, Oryza sativa
ggtagaccttttctgtggactaaatatagtttgagtacgttgtacacaatgaaactgagttcagtatcatatgaaacctaaggaaatgatactgaggaggatcatgatacctcccagggttcacatgatcctactcaagtatcatatgtgaaacccataggaaaccactttacaaggcatgatactggataggatcatgtgatacttcacaggtatcaatcataatgaaacacgattctcctcaaagtttcattatgtatgatacttgtaaagtatcacatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaatttttagcaatcacataacaaattgtgtgtgaaaaactacctccaccaacagccaggacactcagtgtacatcttttgatcatttttctaatacaaaagttcaacgatagtatgcaaacacacaagcaatcttttgacaaatattggagattaagcagtccttttatgtacattccatcaatttttgtaccacacagggacaagtcatgcataccatctgttctatccacttccatatcatctgggtcacatctagctctttttttttcgccgggccagccaagataggccaactaaatttatacttacgattgaagaatatatacaaatatacaaagttttaacttcaactagaagccgtcaaagtaatggaagttgtcaccggagcaacctctctcctatatttctgaaaaccccagcttccttccaaatcgccacctcctctttgattgaaccaaacaggaaaccggctgagcgccgctggttctgaaacacacgcgcatttctttccttccaaaccatccaacaaataagcagcacaaggctatcaatggcatccatgtagttgttccgaaatttttgccgcatcgctaaccaccattcgcccaagtccaagcctgactcatatggcagcaggaagccaaccccaatccagcccttgatcattctccacaccctggtcgtgtaggtgcaagacacaaataggtgttcataatcttcatcaaccaccaagcaaagttggcaaacctgctggttcggccagccacgcttacttagattatccgccgtgaggcatcgccctttttcggccaaccacataaataatttcacctttgacggcgctcttgtttaccaaatcagagtaccacatcgcgccaccgtgtttgccatgaagaacatgctgtaggccgagtagggagtgtatttttcatttggtgcccacttccagattgtctcatcttcctccccatcttgaagttgcaccccctagaccacgtcccaaatctgaaagtattccccaattgcacgattggagggtgcccccttgatgtctcgtacccacctatggttcagaagccctcatgccaccgtcaagcccgagcgctcgacgtggctgaagatcaaggggaatctcaactttatgctcctcaccagcaaccagtccgccagccaaaatttggtgttcttcccatcacccaacacttgtctcgttcctgcgaggtagaggtcttgcaagtctttcgactgatctattggaactgttgttcacggtgtcgacgttttatgtcgcgattccggtatttgcatagtatgggaatcgttggtactaggatatatgcgagattgaagtaaaagagatggggacgaggatttttatataggttcaggccccttatcttacaggtaatagccctacatcccattggccgaagccggtgttgctctttattcatctggatcacacaagtacaatatttggagtagcctatctaactgttgtcgacttggcggtctgaagtgctgacttgtagtcgacaacagggtagccttcctcctcgaatccgcatccggcgagatcaaagacagcgctatatctctcctgataatatccgtagataccgtaagggactagccatgcttatctctgaattcgatatccggcgtcttgtcttgcatgttggcttttatgttgatcttgtgtcttgatctattgttccgtgtcccctctcctcctagggggccctgtatttatacccataggtgtccccttgtctaagtagaactagggaaaccaatatggatacaatccaagtagtccttgtcgtttccatgtagaactctattcatcattccttatgcggaattcctcctatatccgaaggttgttttcgtataagacatggtatgtggtgggtcctgccgagatttagtcaactactattaggtatatggtatccataaccttgacacacggcctgtcctgttgttccccctttttgccaaccacttgagacgaagtccttgccgaaataattgatgttcttgattcccagcccgccattttcatgtggcatgcagaccgctttccaggcaaccaagcagtgtccgccattcacctcttcctgcccttttcatagaaatccccggcacttcctatttatttctttgattgcccactgtgggagctcaagtacagacatgtaatgcactggcaaagcaagtaggactgtcttgatcaaggtcagccggtcaccggcggagagaaactttggcttccacccggcgaatttcttgacaaaccggtcaaggagcggttggacatcgtgcttcgtaagctttcagagggggagcgggagcccgaggtaggtgattgggaacagctcgactctgcaacacaggatcgactggactagctctgattgctcttctgaacattggatcatggtgactgcactctttaacatctagctctaacaagggcctcctttaacatctctatttcagcacttaactcatccaacactaacttatctactattgttgtcacaactgactcgctagctacagacacactagcagaaagtgcacacaaaggagattcactcgagggggcatcacttttttttattctcctgggcatcaaaagaaatcacacaaaatagcaacaaaacatcaaaacacatacattgcatgcataaaatagagataacagagaactggctttagaattcttacgcgggctgatgttgagcttgcagcgcatagctggagcagaatcggtcgaggaggtaggagcagagcaccggattgcagaggaaatcggtagacggcgtgtgcgccggcgaaatcaacaaaggaggcgcgcgattccgaggatcaatcttggggatgcggaggagctcgcgccggcgaggaatcgtgcgcggaggcgcgcgatttcgaggaggattcgtcgggttgccgaggagctcgccttgcgccggcgaggaatcgcatgccttgctgaggagctcgcgccggcgattccgaggaggattcggtgggatgtgttcaggtggcgcggcgagcactggtacgatacgattctttctgtttttgttgacgcgcgcggtgacgataccgtgttggttttagaatcatcctgtttttcaacgggataccggtatatagcagctttttttaaaaaacgtgcccgtgtaagaggaggaaagggtagattgaagccgtttgtaatccggatcggactcgtgtagtcgtattgcaagacgcaatcacgaccgttggccacagatcgggcggtcaggacaccactcgccacacgttctcctcctcacccgcagcggcccgtacccttcccaaggagaggcggcggcagcggcggcggaggtggcggcggccgtatgcgggagagagaaagagctcagctcgcatggccatcgcggtgaggtcggctgcggcggtggcgaggcactccctgcgccctccgctggccgcgcccggcagcatccgcggcgcctcgctcctgccgccgcagcgcgctcgcggcgtgggcccgtgtcgcgcccgcgctcgcgcggcgagctcctccgcgactggaggtggcgggcaccttcctccgctgttcaggtgagcggggagcggaattattccgtgttttaggcaatggagacgggcggggatggcggtgctgctcatggatagctgattgatttcgtggttttccccctcttctcctgcagcgtggcgccgatgatggactggacggacaaccactaccggacgctcgcgcggctgatctcgaagcacgcgtggctctacacggagatggtggtcgcggagaccatcgtgcatcagaaagataacttggtgagctatatgcccttccgcccttcacttcttcatgattaaaaccgggtgaaacgtagatgagagaaatgcaaatccttgctacggaggaggaaaccctgcaactgatcagcagtgaagcaacctgtggttttaccacgattctgaattactgtgcgatgtgaatctggtagtgatttgattggagtcagcagcaaactgaattcgtttacgattggcccactttcattcatgtcaataacaatgccacaggtgttccatgaaaaactttcccgtgcgcattgcataagttttccattctcttcaagctatatctggtgactctttaagtacactcatcagagtcttatagtataatgttcatcttaatagttccattagcccatggtgcgctttcatatatcacaacttggaacctaatcatacagcggcattccactgattccttttgtcagatatagttcatctcctctgctgtctcaatctaggcatatgcgaaggatatccattgttttagctaatcagctctttttttcacataaatattgcagtttaatgaaaaaaagaatcaacttactgccttatcgggataaccagcaatgtattgcccacatgttttttcttttgtatgttatcaagttgcgatgagctttcttggcggcactggcagcttaatatgggggaaccacttcaactcaacttggcaccatcagtgctggcttgttttgtatatttgtcactatgtcttcaatcattgtttcttaaattctacttttggtgcaatgaaggcaactgtgaaacgtgtctacgacatatggttcacattatgtgcacatgacactgctacacagaattgataaatcttattcttttgtcgtcacaatatgcaggatagatttttagcgtttcctgctgaacagcatcctattgtgttgcaaattggtggaagtaatctggataacttagcgaaggcaactgaactggcaaatgcttattcgtacgatgagatcaacctaaagtaaaaaagcgtcactcaatctcatctaatcatgtatgacatttcttttattacatataatttactccaaacgttttgtatcagctgtggctgccccagtggcaaagttgctggtcatggttgcttcggtgctcgcttaatgtttgatccagaggtttgctttatgaattcattgcagtaaaccatcaggtagcatcaatttgttctttctccacccttagtaaatattgattcaattatctgaagtttgtaggggatgctatgtcagctattgctgccaattgtaatgtcccagtcagcgttaagtgcagaattggtgttgatgatcgtgactcctacgaagaactttgtgagctttcttcagagacctctcatgttcctttaaatttccttaggcttcccagatatgagccatggaaatcatgtcaaataagtacactctatcagatgcacttttacaccgaaaaggatcaatcaacaatgggttgcggcatgctttaatgtctcatattatcaaaatatgttaacctataccataagctaaatataagtaaatcacttgctggtgttatctggttgttttacaagaaccaggttacctagctgtagttgttattggttactggtcagtgtatttgtactcttctggcggtggttgtgcccttaaggtcaaattgaagaaagaaaaaaacagtagtatctcttgtgcatagtgatgctggacggttaaaatcttggattagtattaactgacccctaaaatgtaccactggtgcaattactccttacatttcaagttttcaacagcatcagagcataaaaaaaatctcatatcttctcaaatcaaaagaatagttgaaagcttctaacatcagtggagagtctctagttctctgcatatatttatcatgacttattccaaattaatctactgtatgtaaatctgcttgtagatgaaatggtggcatgatgacatttactgcagtttatctttttttagggccaaaaataatcacccatggctgtttggctaaatttgaaaaattcccctttccccctgagttggctgaggattatcttcaaagcattggactcctattaaattgcaatgtttaactatggttgccagttaattggtgatgtatatatttgacatgtgatcaacctttttgtatgataacaacatccttttacatttatttagagattatcccttctgcacacatcaagctgaaataattaggtaactgaataatgggaaatcaagtctaagaataagttgctcaatttaattgttttcttcttgttatgatatatggatatggcccatttctttttaacatgtcacacgacatagttccttttgttaggaatttgtaacatatcttttttttatttatattacccagttcaaattctatgtcatgctgtaggtgcatacttttaatgattctcattcatgttactctagataaatttttcatatgatgtttaattagttcttgtattgcatggtatttaattatcataggagtattgtttgagggttaatttaacctcatgtgctgatacagtgccatattgcaacaaactacgtatctttctcactgttaggtacattgactttttttttctttcccaggtgaatttgtagataaggttgtttcaaaatcaccaactaggcatttcattattcatgcccggaaggcattgctaagtggcctcagtcctgcagaaaatcggaacgttcctcctttaaagtatgtcacgcccatgattttctttgtgtaaaatattattcaaatttgatggataagtcttcgtggtccttggtcgtgattcttctttttgcttttgggtagtttcaccttttcaggacagcatctacttctttagcgtatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggtaggtatggctttgtgttttgtgaatgaagaaaaccagaaaattgccccatctcgagtgccatcctcttctcaatgagagtaaccattgaagttctaacatctggtatcaaagccacactttcctgtaggctaaacatctcttgttccaccccttcccaagctcggttgagctctcagctagcagcagcagcagcagcaacaccggctgctcctccttcccctttcccttccccctctccacgcagcagccccccggaggtgtgccatgtccgacgttcggtctcggcgttcggtcgcctcgagcactcggcgtcagcaggacaccgagctcgccgcagcagaagagcgcaggcgagcaacggctcagaccgctgcagcagcagcgagggcggccagactggcggcagcggagttggcagcagccaggtcggaggcggaagcagaggcggcggaagatgcggcacgtgcggcggaggtagaggttgagaccttgcgcagcagcatcaacggctccatcgccggcgacatcaccgccgacagggagcttgaggagctggcaagaggaagggcacgggaacgggcagagcggcggcggcggcccaagggaccgcgcacccgccgacgggaacccagatgggcgcgggcgtgccggcggcagcccggagcccgcgcgcggccctcgcaggcagcgcggctctccctcccctgaccggtgccatggtcaccacggcgtccagacggtggtaagggactttggtctcggcggtgggtggcctaccctcaccaaaaccaactacatcgagcgggccgcggtgatgagggtgaggctccaggtgcggcacatgtgggaggcagtccggtacggcgacgttgactacgatgaggatcggcgggcactggatgccctcatcgctgcagtcccgctcgagatgcagttctcgctttcccataagtggactgccaaggaggcctgggatgccatcgctgtggcacgtatcggcagcgaccgcgcccgcaagtccacactgcaggcactccgcaaggagtgggagaacctggccttcaagccaggtgaggatgttgatgactttgccctccgtctcaacactcttttgcagaagatggtgcagtacggcgacgacacctacgacgaggagagagctgtcgagaagctctttcgttgcgtcccagagaagtacaggcagatcgctcgctcgatcgagtctctgctggacctctccacgatgtcgatcgaggaggcgttaggtcgcctcaaggtcgtggacggcgatgagccacagcctctctcggggcctatcaccattggcgggaagctccatctcactcgggagcagtgggaggccagccagggtgacgggaggaagggggagtcctctccctcgacaggcggccgcaagccgtgcaaggcgcgcggaggcgtccaactgcggtgggcgcgaagacgcgccgagggtggtgctcgcagaggcgcccagggcggcgccgccggcaaccacaagccggcacgagacgacgcttgccgcaactgtggcaagcttggccattggg

SEQ ID NO: 32457 - DNA, 2035 bp, Oryza sativa
caacagctccagcaacgacaaggctgatgggtggtacctggacaccggcgccacccatcacatgactggccggcgggagttcttcaccgagcttgactctagcgtccgaggctccatcaagtttggggatgcctccggcatggagatcaagggcgtcggctccgtcaccttcaccgcaaagtccggtgagcacaggctgctcaccggagtctactacatccccgtgttgaggaactctatcatcagcgtgggacagctggatgagaacggctcacgcgtgttggtcgagcacggagtcatgacgatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgtttcgggcacctccactttgaggccctaaagtggctcagcgccaaggagatggtgcgaggcctgccgtgccttgaccacgtggagcagctctgcgacgtctgcgtcctaacgaagcagaggcggctcccctttccccagcagacgagtttccgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaaggcagaggctgcggacgccatccggcgcgcgcaggctgctgcagaggtggagtgcggccgcaagctgcgcgtgctgcgcaccgacaacggcggcgaattcacggcggctgaatttgcgtcgtactgcgctgatgagggcattcagcgccagtacaccgcgccgtacagcccgcaacagaacggtgtcaagcggcgcaaccagacggttgtagggatggctcgggctctcctcaagcagagggggatgccggccatattctggggagaggtggtggtgacggccgtctacatcctcaaccgctcgcctacgaaggccctcgatggcaggacaccgtacgaggcttggcatgagcgcaagccgggggtctcccacctgcgggtcttcggctgccttgcgttcgtcaaggagcttggccacatcggcaagctcgacgacaggagcaccccaggggtgttcatcggctacgcggagggctcgaaggcctatcgcatcctcaactcggagacacagcgtgtgcgcacagcgcgcgatgtagtgttcgacgaagggcgagggtgggtatgggacaaggcggtggacgatggttcgactccgaagtacgacgacttcaccgtcgagtacgtccacttcgagggagctgggggagtaggcaactcttcttcaccgagcgtgtctaccccagtccccgagcctccaccgactccgacaccaacacactctcgggccacgacttcgactacgacgagctcctcgcctacaccaccacagccggtgaccccacgcgctccagcaccaacagccactcctccgagcacgtctactccgacgccagctagtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcccgacctggaggcgcagttgcaccttgcgtgcgacgacggtgagcctcggtctttcgcagaggccgagaaacacgtggcatggcgtgccgcgatgcagtcggagatggacgcagttcaggagaaccgcacctgggagcttgctgaccttcctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactc

SEQ ID NO: 32458 - DNA, 4665 bp, Oryza sativa
taggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgccatgtccgacgttcggtctcggcgttcggtcgcctcgagcactcggcgtcagcaggatgccgagcttgccgcagcagaagagcgcaggcgagcaacggctcagaccgctacagcagcagcgagggcggccagactggcggcagcggagttggcagcagtcagggcggaggtggaggcggaggcggcggaagatgcggcacgtgcggcggaggtagaggttgagaccttgcgcagcagcatcaacggctccattgccggcgacatcaccgccgacagggagcttgaggagctggcaagaggaggggcacgggagcgggcagagcggtgggcagcagcccacctccacggcggtggcggcgacccaagggaccgcgcgctcgccgacgggaacccagacgggcgcgggcgtgccggcggcagcccggagcccgcgcgcggccctcgcaggcagcgcggctctccctcccctgaccggcgtcatggtcaccatggcgtccagacggtggtcagggactttggtcccggcggtgggtggcctaccctcaccaaaaccaactacatcgagtgggccgcggtgatgagggtgaggctgcaggtgtggcacatgtgggaggcagtccggtacggcgacgtcgactacaacgaggatggcaaagaaccccgtcttccacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatgacccaactttcccacaagacgacgcacaagacttagggggagaatgatggaataagcctcgtggtctttggtccttgtggtccctctcttgcttttaggttgtttttcccttttaggacagcatcctttcagttttgcttttagcatatttcggttttgcttttagcatctctaggacagcatctaggaccatcacctttatgctttattcagtttggatgctctctaggacagcatcgcgttcaaattttagactagtgtgggcagcaattagcttgcagccatccagccagctatggctatatatatatgtatccaacctccctcgggaaggtatggcttttgtgttttgtgaatgaagaaaaccagaaaattgccccatctcgagtgccatcctcttctcaatgagagtaaccattgaaattctaacacttggtcgtgattcttctttttgcttttgggtagtttcaccttttcaggacagcatctactcctttagcatatttttcagttgctaggacagctgcggttagtaggacaacagcagttagcatctcctttatgcctcctttatgctttattcagtttggatgccctctaggacagcatcccattcaaatttcgaattttagactaggagggtgcagcaataggctagcagcgagctatggctatatatatatgtatccaacctccctcgggtaggtatggctttgtgttttgtgaatgaagaaaaccagaaaattgcctcatctcgggtgctatcctcttctcaatgagagtaaccattgaagttctaacaaaatttatggagtggcgccaaaaaaaatctctaaagaggataaccatttccataaacaagaatatgcattaagtagagtttcaactttcaattgttaactttgggtaagattccaaatgatgtagatactacgtgtagagcatgaggggcacaaacacaatcctatagtccaaattgcttcctaatctgttgaattaaatttaaggtctgcagaacagattttatttcctggttatcaccagtaactgactagttctcatctgaattttcatccccggcctcaacattttttttgcagatatgaatactactttgctttattgcgggacttcccagatgtgcagtttactctaaatggaggtataactactattgatcaagtgagtatcttactctagttatgtagttttgataatgcaattcctggaagttgctattttaatgaacaaattgcgtagcgagtccatcagttcaaattaggtcaaactgatgttaatgatacaattttccttggcaataaaaaaacaattttgtttcatgaatgcaaaaagaatatatttgttctctctgtacttagtactagacattcatgcagagaagtagctcttgttgcaatcagatataatatgcctgagtcaagtcatttttattgaacatcagttatattcatttgcaggtcactgcatccataagacaaggtgcacatcgagttatggttggccgggctgcatataataagtatggtcataattagaagcctttgtgtctctaaattctttgatgctttcaaacatgcaaactaagtaactagaatatgtttccttttgttgctgaaaacctgaaacagtatttagttgtaattttaattttggtatggaataaatgttcagtccatggaacatgctggggcatgtggacagtgaagtctatgggatgccgacaagacgctcttctcgtcgccaggtttagcatcaaaggatggttttgttttcagctatcaactatttcttttataagtattaactgaactccttgttttagatccttgagagctaccaggtttatggtgattcaataatgggccaatatggccccagcagaccaaacgtgagacaacttgtcaaggtgtgggttgcacttacatttaatgaaaacaacctattgttagctttatgatgtgatgtagcagggcatttatgtacttgtttcaccttataatgtaattatctgtgacgtatgcaccattgtgttgatcatagctttctgaattactcaagaactgttacttttgtttgcgtatagatagggattctactttatgcctaaaagcctaagatatgagttataaaagataattatagcacactaaatagaaaatagagttcattgaagaaaaggaaatgcactgatcaaacagtttcatctgtttctcctggtattctgagctgcttaattgtggtctaacagttgcgagttctgcattctgtgtattgatctggaaactagatttaatgcaattactatattgacctttatcagtccttttgtaaaatttatgagcttatgcaaatatgtgctttcagttactgagaaaatcgcttgattttgacagccattgttaaatttattccactcggaacctggcaatggcctttggaaacgcaaggctgact

SEQ ID NO: 32459 - DNA, 22809 bp, Oryza sativa
  unsure (1)..(22809): unsure at all n locations
nnnnnnnnnnnnnnnnnnnnnnnnnnnnnnnnnnnnnnnnnnnnnnnnnnnnnnnnatctcttacgatccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtcctcgcctgcacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgtcgccgccgactggtgtccccgcctgcacggctggcctttatgccgccgttgttgggcgtctacgtcttcaccgaccggcttgccttcgccgccgccgactggtgtttccgcttgcacgttggcctattatgccgccgttgttgggcgtctacgtcttcaccgaccggcttcccttcgtcgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagttaaacctactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttattgctgctacttcatcatggtggagcgacttcatctttattatcttcggcactggcaaactctattgctgctacttcgcaagttttactacttcaccaaccacgacgtctttgtgaacctcgacatttcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctaatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttaccacctctggtgggcaatattatctctatattggtcgtcttgtctatatgccaactgcgtcagctaccatcaatggacgattgtgactacgacagaaggacaagctatatgctcaggggctcatcaactcaagcgtgagaattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagaatcccataagggataatcattcagatcataagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcacattttgcttaggccaaagtgcgcgtgatcaagtgcccaataccttaaaatccttttataccgcagttactcaactttttaggagttggtacgatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgtatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcggtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccatatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcacagttatccgactggctataggggataacttatatctatggaatatgtaacagattatgacttgggtattacgtttccttgtatattatggaacggcctaaagtcctggtttgataagattgtaaagtagacttaggaaaccgataccgtattggttaaggtttctatcttgtaaccctgccccccaacctatataaggagggcagggagccccctctaggggcatgagacaacctgatcgtcagatctatactacacccggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacaaccaagaagcccaaagagcgacaaggcccaagaaggtcgttcgccattcgtaggctagcccaagaagcccatcaagggggcccatagttagaatggacattatatgccatcactaatgtccctatcataaggatatacatgtaaattcccctgtacacattaaaccctagagggtatgagactatactaagactataaatagcccctaggggcatgtaatggggtgatccgaaaaaattccatcaattaatacattgtttaacttttcaaccattccactaagtgaaccacgtctttcgacgtgaagcagttgtctcttcaacaacagctggcgccgttcgtggggaacccaggacgaagctactgatgtcaccgaagaaaatggtgaaataaagagttgcgcctaggagaaaaggagggtcaaggcaaagcggaaatggccggcaaaggagtagagcttcatgttggcgaaggggacggagagcagcctttgggcggagcaggccaagtcgtcacgccttcggatcaagcgacggcttcgactatccaagccgcgaccaaagtatcaactttgaccatccaagctacaacccgaacgacggcttcaacgaagcacgcttcgacacaagcagcgtcgaaggcggcggagataagggggcggaggcggcgccctcctccctctttcgcatggctcgtcggcatcttgacgggtaacgggggaggcggagcttgacctcggcggcctgaactcggggatctcggggaggtcactaccgctgctctcttggtcaagttggggaagccgccgccaatgtcacccttttggggagctcaggaaggctgccaccaccactccaccgctctcctcgccgagctcaggatgggtgccggtgaactcaagtgtggaggtcgatgggaactaaggagagaggggtcagagaagaaggatcggacaagaaagagaaagaagagaggggatacgagatggaggtagaagaagagtattatgctttgacatgtggccctatatcttttgtatatttttgtttattgattggaccaccacacatcagcgccacgttggcgaaaccaaactaaaaaccactcaagggggtaaactaggtgtgtttggttcccgatcaaggttggatgagatatggcggtccatattttgctggatatggcgatccggtttttatttggtagagtgaatatgacgatccagttttttatttggttgtaaggatgaaggtggatttggtgatacattttttttgtttggttgggggagtaggatggatgagtggttgtaatcaccctttcattagaggtggtgagtatacccccttcaaattcaccaaacccaaacaaattatcaatctactacaaacaaaaaaatctaaatagaaataaaaagtcagaaagaaataaaaggggaaggagaaaaacgaaaaaaagaaaaaaagatcatcttcaccgaccgctgttgcgcctcatctcctgtccgtcagcaaccgttgcgcctcatctcccgctcgccggccgccgccccaccttctttctcgctggtcgccgccccgtctacaaatcgtcgtctcggtcgtcgtcgtcgtcctagtgtggcagtggcagacctcttcctgctgcgtcacctccgggctcgccgccgtcccctcttctcgttgccaccacctcgagcactcgagcccgccgccaccctttctttctgtcgccgcactcgtatcccgcgttggccaccgagctcgcatcccactgcccccctcgcgttgtcgtcgttgttctcgcatggtgagagggctgacgcgacccacctcatcactcgccccgctcgcccgagcactcgggcggctccatccagccaaatcggccggattcctccatcctatctggagggaatattcccctccaggccgccatatcccactctcgcccacaaaccaaacacccacaaaaaatgggccgccatgtcctatccacccaaatccctccatccaaacacaccctaaatggtattgaaaattcgggggtgttaaatacccggttttaaacttcaggtgtgtctcttatacaaaacgaatagttcgggggtgtaaaatggacttatccctaaaaaaacaatggaaagctgcactccaagtattcaattgtaatggtactagtagaaaattttgggcagtctatcgatgtgttcaattacagaataaattcttatacttatctcgggaacatatgttatgcacacatgtttcccatgcacaccaactagcaaatgtcacacaaaattttagaaaaaagttggatatatacttccaatagtattacaccttcctgtgaaatcttatcttcaaattcattatattttatccgtatctgacagattttctcccttaaaactttcacattttttgtttttttgttacagctaaaatataatgaatttgaatatgagacttttcgtatatgtgcaatactattaatagtaaatgtccaaattttatagaatttccatgaaatttgctaattgatatgcattgtacacggaaaatccgtacataaaatatgttttcacttatctctccactatccaatgtagctaggatggtggagtggcaaatagtaaaaactagttggcaccccgcgtctttgttgtgggttttatagttttatcgtcaaacaaaatcatagttttaaatggttaggtgcaactctatgtatatagaaaatatatgataaatgtgaatgtatagccttatgttattacaatataattcatgctttatttttccaagcataattgtgtattgttataatatatgaatattattttcatacgcaatatgggtatcgttatagttagacaatttgcatctctctacttcactcaagttttttctgaaaatagattcatgtaactatacctaataattatatgctatcttatcatgcataataaaacaaaacacacatattaaacaaaatcatatattaaacaataatttgagttgtattcgggaaacatggtgttatgcacaaaatatgtaacagtgctatgtgtgactgtgaagtagagcaaagggaagtgaatggataactaatacttcctccgtttcacaatataagtcattctatcattttccgcattcatattgatgttaatgaatttagacatatatatctatctagattcattaacatcaatatgaatgtggaaaatactagaatgacttacattatgaaacggaggaagtaataaatgattgaattggatgaataagtagcttcttgatccaacggttattatctttgtaataatataatctaatggcttaaaattgttaatgatatagcttcttgtatctcttgctttataagagttaatgctccttgtggttgcggattctttaagacaaaagtttaactcgcacggcagcaaccaaaaggtgtcgtggtgtagttggttatcacgtcagtctaacacactgaaggtctccggttcgaacccgggcgacgccattaacttcacaatagtgtactttttcacttcaatatatttactatagtggtttttatattttctttatccatttttttcacttcaatctatttactatattgctttttagtttctatttttcacttcaatcatttttattgactttgcagcttgaaactgcatgcagctaattacttaacaaaaccatcttttttttttacttcctttttctttcacttcaatcttttatttttcacttcaatctatttactataatgctttttatattttctttatcctttttttttcacttcaatctatttactatattgctttttatcttttccttttcacttcaatcttttttttgactttgcagcttgaaactgcatgcagttaattacttaactaaaccatctttttttacttcatttttctttcgcttcaatctttttacactggtggagaaaccatattttctcccggttcgtaaccccctttagtccggttatccaaccggaactacgaacccgggactaaagatcgttatcttagtcccgggtaaaataaccgggactaaagatcgatctttagtcccggttggtaccaccaaccgggactaaagagaggataacaggcggcagttcagatgatcccctttctttgtttttttcttttttattttctccttttattttctcccgaaccaagtggcatgcatatccccaaatcaaaccctaaatcccaaatcaatgtaacatcctaaatccacatcacaaatcttgaggttacttatatacacaaatcaaatacatcacaaatcctaaaaaaactacacacaaatcaaattacatcacaagttctacaaaattcatcgcaaattcacatcacacacaaatcaaatatatcacaggataaatcacaaattaaaaaaaatccccagaggcgccggccggcaactgccgcctcccctccgcgccggccggccaccaccgcgcggccctccacgacgctgtccgccgccgcgccgccctccgcgccgcctccgcctgccgtagcgccgtcgtgtgaccctgcgcgccgccaggcaggccaccgccgcgtggcccgccgtgccccgcgccggccaccgcccggccggcccgctctcgctctcactccgattcgatccgatctagctgctctgtgaaaaagaaagaggtaagggaaaagagatggggagttagggagttaaagatgaaaaaaagagatagagagagagtttgttgtgtggacgggagaagaggataagtaatagggattatataatacgtgttgatttttattcccggttagtaacaccaaccggaactaaatatatctttagttccggttggtgttactaaccgggactaaagatcctaggcgtctgacatagtctgacatggaaccaactgggattaaagatcatctttagttccggttgatgttaccagccgggaataaagatcctctagtcctgttgctcttataaattgggactaaaaattatttttagtcccggtttttaatgggaccgggactattatggatttaggccgaccgaccaaagatggtttctccaccagtgttatattggttttccatcttgaacctgtagataattacttaaccagagcatgggatatgtgtgttaattacttaacaaaagcttgggatatttgtagtaaagaaaaatgttaattgcatccccattacttaattaataacctaaagttggttagtagtactccctcgtcctattttaggtgcaaccataagtttccacgctcaactttgatcatccatcttatttgaaatttttttataattaatattttgattgttatgagatgataaaatatgaatagtactttactcgtgacttatgtttttaaattgttttaaaaaattttcaaataagagggatgatttgcgaaaagccatggttatacttaaaatgggatggagggactaagtactgagcaattgccgctttgcgagccattgatttatgtgacttgtcctagtagcagtgattacgtttaatcacattctggcagattagttgttgggccgcttgccctgtaaaagtaaggataatagtaaagctcactttctactattagtctatcttaaagctaacacatataatagattagctgtaaggttggttataattttcttttcctctttctatttctcacttatacatttaatatatttgtcttgtagcttgtgttaagctagctcttgtataagagctaacacctttgatttcttgttacctctctcctttaaataaacttatagctcactattatacttgcactaacttatgcaggaaggtggcggcgcactagtggtgtgcgcagcaatggcggtgacggctcggcggtggcggatgatgatggcttggtggcgcgctaggagcgacgcctcgcacaacagcagcgccaagaggagaagaaggggaggtggtgcaggtcagctggaaagatggcgtggaaacgatggctcctgacgagataagttgtggcagcagctcgatgaaggtcatgttctgcggcgatatcggcgttgcagcgacgactcttcggtgagataagctacaacggcttggcaaatgttttggtatgcaatgacgaaaacttggcagcagaggtcctccgatgagataagcttcggcggctcggcggaggtgggcgatggggcaacaaggtgtcgtttgcattgtggggtgttggttgtcgtgtgatgtggtgtcggtgtagcagcgacgacttttggtgagataagctatggcagctcgacggaggtggttctctgcagcgacgacggcatggtggcgatagagtcgttagcaccacggatgagtaggttgttcagacagcatgagacccttgcttggcaactataaggtgattggcggactagttttgttgcctttgtttgatctttggtggaatagagaagcttctgtggtggttgctgtgacagcaagggggtgtggaagggcgggctagctccgcatctacttcaagtttgaaaaagattagagctagtcttctagtttttttttcttttcggttgttcttttccatgtttctcgattatgagttttagagtgtatgcactcgtgtaaacctttggctatatatattcactttgaatatagagaccggattttatccattatcaaaaaaatgtaggagcagtagtgcagtaccggctgaaccgttcattggtcggtatggggaatatatatatatagtatatggagtagtctttttgttcatgtgcagctcacatcacatgctttggatgacaaaataatgcttgcttaggataggaagaaggaccgatcaccaacatgactccttgaaatcctttggaaactgcacaacattatacccccaccatggcgcactctcagaatccaaggcaccacaatgcatttgactagtgatgaaaacggtcgaagacaacattattgctagtacattactgctagtacattactcctttttatagaaacagtttcggtatagttaggaatttttatactatttataaatttaactatttattagcgttgacttaagcatgttactgataaaacatttttttttaaaaaaaagggacttttacgcatggttataaacagaaaagctaaaaacatatagtactacttttacagaaatggtaacatttttatctctacatcatggtttattgtctatatttaccaatttaatgatgacaatattaatgaaaatgattagaatcgggcgtccggcgtggggggagccggatcgggcgctcccccgcgcgcccctcctcctacgtgcacacctattggacccacttatttctctctcccccttttccataaaagatgtttcacctagtgtacttacaatgtttcactaataaatctaatattgcagtgaattaaaatactcttttgcaaaaaaaaaacccacatattttggaaactctctattaatggaatttggtttattttttgttccaccaaaaatatttcacctagtgtactcatgatgtttcactatgtgtagatctaatattgcagtgaacgaaacatttcattgcaaaaaaacccacatattttggaaaccccttattaagggaatttggtttattttttgttccaccgaaaaatgtttcacctagtgtattaacaatatttcactgtgtgtacagatctaatgttgcagtgaaccgaaatattattttgctatttgctgaaacattgtttttatataggtgaaacaacacctgatttaaacgagtgaaacattttcgatctgaaacaattccgatatacctggtggaacatcgtgcaatatttaaaaataattcaataataagctaaatttttttcgtcggaatatatccatgtgtgatcttattttgaagatttaattgcaacaaatttaatagtgcaatcggatcatgatttggataagtaatttaggagaaaaatcagtttaaaatagttttgcacataaatcgggcgctgatgtcatgctgacgtcagtgcctgattttgctcccagccgatcggacgcccgatgcataggtccgtcccaatattaataaggcgcggaaagaaattaggaagaaaaaaaactttactcgtttggttgtaatttttttccgcgtcttttcatctcacttacgtgtgggacccaccaccttccctaacaattatttcctccgcttcccgggagcggcagcagagtgagtccaagagctcagtagaataacctcctccttacttgtaccgcgcgagctagcgaaaatcctcctcccatggccgcggcctcctcgactacctcgtcctcctccgcctccaaaccctagatcgccccccacctacctacctacctaccgcacggagacccctcccatggcggacgcggcgcaccacctccgccgccgcagcagcgccgcgctcccccgcggctggtgctgctccttctccgccaccccgcagagccccgaccaccaccgcccgctctccgccgcgtcagcggcaggaggagagggcgtcggcggcggcggcgcgcgcggtaagctcccgcccaagtcgccctcggtctcgctgccgtccttccagagctccccgtcgtctaggctcgcgggcttcatcgacccccgccgcattctctcccccggccgcgtctcccccatagaccccgacggctcgccggcggtggcggctggggcgaattcggaggaggatgcgacgccgaggccgtcggtgccgttcgtggcggtgcgtgaagagcgggaggaggaggaggggagagggctggatctgaagctgtgcctccgtggtagggacgggaggagcgtggcgatggagctggactccgccgtgctctgcgagagcagcgccttcttcgcggccatggcgccgccgccggaggccactgtcggcggcgggagcaagaggattgaggtggatggggtggagaacgtggaggcgttcaaggagaccgtggagctcatgttcgaggccgatcccatgcggtggttcgtcagggccggcgtgtcacgagcaataggcgtgctcgaggtgacaaattgcgcatccttacctttttttttttctgttgctgtttcgttgagtttcgcatcgaggaccatacgcatgtggccatgtagttgtggaaattgcattcttcacgttcgtactgcgggttaatatggttcaatttcgatggttttgtggtagattcgtgaacgtaaacatgtactattaactgtgcagtatgtacatccatgtttttaactgaatttcttaccgatgattgcattttctgtgaaaaccagtgagttggtattaatcttctagtgcctactaaaatctcgttagggatgacaccattttgggagtgcaactcatactagctcagtagttcttttagttgatacgaagatagtggtatgaccaataggatttaatgttcattttatacaacttgtgctgtgatgacagcaattaaatgagactagctaactaattatatcaacaattaaatgaactacctaattaatatatttcatactagggcagcagttttataattattgtaccatgatcgctataaggttatgcctttttctattcaatcagcaattgttgctgtgtgcaattatagtactccacaacgggtcaatggactcataaacttctattgcatgtacacctatagtcgaagccttgaaggatatgaactgaagcacattgagtgtagtaagtacggcataaagtcatcaggaaaatagttctaataataaaaaatggaaattttaggacaattgcaatctttgtcatgcatagttaaggatacccacaacttagattattttgacaatttattttggtgtctttttttgtccttagctgctgatggctaccctgcactgcagactgttagtggtctccagttaaaggtgaggtgtctgttccagggtagctcagcaattgagcacgccattaagagggttcagatgtccatattaatacttgaacattgctatcagagcatgaatagtacatatttactcttagtaccatatttatagtttcttcttgatttaattttatattgtactagttcggctgcacttgatagctgctttgttgaagccagcggctgtacaacgcagacaaacatgcccattatcatctgattatgggtcccataatccttactacatcttgaattgcaggtatcttcctctataatgtttgacagaggaatcaaatcatgtttggagtatattgaggcagttccatggaatgagaatgaggaagagaagctgaagaacctctttgctagatgtactttcgatgaagcagtatccaaagatgtactggcaagattaaaaccacaatgccagagcatctcagacgatgttacagttcacctcatccaatctgtcacaagcagcaccaacactggtgcaagaaaagagatgcaatctttagtcaatggtcttctcagtagaagctcagtctatcaaaaagatttgtctgggctaaacaaaggtagcctttaccagatttgttgttcctgtttgaattcactagtggagcattttacggaagacctctgctcggacaaaattgttagagatagtaagcctatgatcgaaagagtcagtaagcaaaccgagaacctcaactggctctttgatattcttgtgaacaatgatatggcagaagaatttgttgagttgtgggctaagcaggaagatctcatcagcatgcatgggcaagcatcagcaatgttcaggtacgaattaagtcggatatcagcgaatgtgtttattgtcctggggaaagggaaagttcagtgccccagcgatttgaggagccaattgttctacggatggtttcggcccatgttaatggattttggttggcttcaaagatgctccaaagggttagatatgagaatgttggaggagaatctcgggcaagcgcttctcactcttccactccagcagcaacagagcctatttgaagaatggttccaatgcttcgcatccaggggcacagagtgcccgaatcttagtagagctttccaggtatggtggagaagatcatttgtcagatcatccctagagtcacgtcgttgagagttgagttcacttgtctgctgatatataatcttgtgtgtatcaatgtaaaattagagttcttgtattagcttgtagaatattcttcttaataaatctagcttagctgcttccattatatgcaacaatgtaagcataaaactggccaagaaaaaaaaactagaagatatgtagcaatttggatatcgtttgccttgaagatggcatcactgtacatgatcttattcctgggaaaaatatacaaactgcaccagggagtgtgtagcccttcccatgtttcatactacttcatacagtagattcatgctacatagtattatatctacattcatgcactccaatatccatggtttattggcttaattcagcataatcagtcagtgacatggcttcacttagcagctcttgccatagatgagctcttcaggttgggcatcttcgatgttgagccagtggcaatcctggaacgcgcacctgcctgaggcttgcagcgtctcacctacgtcccgggggtccaggaagtatggcgtccacgacggcgtgccgtcctcgaacgagttgtgcgtgagccgccggatgttggacccgtcgatgtcgacggtgtagatctcgccgtatggctggtaatggtgagggttggagaccggctcggcggagacggcggcgtagtcggaggtgaagacgaggctcttggagtctgaactgaaccatgggtggttggtcggtccggccgccgtcgccgctgtgcaccacccgccgcaacccggtgccattggggtgcaccatgatggcgaagctgccgctccccggggcatggcggtcggaggcgaaggcgatccactcgtcgtcgggggaccaattgcacatcgtgtccgaccatgggccctccgtcagccgccggatgccaccggcctcgccgtccttggcgtccatgatgtacaggttcttgtgcccccgacctccccgaccggaacaccaaccacttcccgtccggtggcggcgacgggaatgcgttgttctcgtctcccacggtgagcttcttcatcgagatggttttgtcgtcgtcgtcgccgagggagatcgccaccacgtccacctccgtgctctcgatcgcgaaatccggcccgatgcttgtgtgtatatcacgcctttcctcttccagtccaacgacgtcaggaaggcgttcccggagaagatcttgcggcgaccatcggagccatcggagttcaccacgtacatccccggcagcccgacgaacgcgatcttcttgccgtcgtgcgagaaggagggaacgacccgtcgatcctgaacaaggagaacgtgtctgccggccctgggctcttgatgttctccagcagcaacggcgagtcgccgttccctctcccccagcaccggtggtacccaacgcgtgcgccgtccagcgagatgaatgggttgaaacggtgcacgcgcggcgccacgggtctggtcacctcaaagtaggcgttcttgtcgtcactcatgtcgatcacctcgatgtggcggtagtccgagcccgcaagcctggtcgccaccgccacgagccccggcgcaccgggcgacgcggccggcgtgaaggcgtggaacccccgcggggtgattcgctcgacggacgccgcttcgactctgtcatccgtgacggaaatatgttgaattggatccaaattcatttacacacgtataaaggccaactttggacggagcgaagcggaggcctgccgtcggaggcttggatcgttatccttttagggtttcacctttatatatacttcttgtgagccgtcgttcggcattgtaacctcacccgatatagcgaagatatttgctggctagcgctcgtggttttctctctcctgctttagtagggttttccatgttaaatgtcgtgtcttttgtgattgatctatcgttatttatcgtttatttgctgatcatttcctaacaggcgcgatagacgacgtaccaaccattgctatcctggcagtggaagaagacgatggtctcgtcggcccagctcggctagctgccgtcatggacggcaagtgatcgccaggacccgtaagcggtgcagaagacgtagatgtcagtgcgaaggtcctggacctcacctgtaggtgacatgggaccggggatatcttgactagaggtttggggcagccgcggtcacccacgtggcctgaccccctcgggggggtcgggcccgagggtgaagaggccgcccctccctctatctctccgaggggtcgggccgctcccgtttcgtccccgagggctggggcgccccgaccccctgagggtttggcgccacgtgaatgggttaggtgagcacagcggcgctcacctaaccgcgtttattgcgggttggacgagcgcatcacgccgcatttaatgcagtatagcgcaggcttatccggtccgtgacaggtcgcagtgtgtgaccggtcacagaccggtcagatcgcgggttaaggggcaacaggcggcctgacacacgcctccaggcactcgtccctagtcggagccggcgtggggactcctggagttggcacatcagccccagccagatacattccaggcttcatcgcaatcattgcaaggaagccattgtatgaagaagggcagacgtgtagcatgctaaactgacacgtggtggacaagaatgaccggtctgtgactggtcatacgccggttgcgtcattggcaaacaaccgtgcttccacgttgcacctgcttcagacggagtggaggttggtatgacccatcccatcggagggtcattcaaacagcagccattgcaaatctccgcccattaatgagggaggacagggctatcccggtgtcagacaaaagtacgagccaaatcttgatcaaagtaggatgggtccccacccaaaagaagggtaggtagaaatggtatatgtggtatccccttgagatataaaaggaggaccatgcctaccaagaaaaatgggagggagaagatctgagctcgtagaagggacggaaaaaaaaagagtagggagagggtctctagagttcaaacgctctttctctccagttctttgtaactccttcatacacagatccaccagaacacaggattagggtattacgcttctcagcggcccgaacctgtctacatcgcccgcgtcttgtgaatttgctctctcgcgaaccattccacagatcaagggcttagaacctcacttagcgccccaggccgaaccggcaaaggggggcccacgcggtctcccggtgaggagccccacgctctgtcatctggcgcgccaggtaggggcgcgcctgtgtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccgccgcccccctctcaccgaagtcttaggcgggaggaggcgctcgagggggtcgaaagatccgcgacttcgccgcccacgagcgatggagaaggacggcgagacggggagcgtcgtctcctcgtctacggtgatggcagcacgccccagggagcgctccaggctgcgggcgtgctcctgcgtcacccgcccgtcgtccctgatccagagactccaactcgacgttggctagatgacgtggccaacttggtcatgacggcgcaacagcgcctaggcgccggcgggcggtcctccgccaccaaggccactggcgctgctactgccggctccgtatcgtcgaggcggagggcgcggtgagcggcggccgttgcccgccgttcgtccgccattccctcgtcaatgcctccgacccaagaagatgtgcgtgaggggccggatgcccgcctcaatatcgagcgccggcgcaatgatcaccgtgctgcccacgcatcggagggcgcttcctcgtccggagcgccacttcggtcggggcacgggggccagccccccgtgtccccggttggcggtgccggctgtcaagcctttgtggcgagccttcggaacgtccgttggcacccaaggttccggcccaccatcaccgaaaaatacgacggaagcgtcaaccccgccgagtttctccagatctacacgactgggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccagggcacatatccgcgcccaggtgaagaagcggacttgcacgcggtacaacgaggggacgatgagtctcttcgctcgtacattcagcggttttgtcaagtccgcaacaccataccatgcatccctgcacacgcggtgatctacgcgttcagggggggcgtgcggcacaaccgcatgctcgagaagatcgcctccaaggagccccagaccactgcggagctttttcaactcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtccttgccgtcgagggtgcttcgcgggccacccgaaaggggaggcctacgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggacgtgggaggaggagaggaggcaggagcgccttgagggcaaggccccagcggctccctccggcaaccggcgaagtgaggccaagcagaaggcccccgccgaggacattgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcgttgcccagggaggacagatcgcgatggtggtttcccccaccgtttgcaacgtgaagttggggcgtgtcctcatagatgggggtgcagccctcaacatcctttcccctgctgcctttgacgccatcaaggccccggggatggtgctccggccgtcccagccgatcatcggtgtaacgccggggcacacctggccgctaggtcatatcgacctcccggtcaccttcagtggttctgccaacttccgcacggagcgggtgaacttcgatgtggcggacctcagtttgccctacaacgcggtcctggggaggcccgcgttggtgaagttcatggtggcggtccactacacctatctccagatgaagatgccgggccccggtggccccatcaccgtccatggcgacctcaaagtcgcgcttgcttgcatagagcagcgcgcggaccacctcgccgcggcatgcaagcccgcgggtggcgacgagaggctaagcgcctccgtcccagccgccccgaggcagcggatgatcacgtgcgacgaggtcccgatcaagcaggtggccctgggcgacggcccgtccaagaccacacgaatcggtggtcttctggacgacaaataggaagacgcgctcgtctccttcctgcgggcaaacgccgacgtcttcgcctggagaccggcggacatgcccggggtccctagggaggtgattgagcaccgtctcgccgtacggccgggcgcaaggccggtccggtagaaagtgcggcggcaggccccggaacgtcaagccttcatccgcgaggaggtggcgcggcttctggaggccggattcatccgagaggtcatccatccggagtggctggcgaacccggtcgtcgttcccaaggcgaacggcaagcttcggatgtgcatcgactacaccgaccttaacaaggcatgtcctaaggacccttaccccctaccacgcatagatcagattgtcgactccaccgcggggtgcgaccttttgtgttttctagatgcatactctggatatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacacgtaaccaagagaccttactctcggatctagcggaaactttcgaaagtctccgcaccgcccgcataaagctgaaccccgacaagtgcgtgttcggcgtgcctgcgggtaagcttatcgggttcttggtctctgcccgaggcattgaggccaaccccgagaagttacgagctatagagcgaatgcgcccccccagcaagcttagggatgtgcaatgtgtcactggctgtatggccgccctaagtcggttcatatcgaggctgggagagaaggcactacccctatttaagctcctcaaacgctccgggccgtttatctggacggaggaggctgaacgggccctcactcagttgaaggcgtacctcagttctcgcccagtcctggtcgccccggagccagatgagccgttgctactttacctggcggcaaccccgcaggtagtcagcgcggcgttggtcgtggagcgcgacgaggatgaccctcgctccgcgcatccccaccctgtgtcgactcgacccgggagagagcagggaggagaggcccccgagccgaacggtggcccaaggcccccgacggccgaagctggccctccgcccgcttgtccgaaggtgccaggcgcccccgacccccaggatggccacggggccactgcgggaaggccgcgcctgtcgccttctgaccccgaggtcatcggcacagaagccgagtgcgccccgcgcggcctctcggagcgtgacgaggacgatcctcgctccgcgcgtccccaccctgtgtcgattcgacccgggagagagcagggaggagaggcccccgagccgaacggtggccaaaggcccccgacggccggagttggccctccgcccgcttgtccgacggtgccaggcgcccccgacccccaggatggccctggggccactgcgggaaggccgtgcctgtcgccctccgaccccgaggtcgtcggcacagaagccgagtgcgcctcgcgaggcctctcggacgaaaagcgccctggagatgcggcccctagtgaagaagatcggccccgccgaagggtgcagcggcccgtctacttcgttagcgaggccctccgggacgctaagacccgataccctcaggcccagaagatgctttacgctattctgatggcttcgaagaagttgcgccattattttcacgcgcctcgggtcacggtggttac

SEQ ID NO: 32460 - DNA, 8651 bp, Oryza sativa
gagcccatctccgtccccgaggccagctcaggcccctcgcagctgcctcacaccgtctattgggtgatgcagttcgacggctccctgtctcttcagggcgccggtgcgggggtcacgttgacctcgccaagcggagatgtcctcaaatacctggtccgcctcgactttcgggcaaccaacaatacggcagagtacgagggactccttgcgggactcagagtggcggctggactggggatccgccgcctcctggtgttaggcgactctcagttggttgttaaccaggtctccaaggagtaccagtgctctgacccgcaaatggatgcttacgtgcgccaggtgcggcgtatggagcgccattttgacggaatagagcttcggcacgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcgaagtccaggcctcgggacccgaggggagcgctcccagctcccttagattgattgcttggatcgctgagatccaggcgtacctcgtagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgatggctctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggcatcactgctcggtttggggtgcctaaccgtatcattacggataacggcacccagttcactagtgaactcttcggtgactactgcgaagacatgggcatcaagctctgcttcgcctcccccgcccactccagaagtaatggccaagtggagcgcgccaacgcggaaatcctcaagggcctcaaaaccaagaccttcaacatcctcaagaagcacggcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttagtaggggtcgggtgtcaggtctcgggctcgggccaaccccgcaccccctcgggcgtgcagggttggccgggggctaccacatgcatatacttatcttttttctcttccgtatttcaataaaagtattttcgatttcctaaggactgtgtctgtgccattgtttcctttcgaagaatcttggcttgaattagcacgctcgtgcccgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgtggatctccccagacactagccccgacccgcgccatttgaggctgggacctgggcacgagccctcgttcaagccaagacatagaaggaccgcggcacagaccatcctcgtctcatacacacaacgaacagagctgacacaaaaatttcttctttatttgattgcagattaaattagtttgtacaagaaggaggcccgaaggcctcggaagaagaaaggaaaaactatctaagattggcgggggcctgggggctcactttgaggctcccgggtcgccggcctcgtcgtcactgtcgtccacaccaccgtcgccgccctcctcgtcggagtcgagggcgaacgcgagtcgaggggccgtaccctcgaagctgtggacgatgtggacggtggcgtcccggacctgcgcgcacgcgtcgtcctcggttccgggagggaactcgtccagcgctgcccacggggagaagtccgggtccctggcctggtagcttgccagtacaagctccactgccccccgggcgaggtctctcgaggatgacttgatcgtctcctcgagctcctcggggagccgctggagagtcctggccatctctgagaggcgctgggcgaggcccccctggttggcggcatatttcgcgatccgcccgccccagaggcccgcctgccgcccggcgcggtctagacgggagatggcgtcccgaagcatgccgggccctacctcgcctgccaagcggagggcctcgacctccccggcggacgagtctagcgcgccctgcagctcggcgatggtgtgttcagcagctgcgaggcaggcggctagatcaccgtcgcccgcggccgccccgccgctgcgcgccctcgcgtccagctccttcgcccgcgcctcgagctcagcggcccgctgatccagtgcggccctctcggcgcgggcgccttccagatcacggcacgcctgctcctcccgcgctgcctcgcggagggacaggctgtccgccagccgctgcgccacgacctcggcctcctcgagagcttgctcccgctcggtgagcgcgtcctcacggaggcggagtgcggactcctcttcggcgcaggcggcctcgtgcgctgccagcgttgcctcccggatggcgacggcggcctcgcgacccgccagttccctctccttcgtgtccagggcacgggcgcgctcctccagcaccgtggcgcgagcctcaagggcctcttcgcgctgccgggacgcgtcgagcttcttctctagctccgccccccggctcccgtattggaggcagaggtcgtcccgcgccgcgttaaacacggcggtggcaatgagggcagtctctcgctcctcctccacctccctggcgatctccgccaggtccctacgacgggcctcgagctccgaggtgtgccagcggtgtgccttgcggcccgcctccaccatggcctccaccgagcgtcgcccctcttcgacacgcgcccacaccgcgtcgagctccgcccgctctacctgtaggacctccatctgggcacttaacccgtccaacaccgtggtgttcgcagtggccaaggcctgcagaaggggctctgcgctcggtggggcagcggaaggcatggggaagagccgcctcgtaaaggatgccgcacggctcggcccgccgatcgacgtgccgaactcagggacgtcccccgaagctggctcgtcctgagcatcgcccgatgggtcgggcccgagcggtgcgcccgcggcctcgtcgtgggtggcttcggaagtcgtcgtcgcctcgggcggagtcgggtcgggggcttggcagtccgcccgcgtgcacgcgccgcctccgtctcccggatggactcctcggcccggtggagtctggcctcctcccaagcggcttcctcagcctggcgagcccggatagcctcctgggcagcttcctcggcttcccggaggcggtttgcggcttctcgccggtcggcttcccgcctccgggcctccgcggtcgccgtctcctcggcctcagaccggccggacttggaatggcgagaagggcgcgacgggatctcgctgatgcagaagaaaaaccagaagacgaaaaacgggtgagtgaaaacttgccttgagagatgggagaatgaatatgaccgcagtaggcgcagggacgaacctgcgaggaggtcgactaaacgaccaccttgggggggagatgaggtttccccggcttggttcggtcccccctattttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcctggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatggtgtcctcgggcccggtgtactcccaggcgccccgggcgtgccgctggagcggcgcgattcggcgacgaaggtagtcgccgaacaccatggcccccgtgagcccctgggatcgcaaaccggccaggcgatcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcatcccacttcttgcgaaggacgcagggaatgtagcggttcagcaccggcccccgcggttggaagtagcagccaccgactaccgacggtggcgacaccggctgtacggtgaagaaccaccggaacaaccggagagatgggcgcaccccgatgaacatctcgcacaggtgcgcgaagatggccaacgtcattactgcgttgggggtgaggtgcgccatctggagatcataaagctccagaacatccatgaagaaagaagagaatggcggaaccagccctgccattgcgaagggaaggaagaatacggaccaccccgggtagtgtggcgccgggcgtccctcacccagcgcaaccacctcccggccggtggcagattccggcatgaatcggcgcagcagcccgacctgcctctcgctcacgatacgagaaggcggcagcacgctaccgtcgagcggtgcggagccccgtaccataacgccggcggaggaggggtttgagagcgagtgagtgtggcgagggtagggcacaggaaacgagaagttagagcgcaagcggcgaaggcaaggggaataatggcgagaggaaggaagcgaatctcttcctcagcgtctttatacccttgccaaacgctgtgcccggctcctcgcttcccgcgcccactatctcgccccctcgtttctcgcgcccactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacaaaccggctcgtcccaattcgtgcgctactcaagtaatgtagcggtcttgaagaaagccgctcattattgtcggtcggtttttcccttgccgatgcgcgcgatttgcgaccactggattcctgtccacctgtagagaccggccccacctgtcaccaggcctgaggagtggcgtcacgcccgagcgttttcctcgaggagggcgatcgccctggcataacgccgggggctactgtcggtgacatgggaccggggatatcttgactagaggtttggggcagccgcggtcacccacgtggcctgaccccctcggggggtcgggcccgagggtgaagaggccgccccttcctctatctccccgaggggtcgggccgctcccgtttcgtccccgagggctggggcgccccgaccccctgagggtttggcgccacgtgaatgggttaggtgagcacagcggcgctcacctaaccgcgtttattgcgggttggacgagcgcatcacgccgcatttaatgcagtatagcgcaggcttatccggtccgtgacaggtcgcagtgtgtgaccggtcacagaccggtcagatcgcgggttaaggggcaacaggcggcctgacacacgccgtccaggcactcgtccctagtcggagccggcgtggggactcctggagttggcacgtcagccccagccagatacattccaggcttcatcgcaatcattgcaaggaagctattgtatgaagaagggcagacgtgtagcatgctaaactgacacgtggtggacaagaatgaccggtctgtgactggtcatacgccggtcgcgtcattggcaaacaaccgtgcttccacgttgcacctgcttcagacggagtggaggttggtatgacccatcccatcggagggtcattcaaacagcagccattgcaaatctccgcccattaatgagggaggacagggctatcccggtgtcagacaaaagtacgagccaaatcttgatcaaagtaggatgggtccccacccaaaagaagggtaggtagaaatggtatatgtggtatccccttgagatataaaaggaggaccatgcctaccaagaaaaatgggagggagaagatctgagctcgtagaagggacggaaaaaaaaagagtagggagagggtctctagagttcaaacgctctttctctccagttctttgtaactccttcatacacagatccaccagaacacaggattagggtattacgcttctcagcggcccgaacctgtctacatcgcccgcgtcttgtgaatttgctctctcgcgaaccattccacagatcaagggcttagaacctcacttagcgcccccggccgaaccggcaaaggggggcccacgcggtctcccggtgaggagccccacgctccgtcatcaccgttccaactggcggcgccaggcaacgcaatggcagtccactcacccgagggcgacacggcggggctgaagtccgcaacaccaagcggcgtcaggcggcacgtgcggctggtggacagctcgatggagttcacagcgacccagctgctgcgcggttccacagcggggatggcggtggagacatagacaaggtgggagccgtcgggtgtgagcgatagccggtcctagagcgcgatgggttcccagggagcagcggcgagagagccgccgcctcgagcgcctcgtggcaggaggagggtacgggagagaggtagaggttgagggagccgttgcgctcggagatgaagaggatggagtcggagtgggaggtgggggcgaagttgccattgtagttgacggagacgccatcggtgaggtagagctcggtggcagggttatgcggggagggcgagagggggagagagaagatattaaactcatagcggctgcggccaagggtggtgaacacgatggtgccgccgctggccgacacggcctgcgaggcgagcagcgcgccacgaggagcggcgagcaaaggagtggctatggtcgtcagactgaagcgagctaagtgagatagtgttgagagacccgcttcaggttgttggatttggggatttgttttgcctatttttcgcggcttccattggtgatggtgtgactacagagctctagatatgcacaaacaactcttttttttctttttttttgttaatggctttcaacatgataaaagtccacataaaaatcgaaccatttctagctaatcatgtaaaaaactttaggtgaattttaatcccattgtttgccgcgtgattttttttgtttgttttttgcattggctccttgacggttggagattggggaggcgagcttcgtcatccggtgtggtactgtggtgtcctactcagcttttgctactaaggaagaaagacctgatagcaagcagccaagcacactcaccctatctctacttagatgcacactcgactatgactctgaccatctccatagacatacaccgtttgctacttaaaaaaatataatcgtaaatataaacacatgtgttaattcttatgaattatagagaaattcattctattatagcatagaatgatatagtatgatataacctttgttataggattgtaagtcgttttacttttctggtaaagcgactctatggctggtgaagttttgatggtgattttacccgggtaagaacacat

SEQ ID NO: 32461 - DNA, 1090 bp, Oryza sativa
ttcctgcagcccgatttagatcacttggcactgatcaatggaagtatactaactaattcctgaaacagccacatgcataatgttgtgatggttatatgcactgcgtagtgtgtaagacaacttgttttcttgatgttactattgctatatacaataatttcgttgttgtttcattttttgctacctcttaccagttctgtgtatgtgttacaacgttacactttcaaattttacagctatttagttaaacacttatttatattcattttcttcttttacatctctttaagtgaattttcatattatgccctgaaatcccaacttcaatctgaatacagctatttttcttggtctatgcaatgactctgcactggctcaggatgattcagctggtctaggagctacaagaaatgagcaaactgaggaaaacgctacaggtttacagcgaatcgaagatggctcagtggtctcaaatgaacacactgtcaaatggagaatcttcactgataatgctcgagattttttactgaaagcaagtaactcataacctgtagatttattcaaaccaccttttgtctctaacttacttttatactgttttaccgtttattctaagcaatagatctttctaaagaacagaacagcaatcctattagatatatataacagaacaacaatcctattgtatagtccagaaggtggttgatttttcagtgaatcaatttgtactcgttccacactttccggtcacctgctgatactgccagtaggatgacatcatcagaaaccttggatatgcacttctagttttcctattaagctatttatcgcttcacatatgtattccacaaccataatgttaggaaaataatttgcttttgctcgagagcttggttcagcacttccttccctgacagggaacttatgtgtttattattggatggggagaacaaggataacttgtatccatgtgccggaccttcattctgcatttctgcttggtggagaacctaccaagcatataacatggatctcctatcctgcggaaaggaaaaagaatttcacattcttcctttcaggatgggaggat

SEQ ID NO: 32462 - DNA, 2303 bp, Oryza sativa
ttgttagtttggttatttactgaagactaatatgctctttaatccataatataaccttgagttttacaaagttgaatggccttgctttgctttgaataaataaataaacaaattcatatacacatgcacattgaatcggcaacttatttgttgtggtgcttggttttctccgtgacctcattctgttgttatccttagaagagctgcatgttagttgccatcgctccttcaccatgctcaacgctagttacatgctagcttcaccactttgccctgaaccataatttggtctaaagttattttgtttattgggatacattttattatatttttgattttttttgttaagatatactccccctgttgtcttttaaccgttgttaggacaaggacattgtctccagggcattacttttcctattttatattcataaaaatattaaagatataaactgcatggaagggattcgaatgaggtcattatcagataccaaatcttaatgttgttacacatgttaatgagttaagatttcgaggttttactgcaccacgttctagggcatcatctatttgagaacacagggaggtggaagggggaggtcagagggatgaacgaaccattatcaccaacacaaatatttatagtaacataattgataataggtatacattcttgctcttcttgagtacttgttgagggtctcagtatagtttcgcctttctcctgaacatgttggtgattttacatctagggatagcatattccaaattgcttagggttacttactaatagttaaaattacatggtaatatcaattgccatgtggctatctgatcttggttgaagagagcataacacacacagatgtcagcttacattcacttagctgaagcagattattgatgcaaggacaatggtggggaaaaagagggagttgatgaggaggattaggatctagtaccatgatatgttttgccacccacaactactcttcattctgtttgcgctaatcacactcaagttaaatgggccaggtgtagacagggctatgtatatgtcaatactattaacaccgcaaacaattaatactaggctggatggagccaaatattttaataaattgttactcccaaattttgcaggctgagttttataggttaaagaaagaatacgagaaggctgagctattgtatctggaagcaattgaaatcctggaagaatcatttggatcggacgatataaggtacatttggatcttctttttctgctatcattcattatgggtagactgcaaatgttgtattatcaacttggagtattcactaatgttaccactgtaactaaactttatgccagtatagaatggtgagaaaattaggtataaccagtacagtactacccaaatcctatgcaccattaaaacaactagttgataccccgcgctttgctgcgggatatgtggatgaatgcatgttatacattctagaaatgatagatgtacatgtttaaataatgtgaaaatgataatgatttgacattggttgcatattgagttctaaaaatacaacaaaattgtaaatgatatgttatatttgcatgatatttaaaatactatagataataattgctagtgggtgatgacgtagcacacttgcatgtgatttaaaatactctagataataattgctagtgggtgatgatgtggcatacttgcatgttgatctttagaagttagtgggcatcaactttatagtaaaataggattaggtccactttaatcgaaacttttcaagttctctcactttatcattcctgttgctcctgtcaaatcgcccaactggcactaaacaccagattcttcttgatctcctccctgcctctggttggtagacaacccccagatgcacctcatgctgagttcccagccccttcctgtctagatccgtcctggagcttctctcccaactccagtaccaggcataaggggtgccgctggtggttctaattataatgaatccaaacactaattctaattaatcaatcagcgatttacaacaatctaagttcaaactaaatcaaatcaacacaacctgatcatgctgagcatgttacataaaaaaccatatcatactccagaaagaatcttcattacagctgcatgtgaacaattagattcattgtaaacatggttttaaaacgttgcctaggtgtctgggtatgctgagaggtcagggtgtcgcctctggcttcccttcttcacatggagcgtatgcttcccatgataaatcatgtgaaatcgagg

SEQ ID NO: 32463 - DNA, 14849 bp, Oryza sativa
ttgtgaagtgttgacaaagagagtttaggaggagacggtgatagtgcatggagtctgtctgacatgtgcttggacagacaaaaggggggggggggagggggagaaattagactgttagaggtgtggatggctcttggagtctcggtggaaggctgccaagcagtggcctagccttgcctggtcaatgatttgaagggagaagaaccaatgtgctggggaagtggttagtggagtatccccaatcaagagaggctatggagtgctatatgaatatatgatgagaggaggaggctagaagctgaaaccggagaggaaaatgaaattaaggcaagtgagattgaggcatctggtcaagttgttaggagagttgctggcatgtatcatgagtggtataacacaaggcttgtgaaatttaggtggcattttagttaacactaatatttattaggtggtatataagtggtaaaacaatcagttatgctacccctctcgtgtaaatgtacaagatgtaaagagcctgaccacatacttaggccccctttgattcaaaggaaagttagaggaaatttggaggattttattcctatggtatcttttcctagatgatcctttgaatcaaaggaattgataaaattgaatcctatgaaattcctatgaaatgcctcatgccatgtaagttttggaggaaatctaacatgaggtagaaccccatggaaactttcctttgggtcttaatctctcctctaattcctgcgcttttcctgtggtccaatcaaacggtcattcatgtgttttgcaatcctttgttttacacttgcattcctgtcaaaatcctacgttttctcaatcctgcaattcaaaggggcccttgctaaaaaaaacaaagcgtaattttttatttattcaaattttaagtgtctttttgcaattacttctattttaatcaaactcccattctgtatcttttacatgcttgaccacatctgggtaattatcttaattttgttttaagtgcttatttccaattattttaatttcaatcaaattcccattctatatcttttatatgctttaaaatatatggaaacacaagatgttttgtctttgttttctagttctggtaattatcttaatgttgtccatctatgaatcatactttactgtagggttggaactgctttgcatagtcttggaatatgctaccatcttcaacgcaagtttgctctagctcagacatgttatgaggtaccttttacggcctcataggtcttgtctattctgttctgttttttccttggttcttttactgtgatgggcagtctgggatgtttttgtgtagaactatcatgcaatagagtactggctattgtttatgggatcagcatataggggcagtagtattctgtgttccttagcttcaattgtagtgtttgtgctctgtcgagagtggtaaactaatggagccattttcatagcatcttttgccagattgaataatgtgtactatcttgctccaagcatgtaggttaaagaatttcctaaagcatcgtagcagcaatacaatgaccatctgagttgtggcccacctaacctgtttttactacagataaggttgtgcttgcagaatgaaaatgcacaataaaagcatcagtgaaaagaaaaaaaaacgatgctattcagttcttactataattattttgttagtttttttttgtgctcttgatgaatgtgttttgccaacataagcttgcttctaatactgtcatctgttcctgttgtttccttttgcagcgtgctttgaaggtactgtaagttaacttatttgtgactcctttctctctccaggttgaatatgtatttacctgaatttcatgtattggtcatcaatggtggtactaataagtgatatcacattaacagtacttgagtcagtgtttttgttctgcattcacatcattgtttttgatttgaatgatggcatgcaagtaggtttgactgtaatttcacagagagcaagacaacagtgtcaattgttctgcattcacatcattgtttttgattgaatgatggcatgcaagtaggtttgactgtaatttcagagagagcaagacgacaacagtgtcaaagttgcgtgtaaattatagtggtgcaaaagtagacttctttttgttgtgttaatttggtcatctatccctttttgatggtcttatatgctatatggaggttcactggcaacattttttttttttaaaaaaacttattagttgagttgttgaaagttcaagatcttatccacaatacactatggataatgggcctttgacctttgcgcaccaccacccccctgttcttcatgctagttttgttgattcaactaatagttagtacttattagtgatttctgcaatgaatatgcaataacaatgcatatcagttgacagttactgatccgactagaaaataacttgtctttgcttatatgtaaaaaaatatatttaactacagtagcaaggaaattccatttattactatataatatgtctgttttaattgcatctgtagatagaaggacgtgttatggggattggtcatccagagtatgcaagcacaatgtaccttcttggcaaggtactgttgctccttttatatttatattgctgctgtatatcgtgctctacattatagactcattaccttttgtcagtaatcttgcttgtgttaccttagtcctgttcctttcaatcagggtggtactagcagtattttgctgtttaagctattgttgtagtgtttttatattttcattattttgtgactgcaatcctgcggcatattgcctttccaaacctgcacattccagctgaggatacttctgttttgctgtttaacctatagatataactttttacttttttttttcttgtcaatgtatcagctcacattatcttcctttcttttgctacatttttctgtaagtaatcattgccttttgtcgagaaccaatcagactcctagtgaagacctgaattgtactccctccgtccaggaatatgggggattattcccaatctagcacaaattaaggaagatgaaagattgcatctaagacatccagcaatacacatcggcacattgaatgaactgcacaatgtacacctttggggattaaactattaaactttggcaggttgaatggtgtggagtagcactagtacattctctgtatttcttttattctgacgggaactggtggagtacttaatttctagtggatggcatcgattgctcctgtccttgctagcctcgggtaaacaactcttatattcctggaaataccaaggggcaaaataccctatattcctggacagagggagtagtatcatttgaacttattctgctctctaattgataccaccatcatttatgttgatttgatcataaaatttcttctactctgattttccttgtcatgtaaggttgcgagggagtagaaaaaaaagaaatatagaatagtaaaagtatatctggcctcatggtactgtttggcaaaaactacttatattagtatcctcttgtctcctagagtcatttatttgtagcgacccacctatacaaaagaactcaatcccacaattctatgctaattatgaagttggtcattatggaaagaaggaagctgtcatgaacattttcctcctgctgtcactttcttgtcagataaaataattacttcctttgttccaaaatataatcatttctaggttgtttagcaaatgctagggttaaggggaaaaattttcccttttcgtcacttcagttcaatggccaaaattttgaattatttagattccccacccaagcacctgattggctgaaaatgcatggatttctgtgtattgattcagtgtcccagaaatgcttgtattgtggtagaaattttgaatcctagaaatgcttatattttggaatggagggagtagaagatattaattagggataaggttttgtatttaaccttttcctatctccacagttgtgtttagtgactatagtcacataagcctaaatttctttgctgttattaggtgttaagtcaacaaggaaaagatgcagaagcccttattgaagagtctatcaggatattggaggtatgattaccatattagttcataagtttggatcttttgtatgtgcatgtatatgtttgatgaggattttaccatgattttaggagtctgggcttggtgagtcaccaatatgcatacaaagaatgaggtatctctccacggtaagtgcttattacaacatctcagttgtctgcaatttttagcgtttgggcactcaatatctatgcatatgttttactgtacatgtatattggtcctactaaactgtggtaagagttgtattttttatttttatgcatggcattttgccgctgaacccacatcaaaggcgttaaatacactgagtaaacggtagacaagctgaattttattttctataagtaggggataagcccaaaactgctaggtgccaggggcgttgcgggggagtgagtgcggggctgggctggggcataatgtgcaagggcatggggcgcatatgggtcacgacatgcggggttacacctgtcacagctggtgatacactacagtagatcgtgccagatatgcaacagttggtgttttgtgcgtgcgtgagttgagcctgcgagctcgtttgagttgttgagcctgtgtgcttgcgtcatgtgactagctctgtttctattacagcaaggggaaggggttatgaaaatgaatagagaaaactaaatctatctccatctctgctctgtttctcttctgttcttctctgttcttctgttcatcctttctctgctgcttctctctatctctcgatctctctgcgattccaatctattacagtggtatcagattcgggtttttgtggttgattcttttcatactctctcgatctgactggtaaaaatctctgtgctccgggttggtggctacccctgcgtgcggccgctgtaagttcggttctggttcggttggatttggagaaggcaccacggcgcccatcaaactcagtgctccattgcagcagtcgctggactcaatggagctcttggagaaactggagtccatcactcagaggatggaggctattgatgagaaagatggaaaagcacggcggctggattgatcaggtggccaccaaagtaaatctcgctttggaatctgtggggaaattgcagcaggagcatgcgcaggctgcgcgtcttcagaagcatgccttgggtgaccaagtgagtactctgggttccccgtcctctctctccatggctagtttgggtgcttcaccacctccaccgccgcctccacttcttgtatttctgaaatctgctccgcattgggatggcactgaatcgagtcgcccccttcccatgaagggggctgcgagccaagagttgtttgcgtaagatggatttgcctcgttttgatggctctgacgttcgtatttggcttgatatgtgtgaaacctattttgacatgtatcatattccatctactatgtttaaagtttctgcagcggttcttcatgtctggtattgcagcaaaagtggtatcagtcgtttaagttggttgaagaagttcgcgattggtctccatttcttcatgctgttgcgttggaatctgagcggcaccactcagcatgagaaagtgcaggttctgcaaacttggcgtcagactggctctgttgttgaatataaaaatcagtttgattctcttgtttaccaagtgcgtgtgtttgatccttcagtgggtggtatgatgttggtatctcactttattttgggactggaggatgaaattcgagctgctgtggtggttcaattaccagacactattttgggactggaggatgaaattcgagctgctgtggtggttcaattaccagacactattcaacaggctgcagctgttgctttaatgcaggaaagtgtgctgcttgagttgggaacttacaaagttaagaaactgtcatacaagccatctggtgttaaaggggaaacttctcattctagtgatgaaactctggctattaaaccagaaagggctgaattgtggaaggcaaaacaactaagagattatagatgggccagtggtctttgtttcaaatgtggtgacaaatattccccagatcatcagtgtgcagttactgggcagattaaggccatgcaaataactgaggtcatacctgatgatttgcttaatgctgtggcagctgaagagaactccgatcaggaggacacttgtcatatttctttgaatgcctagtctggtgccactcatttgaatactatttgactcatttggtgcagaataaagtgttactaatgttggttgattcagggagttcccatggttttattgatttcaattttgccaaactgctgggcctgccattgcatcccctttctccatcagtggtgaaggtggctaatggtgattctctcttgtcaatatatggttcctaatggtgattctctcttgtcaatatgtggttcctaattttacctggtggattcaagggcacacattctcttctgacatgagggtagtacacttagggggctatgatgcaattttgggtatggattggttagctctatggggggatatgtcctgtaattgggctcttaaaactttaaagtttcagtatcatcaccagtggattgtgctgcaaggggtgcctgacattcagtccccacctgaattgtgtgttgtgtctttgcctcaagtgctgaaatggcaaaaagggtgtgacatttgggcagctgctttactggaaccacatgaagtgtcttccttacctccagtgccagccattgttatctccttgttgacagaatttgatgatgtttttcaagatcctacctgtctgcctcctgataggacttatgatcatgccattgccttgcttcctgatgctgctcctgtcaatagcaagccttatagatactcccctccaaaaagatgaaagagaacaccaagtcaaggagatgattgattctggccttattaccccaagcatgagtccgtttgcatccccagttttgttggtcaaaaagaaggatggcacatggcgtttttgtgtggactataggaagctcaatttgatcactgtcaaaagtaagtttcctatgcctattgttgatgagttgttattggatgagttgctggcactcaattcttttctaagcttgacttaaaagctggctatcagcaaattagaatggtggaaggtgatgagtttaaaacaacattcaaaactcaccatgggcaatttccgtttagggtgatgcccttaccaatgctccctctactttccaatgtgtaatgaattcagtgtttggctctttgataaggaaatatgtacttgtgttcatggatgacagtttagtatacagtccagatttgtcctttcatctggctcatctgaaacaagtgtttcttctcttgagacagcatcaactctattaagtgctcctttgcctgtcctcaattagaatatttgggccatattatttcagtgcaaggagtgtgtacgatcctgctaagactgctgccatgcttgcatggccagtccctactatcactgagctcagagggtttctgggtcacaggatattataggaaatttgttaagaattatagtattcttgctagaccattgacagtgttgttacagaagaaagcatttcagtggtctgactctgctcagcaggcttttcagcaactcaaagtggctatgagttctacccctttgttgtctctaccaaatttcaatcaaccttttgtactggaaactgatgcttgtgcctatggtgtgggtgttgtgttgtgcttaatcagcaaaatcatgaccagctaatcagaaactttccatctatatgagagttcttggctattatgatggcagttgataaatggagatgctatttacaaaggtgccctttcaccatcagaattgatcacaagagttcatgccatctcaatgatcaggtgctgggaactgagttacagcagaaagctatgactaaactaatgggcttacaatacaactttcagtacaagaaaggagtggagaacattgtggctgatgctttatctcgcatgcatgttcactcatctatttctgccttgacagtggttcaaccaatttggttgcaggaagcggtgaattcctatgcagtggacagtcaggctcagcatcttttaatggaattggctattaagtctcacaatgctcaaggtttctctttaactgatggtttaattcatcacaatggtcgtgtctggattggagctaatactggtcttcagactaaattgataactgccttccattcttctcccatcaatggccattcgagctccattgctacttatcagcgtttgaagaagcttttttcttggaatgggttgaagtctgctgtgactaattttgtgaagtaatgtcaagtctgccaactggccaaacatgagcattgattgcctggtttattagtgccattgccaattccaaaggaggcatgggttgatatctcgaaggattttattgaggggttacttaagtctgatggctacactgtcattcttgtggtggttgatcgctttactaaatttgctcacttaattcccttaagacacccatttactgcttcacaagttgcatctgcagtggacaaagctgtttttaagactcatggcattcctcattccattgtctctatcatgataagatctctaccagccggttttggggtgatttgttcaaagtgtgggacactcaattgaacttgagtacggcttatcatcctcaaacagatggacaaaccgaacgtgttaatcagtgtctagagatgtatctcaggtgtatgactcaagctacacccactaaatggaatagttggttgcaccttgcagagtattggtataacacatcctttcattctaccttgggctccttgtaaagccttgtttggagtagagtctcatgtcagccaagtgccagttttgttatcttcagttcatcagtcagtggctgatttggtgtctgagcatgaccagttatctgcattctttcagcagcaactccagtgagcacagctgcgtatgaagaacaaagctgaccgaggtggttctgagcgctcctttgaggtaggcataatggttttcctgaaactccaaccatatgcagagtcctcagtgataaatcgtccatatcctaaactggcattcaatttttttggtcccttccgagttgtggagaaggttggctctacagcttatcgcttggaattgcctgaaagcagtagtgtgtgcatccggtgttccatgtttctcaactaaaagcccatgttcatgatcacactccagtgttttcatcactgccttctccagttgtgctcgatgctgcaggtgtctggtctgaggaaatcctggatcgctgcctggtaaaaaaaaagaggaaatgctgcacatgtgcaagttctgattaaatggtcttcgttgcctactgatcatgccacatggcaagattatgaagtccttaagcatcggtttccttttgcaccagcttgggggcaagctgtgtctccggagggcggtactgtcacagctggtgatacgctacagtagatagtgccagatatgcaacacttggcgttttgtgcgtgcgtgaattgagcctgcgagttcgtttgagttgttgagcctgtgtgctcgcgtcacgtgactagctattaggcctatataattgggaccacatcgaggggaagtgattatgaaaatgaatagagaaaactaaatctatctccatctctgtttctcttctgttcttctctgttcttcttttctctgctgcttctctctatcttcggatctctctgcgattccaatctattacaacacggcggcagcaggtgtgcggctagtagttctgggctggggacccatgtcacaggtgcccagggagcacagctgggcatgggtaaggtgagcctagctgcctaggcatggtgtgtactgggccaggctgatgagagaggatagatttggtctggaggaggaaggagggaaagaaacaaaaaggaaggggtttcttaacaatcagggtgacattggttaacaaggtagtttacagaaccagtagagtagcattatgaattggtgttaataaagtcaaaatgatattaagtcctgttcaggagctaaagtgagttgtttgttaggattagtcctaaaagtgcaaattttgtatcaccgttcagattagaggtcaaatccatgttactgaggaagccacacatccattatgcaaggatgctggtatttcatgaggcaaatactaagaagtatttctatcctcaacccctctagttctctcagatcaagctccacattagacttatgaattatgtatgacaaatgaagatcacagcaaaataatctcagaaaatttccaattctagtttattcgaaagtagcacattttgttgtttgatagttggtacttatttgatactttatatcaggagttgataaagtcaaatcgacttgctgaagctgaaaattggcaaaggaagatattacataatctggaactctcaaaggcatgtcgatatatcttcttgcttttgtactattgcttcattatttgttctggtgatagcactgcttatgcgaatttggtcattgtcatgatgcatgccttaaaaaacgagcttgagttaatctatgtcttcagatattaaattgatttttggttgtatttttgtttctaaatacaattgttctagtgttttttgtacttgcatcctgtctagcaaggcaagagaatgatgttctcacgatctaggttgtgctctagttcaggtgtattaatgcagatgagggcaataaagtcttgcttcagctattcatggtcaatagatagcctgaaatataggaaaatagtaatcagaactaagtagacgattgaatggccgaagtaattgcttgctggtcaaagtacatgtttagtgttttcctatatgtactcatattctactccctctgtttgaaactataaggcatccttgttttcctcaaagtcaatatttaaatttttgactaattattaaactagaagtatacgtgtttagaccactagattcgtttttgaatatattttcacatgatgttaattttatagttagtgacaatatattattatagtcaaagtgtcatgttggagaccatgtagaaacctaatatgccttatattttcaaaccaggggagtattttaaaagtgtagcttatccatctacccctctcacctatagggacacttccttgatccacttatctgataaacttttatgagcttatgtgtcaaggattagatttgttagtatctctacttccaaatattaaagacaagtttcttatggcatgtacaacggtgttcattaacgggctctttccgttgctatgcaagtaaatttggtgacgtgtaagagagagggaggaaagggaaacatcgttgctatgcataacagctcggagtcgactcttagcatttattaaaggaaaatttgctgcatgtgtttggagaaaaggaaagaagtgcaataaaaaatattttggtgtattaatggttaagaggtcttgttgtctcaactattgttggaggataatctctaagtgatatgtattaactaagagcgactctacctttgtacatacccttatgggtcaagttagcctagctatataaggatggagttgtatcttcaccctggaaagaacaaaccaagccaaccacctcagccatgttccagtaatactgtattcttagcaaccgatggaaatattgtccctatcccctctccctgtagtagtttatttttgtatgcaccatagtccacggtaaactgaaaagggaattaacacaaatattccagcaatatcaggctcggtcataatgagtctattaatggaccatgctaaccttatatgtcatattcttttaatgaacaacctcttaagtctttatcaaatcttatcatgaatcatccaatttttttacaaaacctatcaatgttcgtctttgcaattgtttgataggggtgggattcatttgacactacgaatgcagctgaactcttaacaatgactcttcaaaccatggggaagttgaaggaatctgaagaattattggaaaggtggagcgtaaaagctgtttattttggccattgattgttttttaaatttcttactaacataattttattttttgtattatatttagatgccttgaagtcagaaaaaggattttgtctgaggaacattttcaggtttgtatcatatttaatgtttcacgtgatctttagtggaaataaaacatgaaagcatcatctcaatgaaaaaactcacgagctttcttacatgatcacaattctcttgtttcttaaaattatggttgccagatcacttaccaggtatttgagtttttcaccacaagctctgctttattggcaattaacacagactgggaggtatttgtgccatgtgcccctgccacgatgcttgattgggaagcaatgtaatcactgttgctccatatgtattttactaggtcatggtggcatcgccaattcatgttgattatcaccatttccatagtttgatgattacatgattagattgcttcattagtgtttcacttccttggtgcatgctgtgtcctgagaagctgagcccaagaaatgcaaatgttttgttgaagaatgtaggactcccttgctttaggtagagtattgtccatatcaccaatggcaattgtcattgttgactgatggttgcggcagctacggcacacacaagaccatgtgacctgcatctgctatgttgagttcacggtgcacccctacatgtcaggtgatacagcaaaatgcctagtggtggggaactggggactctagtggcaaactggcaatcaaaactaatactctaatagtagcattatgatgctatgatcctcaaatatttggatcaatctaatgaaaataataattaccatatagatacccttcagtcacaaataagtgttgttttagaatccatgcgacataattattactacatccgtcccagaatataagaagttttagtgttagacacggttattaagaaagtaagtagaattaaatggagaggttgtgattggttgagaagtggaggtaggtgtagaaattgaatggtggagggttatgattggttgggaagagaatgttgatggagaagttgtaatatttttggacaaaattcttagtgctagaagttgttatattttaagacagagggattattgtttagaatatagatctgggtatatgaaaataacatggccaaattcgttatatcaaaaaagctttcataatgtcacgcttctgcaactcattttggatttatggaattgaattaagtggtcaaagttatgtcttattggcttttggctttgaaaagtcgacacttatttgtgactggagggagtacagtttagtcttccacaaatatgttattgcgagatttactgttgaaggtgcatccctggaatcatgaaaagtcaataacaccgagaattgggttttcctgccgtttcatatacaatcaatttaatactggttgtcactagcaactagctggaacctagtccacctggtgggttctaactgggtattgcgactacttaacacagtttttgaaatgattccatctccagtggacagtgattgatttcctgttgttcctaatgttacaggtagctgttactttggtacacttggcaaggctaaccatgctaaactttattagtgacaaggaggacagtgacctagcaagatccaaacttgtcagggcaaggctacttgtcaatgattcaatcaggtattccattgaggttgttggataagtctttgtggtccttggtcgtgattcttctttttgcttttgggtagtttcacctttttcaggacagcatctaccctttagcatatttttcagttgctaggacagttgcggttagtaggacagcagcagttagcatctcctttatgcctcctttatgctttattaagtttggatgccctctaggacagcatcccatttaaatttcgaattttagactaggagggtgcagcaataggctagcagccagctatggctatatatatatatgtatccaaccttcctcgggtaggtatggcttttgtgttttgtgaatgaagaaaaccagaaaattgccccatctcgagtgccattctcttctcaatgagagtaaccattgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcggcgtcagcaggacgccgagctcgccgcagcagaagagcgcaggcgagcaacggctcaaaccgctgcagcagcagcgagggcggccagactggcggcagcggagttggcagcagccagcgcggaggctgatgcggaggcggaggctgcggaagatgcggcacgtgcggcggaggtagaggttgataccttgcgcagcaccatcaacgactctatc

SEQ ID NO: 32464 - DNA, 5616 bp, Oryza sativa
tgccaggaggcctgggacgccatcgctgcggcacgcatcggcagggaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacttacgacgaggagagagctgtcgagaagctcttccgctacgtccctgagaagtacaggcagatcgctcgctcgatcgaatctctgctggacctctccacgatgtcgatcgaggaggcgttaggtcgcctcaaggtcgtcgatggtgatgagccacaacctctcttggggcccatcaccatcggcgggaagctccatctcactcgggagcagtgggaggcctctcagggtaacgggaggaagggggagtcatcttccccgacaggcggccgtaagccgcgcaaggcgcggggaggtgtccagctacggtgggcgcgaagacatgccgagggtggcgcccgcagaggcgcccagggcgttgccaccggcaaccacaagccggcacgagacgacgcctgccgcagctgtggcaagcttggccattgggccaaagactgtcgacagccacgacgcggccaggtccacgtcgcacgggtggaggaagagccggctctgctcctagctcatgcaaacattgagctacctccagcggcaccggccgcagcggctttcctccaccttgatgagccgaaggtactcgtctccctctgcaacggctccagcaacgacaaggctgatgggtggtacctcgacaccggctccacccatcacatgaccgaccgacgggagttcttcaccgagttcgactccagcgtccgaggctccgtcaagttcggggacgcctccggcgtcgagatcaagggtgttggctccgtcaccttcactgccaagtccggtgagcacaggctgctcaccggtgtctactacatccccgcgttgaggaattctatcatcagcgtggaacagctggatgagaacggctcacgcgtgttggtcgaggacggactcatgaggatttgggatcgctgtcgtcgccttcttgccaaggtaaccagaggcactaatcgactctacatcctcagcgcgcaagtcgcacaaccagtttgcctcgccgctcgtcgggacgacgaggcgtggcagtggcacgagcgcttcgggcacctccacttcgaggccctgaagcagctcagtgccaaggagatggtccgaggcatgccgtgccttgaccgcgtggagcagctctgcgacgtctgcgtggtgacgaagcagcggcggctcccctttccccagcagacgagctttcgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcagacgccatcaggcatgcgcaggctgctgcagaggcggagtgcggccgcaagctgcgcgtgctgtgcaccgacaacggcggcgaattcacagcggctgaattcgcgtcgtactgcgctgatgagggcattcagcgccactataccacgccgtacagcccgcagcagaacggcgtcgtcgagcggcgcaaccagatggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcttaccgcatcctcgacccggagacagcgtgtgcgcactgcgcgcgacgttgtgttcgacgaagggcgagggtgggtatgggacaaggcggtggacgatggttggacttcaccgtcgagtacgtccacttcgagggagctgggggagtaggcagctcttcttcaccgagcgtgtctaccccagcccccgaatctccaccgactccgacaccaacacaccctcgggccacgacttcgactacgacgagctcttcgtcgacaccacctcagccagtgactccacatgctccagcaccaacagccactccaagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgcctgcgctcccgtggcatggatggagtccgtgcgactccttcttgcgctggttgctcatgaaggctggggcgtccatcacatggacgtcaagtcggtgtttctgaatgtcgacttgaaggaggaggtctacgtgcaccagccgccgggatttgtgattcccggcaaggagggcaaggtgctacgcttgcacaaggccctctacggcttgcggcaggcaccgagggcgtggaatgccaagttggattccacgctcaaggggatgggctacgagcaaagcctgcacgaggcggccatctaccggcggggcaatggaggaaatgccttgctggtgggtgtctacatcaacgacttggtgatcatcggcaccaaggatgcggaggttgcggcgttcaaggaggagatgaaggccaccttccaaatgagtgatctggggcctctctccttctacctggggatcgaagtgcaccaggacgactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagtgaccgacgacggagcagcagcatgctgtgaagaggatcatccgctacgttacggggactctcgaccacggtctctactacccgaggtgtcctggcaaggcacacttcgtcgggtacagcgacatcgaccacgccggtgacatcgacaccagcaagagcacgagcgggattctcttcttcctcggcaagtgcctcgttagctggtagtcggtcaagcagcaggtggtggccctgtccagctgcgaggccgagtacatggcggcctccgccacttcgacccaggcgctctggcttgctcgactgcttagtgatctcctcggcagagacactggaacggtggagctcagggtggatagcaagtccgctctggccctggcaaagaaccccgtttttcacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctctaggatcgggatggcccaacttccccacaagacgacgcacaagacttagggggagaatgttggataagtctttgtggtccttggtcgtgattcttctttttgcttttgggtagtttcacctttttcaagacagcatctaccctttagcatatttttcagttgctaggacagctgtggttagtaggacagcagcagttagcatctcctttatgcctcctttatgctttattcagtttggatgccctctaggacagcatcccatttaaatttcgaattttagactaggagggtgcagcaataggctagcagccagctatggctatatatatgtatccaacctccctcgggtaggtatggcttttgtgttttgtgaatgaagaaaaccagaaaattgtcccatctcgagtgccatcctcttctcaatgagagtaaccattgaaattctaacagaggtctatgtcctttttaacaatccaagatcttgatctccatacttacataaattacattcgagaactggtcagtgtccacattttaatatttcattgctgttgtgtccccattgacggcactggagacaagaaaactggatagcgttacagtttgggtgaacttcatatagcccctactttacaagatatagaagtttgattatgttagttctgcatttcgagaagcctaattaagtggttaaccttgcctagtctgccttggttctgcattttgaggtaatcatatctggcctagagtgaagtctaattaagtagcaatgcttctggccagataccataaaataaagtgcaaagtaggcatatccttttagactagtttacttgctccaaatgacttaagatgttctttttggggcataatagcctagtagggctactaatggtgccaagcttagccaaagtagctaccaattctgtaagtcattttcataaaaataattcgctgtctgatttgcacctaaatgtaaagctgggcaatcattttgcctatggtaattgttcccaaccggctccaattaataccaaaattctggttaccaattatatttgagcttctttctgttagatgtatatttagattttatattcctttatttgtaaagggtttttctgtatatttgtgtattcctgtacctgtatatatttgggccttttgccctaaggtgaataaaagtgctgttcataacatggtatcagagcctaaactagggttagacttttcttcttgtcctagatgatccaaagatttttccacacacgttacctggtttttgtggtcgattttttcgcggtggtcatcgaactcgtcgtggtcgccggtgctgcttgtctctgcgccggcgaccgctcatctatgctcgccggccaccgcttgtcgtccccgtcaccagctccagttcgttctgctgcccgtcgctcaccgccggcaatcactcgtcgtcggctaccgtcgtccgctcgtctcctgccgctgcccttcgtcggttgcggcgccgctcgtctccggccgcaacccacccctcatctccagctgccacccgtcgtcggctgtggcgccgctcgtcttcagccgctgcccgtcgccgctcgtc

SEQ ID NO: 32465 - DNA, 2842 bp, Oryza sativa
tcgtgttgcccgccggtgtcgattcgtttccttcgaatcggtaccgatccagatcgggtgatttttctaaaaaaaataataaaaaaaagagcctcttgctgcctttcctgtgcagttgcaccagcgtttgggtgtttctccgaggctgttaaaaaaaagaaaagaaaagaaaaacaaaagaaaagagagagagagagaggttcctgttctttcgcttgttgccgctttcatttgcgctctcgccgtcgcccgttgctccgtgccaatgtcatctctatcaggcacagtttcagttcctcgttgcccagttatttttgatggcatcaactataatcattgggctcagcatatgcgtctacatatgtgtggtcaacgcctttgggacgttctttttggtgagctagcttgcccccctttccccttggctcaagctatgcctactttttcagctcagactactgatgaagacagagcaaaggcacaagaggagtatgatgatgctttggaaacttatcagggtcagtatgttatgtacaagacttggttggatgaggatgcttgtgcttctgctattcttgtagctagtatggaggtccatcttactggtgatgtggttacccttgcttcagctcatttcacgtggacacaccttcgtgaccgttatgcacctactggtgatgctctatatcttgctatggtgcgtcagaagcagtctttacagcagggagatgctacaggggatgagttctatacacagttatcctctgtctagcgccagcttgatcctttgggacctgatatttgtcgtacttgtcagtgttgtcagcgccagtggtctcacatggatcttcgccgcatctatgacttcctcacacgtcttcgctctgagtatgagtcgatccgtgcacagttgcttgctcggcacccccgtgttactttgatggaggctctaactgagattcattctgaggagattcgtcttcgtgaagcgggtattatatcgcatccttcttcagtactcgttcgtaccacagcttcagtgtcttcatcatcagcagctccttcctttactttaccagcacatacttcttctcaagtggtatcatcttccagtggtcatcttcattgcacttactgtgatcgagatggacatgtggagtcattttgctttaggaagaagaaggatttatggcgcagtcgttcttcatcggttgctgggagttcttctcagaagagtactcgctcttcttctcagaagagtactggcagttctgcagttctgatacacaggagatccttatgttactgcgttgcctcactgcttctgcttcgacaggtttagctagtttagttgctttgccctctgcacaatctgatttggttgttcttggttctcacttttcggtggattcttgattctggtgcttctttccatatgccccttgataagtctgtcctttcatctatatgtcatcctttagtccctattactgttcaaactgccgatggtacccctctttctgttgttggtcatgggactctttcatcttcttgtagtgttccttttgtttcctatgttccaaatttgaccatacagctcatgtctgctggacagcttgttgatcatgattgtcgtgttattcttgattctgactcttgttgtgttcaggatcgacgcatgggtctcctggttggtactggccctcgccgccatgattctcagcatctttgggagcttgactggcttcgtcttccttccgctgcgcttaccagtcttcttgcttctgctacctcccctaaaccctcttactcaagtctatagtcgtcgccctcgtgttatggagccttctgttgatgcttctcctgttgctcctccgagatacaatcttcgggatcgtaatttagttacgattcgtccagaggatcgctatggttatgttgcgactgttctcgctgagcctagttcttatcgtgatgctgttattcatcaagaatggcaacatgcaatggcagaggagcttgttgcacttgagcgtactggtacttgggatcttgttccattgccatctcatgttcgtcctatcacgtgtaaagggatctttaaggtcaagactcgctctgatggaactcttgaacactataaagctcgccttttagcgtgtggttttcaacaagagcatggtcgtgattatcatgagacttttgctcctgtggctcacatgaccattgtttgaactcttgcagtagcctctactcgtcattggaatatctcctagcttgatgttaaaaatgcttttctcaatgggggattgcacgaggaggtttacatgcgaccacccctaggatattcggttcctgagggtatggtttgtcgtcttcgcggctctctttatgggctcaagcaggctcctcgtgcttggtttcaacggtttgcttctgtagtcactgctgctggtttttcggctagtgctcatgatcctgcactttttgtccatacttcgcctcgtgggcgtatcattcttcttctctatgttgatgatatgattatcactggcgatgatgctgattttattgcatgtctcaatgctcaatttctgatgtctgatcttggttctcttcgctattttctagggattgaggtttcctctacccacgagggtttttatctttcctagaccaagtatattcaggatcttctggatagggcttctctcactgaccaacgcacgattgacactcctatggaacttaatcttcatctttctgccactattggtgtgccattagctgatcccacttgctatcgccatctcgtaggagtcttgtttatcttgctgtcact

SEQ ID NO: 32466 - DNA, 607 bp, Oryza sativa
cgtgcaaaaatccattttcaacctccttgtatcagtataaatgtaaaccaaggactaaaggtaggcagcaccatgctacatgttacattcaatcgtatgaaagcacaaattacacaatcaaattgccctttttgagagaacttctacccctgcagcctcatacgcggaaattcgtgtcaaagactctcaagaacgagtatatcagatgcttgaggcggctcactggtattgttcagagcgattccgctgtgtcggaggcattgacattgcaggggttgctagctgaagcgcaacagatacttgaagaacttggacacgagagcaactagaagtatggaaaagtaattattcatgactcggaggaacacctttgttgtgtgcaaggtcttctacgttggttttgcaccaacagattttgatgccagcatggatttttattgtgctctgagctatcgaccatatgctgccctagctggtggcgactttgcaagcaacaaaagatggtgattttgttttcttctggtttacaggtttatgctgccgtggttttttgtttgacctgcggatgtcatttgcccggcaaattttacttgtatcatgactgctc

SEQ ID NO: 32467 - DNA, 846 bp, Oryza sativa
gttctcaatgagttcctgtatcggtcacttcctttggttggttagctgctcctaggagtaatctgttgcgcgtcgctttttgtgatgcctttttctttctagagggttccttcttcgtggaccgctttgttgtacgtatttctgcttcttaatgaaatgaagcattttcgagaaaaaaaaatgaagaactgggagggaaaatctagtgccaactaaaaatagtggcatatagtcaatggaattccacctgtttggtgaataatgttgttttggtgttgtgaccttttcctaaatatgcgataataatatcttatgttgaatcgcggtgttaaatgaattccatatgcaaaatattctatacgtagcaaacagaatatcagagtgaggtacatgtttaaaacttcaaacggcttcttcaaatcaagaattagtgagggcatctttctttttgtagtaagcaactctattgaagataacataaaattgtaaaaacagggtattgtagttagttattttaattcttctacttattctgtactggaaactatatgatgtggttgatagctgttatacttgactgtgagtgctgtacaagaaaaaaaatcaattagatttgatgtagcgaatacacatataaaatttgatttgatattaacctttattttgggtattttgaaccaatcaacctcaaatttcagtgataacattgtttcttatcttactcttttggactactaggtaatcttcgaaggtgtctatgctttgcatcctgctataaggaaatcactggatttatggattgcagttgtaagattttttaccctcaaaaaaaagttgtaagatttt

SEQ ID NO: 32468 - DNA, 25645 bp, Oryza sativa
  unsure (1)..(25645): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaactaacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggggtgatagcattggactatgtccaaacggctagaaatctggcatatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttttatgatgtgcttctcttctttcctgcatggtaggatggcttatgtcttaatgtgatccgagtggcttttccaagtagagatgttgacctgcagaacatctcagaaggaacacacctatatgagttcaactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactcacaattcaaggcatagtccattgttcagttgtggtctaatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggtccataataagtgttgaggataataataccacctcaggatttaagcgagaaatatcttaacctaaatagggagttattggaggttccctgttgaccagttgaggtgggggtcggaatgccacacgcgcgcgcgccgggccaggccgtgggcgtgggcgtgggcgtggcgtggctggctggcggcgtgcatgcgtcacgtcgctatgcttttgcagccactaacccacgttcccacgattccctccacaacagcgcgtccacgttctttctcgtgatagataaggaggccgcgagtccgatccggtttcatcgcttctttcccggtgttagtttctccttctccgcgcctgagttgctcttgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgccaccgccactgctggcggaggtggtacgccgctgacaggagctcgatccggagctggtgcgccaggaggtgccgtgaacgacaacaacaacggaggcaattctgcctcaccatccagcggagggccattctcagggtataatcttctcctcatgctactgttgttagcgctatcgctatactatgtgcgctatgtgcgcgctatgttcttgttcctgttctacatgatgcctctagcatgttatcgcgttactgttatgttcctgttcctgacattcatgatgcgcataatatgctactggttatgttaagatcaccctacactgcttatgccatgatcattgctttaactttttggattaaaatatgccgattaatgactatatttccaacatggtacacacctgagattctttctggaaggacacaatttccacggagactacaccgagtcactggcaatatttgccgatgttgaactgccttttgcccaagctacacttcatttttacatagcagggtacactaggaagtaaacaagctcataaatgactgcaaattaaacgttactggagatgaaattttttgtctatattgttactgcaagagctttcacctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccatacctgactgccaaattatttgttttgtagtagatcatactcaccaaaatggtttatcacgagtctgttttctgaccacatttttgtctagacagtctgctgcaagacggtagttgcccagataattaggccatgtttagtttctaaaaactttttcctaaaaccatccaatcgaatcttgacatatacatgtaatattaaatatagataaatttaaaaactaattgcacagttagggagaaaccgcgagacgaatctttggtgcctaattagtccatgattagccataagtgctacagtaacccacatttgctaatgattgattaattaggctcaaaatattcttctcacggtttctagataagttatgaaattagttttttcattcgtgtctaaaatcccttccgacatctgatcaaacgtccgatgtgacactcaaaaaaaaatttcttttcggcccaacctgactgactgtcgattagaccgactgacgtcttctgtcaccaccatgatgtccgtccagcttgttcacattcctcagcagacagacatgcaatcacaacaattaacactaggtttatgtaccatatagtggtccatgatgcagaaatattaatattctcaactctaaattctactacaaaaaaaaagagtgacatgttgcttgtagtacaggcagtacggtttggttgttaaccacgtttctcatctactttgcctgcatttgaggtgctagagtgaagataaatcctaggttgccagattattcaaatattcaatcaagataaaagaaattccaagcttttccatctaacatctccctcattagaccagaaacatgcttgcttgcaagctactccctccgtattttaatatatgacgccgttgactttttgacaaacgtttaaccttttgttttattcaaaaaatttatgtaattatattttattttattggaacttgatttatcatcaaatgttttttaagcatgacataagtatttttatatttacataaaatttttgaataagacgagtggtcaaacgttgattaaaaagtcaacggcgtcatacattaaaatacggagggagtacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttagaaaggatgaaatgtgcaaagatattgcaaatagaaatggatattgtagaatcaaatgcgaactgtttcagagctgtccacaagaatagatataatatttctttataatactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctgatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataacaataggaatatgaaaatagctacaagatgccaattaatggagagcaaagactgtactatttctgaaccacatagtaaaaaaatttaaatgtttaaaagaatgttgatggaggttgttgggtacttcggttgatattcctaaaaagtacttcatatctcaaaacctcagtgaagtgaaccagcattgatttgctaacctcattatgccaatgacgatcagttggatagtgggtttctgcaatgcttgatccacctttgtcaaaagatgtatttctgttcttttgtgggatgttcacaactgagtttatttgagggtcctccagtgatgagaaatcagtgctatccaatgtcgagatcgatacacattcctcaaaataattcattgcctcttcagccaaatgcttcgatactttcagtcgttctacactactctggtaccacaacatggaaacaaaggtcaattcaaatacaaagaccatctatatttatgagcaactgcacttatcgtatctttaaatttcagaaaactacaactttaatgataaaaccatctatatttactgtagcagcatactccctctgtcccataaagaagtaattcctagattcccaatgcaaaactaaagagatagataaatgaccaaaataccccttattaatagcatattagtattgatggttaggtaggtaaggagtattgaagaaataaactttttcgatttgtgaaccaagtgtgaatgagaaggtagaagttgatttattttgtgacaaagtttgaattccagaagttgatttattttgggacagaacgagtataacgtaaaagttgtagttttgtgataatttttcacgttattgttgcagcaaactgatacttttatcactaaagttacagttttcggaaatttactcttctttaaaactacccttaaaacaagcattgaaaaccaaattcatggtggataacagaatgaccatgtagaaatacacaataccatactttcttatacttataagtcaaaatttaaattttcagctttaaatttggagttgattttagggttttttttcattatagtttattttccagatttttcttttagatcgctagaaacacatatataaaacttttattcatgaattatattccgtttaccaatatgccgtttggccaaacgatggccccgtttacctatagccatggctctagccgatgtcgttgaaatgtgggatgggaccaagctgtcagtcactgtcactaaagacgcttctacctccgttctaaaataagtatagccgtgaaaatccgtgtctaacgtttgaccatccgtcttatttaaaaaatttataagaaaattaaaataagttagtcacacataaagtattattcatgttttatcatctaataacaataaaaatgttaatcataaaaaaaattcaaataagacgaacggtcaaacgtgagacataaacagtgtaaaactccacttattttaggacggagggactactataaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacatcccctttgatgtttgaaatgaaactaagaaaatcattatgaatagatgtttacttgagcaacagcaaactgtttagtcgcattcggatattcatcaaaaattgctgttctcgttcagaataaagggaacattcaacaaaaatgtttctgctttaacgcaacacaaatggccaagtgaaagtgcatctcatgtttaggctgagtccatcaatcgtgtgtttctaggctcgtggatcaccaatagttctctaggctggccggagtattctagattcgaatttaaacatcaaatttaaatttttacagttgttttactacttcctccatttcacaatgtaagtcattctaacatttcttacattcatatttatgttaatgaatctagacatcaatatgaatatgaaaaatgttagaataacttacattgtgaaacggagggagtaatatattgtagctgcattttctttttttgtaattgtagccggtggtttcggaaaaaaataaccggttattggcaggtaaccatcattgatctgaactcaaatatttagtttgaaagtttgtccgataaaggtttggataaatgatgttcccaaacgccaaatacttattactccctccgtttcaggttctaggacgttttgactttagttaaagtcaaattgctttaagtttgaccaagtttgtagaaaaaaacaatactctctctatttctaaatatttgacgccattgacttttttaaatatgtttaaccgttcgtcttatttaaaaaatttaagtaattattaattcttttcatatcatttgattcattgttaaatatacttatatgtatgcatatagttttacatatttcacaaaaattttgaataaaacgaatggtcaaacatgtgctaaaaagttgacggtgtcaaatatttagaaacggagggagtaacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaatgaagtgtgaggttgggcctacacatgtgtccgtgctgggcttgaggtccagcaagcaacacgacggcccaaacaagtcgctgacacctcacgctgtggagtggatccactcaatctgggccacacaagccttatccgacggtagcccagagacccaagggggctcggagtctaaaactccgaaccccctttgtgttttgaggcgcagcggattagcttatctctggctgaatatcatcaaaatttgtatattttccaagactaaagtatctttgtttctagacatgaacacgaaaacaccatgtatgcattagttacaggaatcatgtaaaagaaacatatttgtttgatatttattccctgaaccttcctaaatgataggtgtttcatcatattccagtattccacttgtacaagattggcctatttctaaccacatgcgcatgatctgtgagactgagaccgtatgaacttactgtcggttgcttttctgcatataaattcagtacgtctcctgccgaatgtctagcgttttttcttctagcttgtcaagactctgatgacatatattgttcttatcagtcttcagcttgtctcaaaaacgattcttgccacaaaatgtgtatccatggtgcaaattgtgtaggtaatcataaagctccttgctgacctttagaacattccaattttaagttcagagaccgcagatggttctattcatttcagaaggcccttttgcagtcatacaatgagcatgtgacacaattagaaatgtagacaagttgatttccactcttctaatgtcccatgttccatatgccatctactatggaagtccaagaatgttagaatgattgacaggggctagaaccaacttggaagttaaacctgacaaatggctgatcaaatctgtggacttacgtggattgaagagaggagttggtagtggctgaactttgctagtcaaaaaacgaaaaaacaaaaaagatagtatttgaacatatttaaaacattaacaatagttgctacctcattgtcaaagtttgtggtacagttgcctgtgggaaactttgaaactatgaaaactgcaatgacataataataatagtcatgtactcaagctgtcttcagattcaggtatttggtatgcattgatgtttttttggaatatgaagaaatgcattatccatgtgattccatattgccatctacaatcacagtcaagtagaagcggccatgaacttcgcaatgattgaagagggagcaatgcaaaggctcagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggactaacaataagatctggctatgcaaacaaaagtaaagtctaactaacttcacataatcaagaagagttgaacaaactcctcagaccaaaaggaacagttgtacatcacataagccgcaagcctatcctacaaatcctcccaattcataagcattaatcctgcttcacgatgcaggactcgccaactatcagatcaatcctcagggattattgtttaatatacaaagttagcacaaggtgcttcctttatagcccaacaattgttgtagaatcatcattgccgttgggcagatggagattgctgaacctgcactggtgggaagaacccagcacctggtggttgaaaaaatccagtcgaggtcggcgattgctgtggtgcctgtggagactgctgctgctggggctggctctggttctgagattgtgtaggcagaggcagaggtggaggcacacttagtcttggaaaacctgctgacataatgttgggcaatgggggtggaggtggcgcagagccactcaccatcccaaaaggtcccattccaaacattcctccagtattttgaacaaattgtggcataagtggtaatggaggtggaggtggtggaaatgaaccagctgcttggtttgcttgggttggtggctgtgtgcctccaagagcagctgttgctccaatctgtggttgcacctgcggcagttgcccaaagaatgggggagcactcatgtcactagcatgaatggggttgtcaagcctaggcttcttattgctctcaaagcctgaaggtcttgcagaaagatctccagaagtcgaaccactattccttgcttgttcagcagcaagggaagagaaaatggaggagagcaccttctcaggagctgacaaaaatgcaagcttatctgccatagctgctgcagtttttttgggctcatcaccaccagcactgaatgtggcaggaagtgaggttgctggatgcagtggttgaaactggggaaatatcggcattgctgctgaattctgcatcatggcagctgtttgtcctggtggaagtgtaaccatcagtggactagaactagatcctgcaccattgttcaaggcactaccaagtcgttgttttagttgcatggcatgttcagcctttgctcgagccacctgttaattaaatcagggttagccaaaaatcaatctaaataatttcttgagtagctgctaaaccaccccttcagtggcaggaaagatgctgtggttttaactgagatggtagatagcaatgttaacaaaagccagcggagatggatactacatagggaacagaaatatgtgattggaaatttctaacttaagatgcaatgacacatgtttgcaccatggagttagcaggttagctacatagaacctaggttacaattaataacaatgcatgcgcatgggtatatcactgcaggcatatctttatattagctcgtgcaagggccaccttaaccgtatagcttatgctgtagagatagtcagacctcccaatgtgctggacctaattctcttgaaacagataaagagagaaatgtcatatataagcaaacataagttggaattgagaagcagtctaacaagtaggaaatgacatgttgccttgttatccagagtaggcctcagggttgccatggtaacttttaagaggcaggtttgtgcttgaagcaggatactagatgagccagacatcatctgtgctgcccaagctgaccatggttagtctactacttccatcatagagctgaattgtacagcagattcagcaactatccagtttagaggcttctcttcgtgtcagagcatacaatgtgcatcttatgtgttctcatttttgcttttgtatttcctagctctactcatcctgaacatgtgtgatataaattcatgaatgaatgtcgttgacaaagcaaaactctggttgtgctcacatgccatggactcatggggtcttaggctaggcatcaagaatagagtctagctcaaagcaaatacaaaagcatatggatccatgaaaatgctcagcataattttgaccctaactttccattataattgagtaataacagacatggcataagaaatagaatgatctaacatgtgattctgcagtgaaagnnnnnnnnnnnnnnnnnnnnnnnnnnnnnnnnnnnncaactgattgcgaagaagctctgactttgcttcctgttataaagaaagaaaaaacataaagctttatgactgaatagtatgccgtcaaggtagaacatttggaagaaaatataaaaggtgctcaagacctgttcgccgagggcttttcttagtttattgattagggttattctagccatgttgacactttcaagttgctcaatgcactgcttaaggactgtttcctgcccttgaaggtcagaaatcaacgatgatccttgctgaatacctatgaaataaaaaaggagtaaggtgcgcatgttttgatcaagaatcgaagtgaaaggctgaaagcattatagtgtcaaagcatcatttcttcatatctggtctccaactttgtaaatacagaaagtcagggtacaggtttccgattagagtgaaatgcatggtcggtccttaaaattgagcagtggtgtcacttgggtccgtaaacttgaaaattgcgcgtttaggtccatgatcttggtttaatgaagcacaccaggtccaaaccttgtttgaccagggctgaccgacgatgtggcgccccacgtaggcaacaattttgcatccagcctcatccacagcacggagtggcggtaaaattgcatttagctcctgcgagggaggagggatttggggattttggggggtttcggggtggtactgtggctgaaaggggctaactacaattttaccaccacgctgtcctgcaaaaggggggcggatgcaaaattgttgcctatgtggagcgccacgtcggcagtcagcccccagtcaaatgaggttcagacctactgtggttcgttatcatggacgtaaatgtgcaattttcaagtttacggacctaagtaataccaacgctctagtttaaagacccgccatgtattttactctttcagatcattagagctaggagcatttttaataggaaactttgcactacagtattttttactctgtaactcattaaaatatttagtcaaatttgaagtcagcaattgtcaataatcatggcctacaggcctagtgtgcactataaaggactcaaggaactatcacaatgtaaaataattaagctgctggatgtgctccacagaataaggatatgtatgctagaccaccacctatgaaaacaaatgccagaaaattgattttcttccctttatatgccaatgcatgctacaatcacatcattatagtttttttaacataattataaaattatgtacagcaattttctttgtcaacatgctagatcatatttatgtatttgagatgtttgtttagtctagaatttacatggcagatcaacaaaaaaccggaaatactatgtaaattccttttttctcaagtcaagtacatgatggaactagaagtaaaatagcgctggaacaatcatgatgcaatacaggccaaggtatcagaatgcattaagtgccaatctttcgacggtacatatccataacataacagacctattgaagtgagaaaaatgctttaccttgagtacaagcatcatctacatctttatccatcctatccaaaacactaacagcattattgcatttgtttaaagctgtgtcttcatcaaaatgttgatcaagcactgactgatatgctgttacaatcttttctggcatcccgccaacagtaagtttctacatcaaaagacaaaacaacaaaaatatctctatcaaattcatgacaatatactgcatccatccttagcacaagaaaatattttttagcaggtcaagatctggcaacttactcttgttactgtaccagaatctttccgcgcagctttggaaactgaagaggggttagggcttggatttgagctattgacattgttacccattgtatgagtgctaccaccaagaatgtcatttttcagactttcaatacgggttccaaagaccttccgctcatcccaaatatctatctgtaattttaaaaataaagttttttttttactttttgggctatggccttgtgatagagaaaatgaagtaaatagacttttccaatgtaacggaattaagaataacttactaatcttccaactactttctttccatcttctcccccattgacataaaagtctttcaataatccaggaagaaccctccaaaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcatgctattgtaatctagatgctattgttaaaaatatgctgtgggaatttggtatcatgactgtgtaaatgatttttacggcattgacatcaaacacaggaaagcaagtggtaagactcgttcagaagatattacatagggattcgagttgctaatatgtaagcaaacggacatgacacaaccatcacataatcccccaccccctttgtagcgtgaatttatggatgcaaatggataaatgctatatatatccttcttcaaatgccaaaaatttgcaatttgcgacttgttttttttacaaccatagggaatctgttatttgtttaattgatgacagtatatgataagccctgacctaactgcttaactgatttagaaatgaagataaatggtcataaaagaatcgaaaaggttgtttattcatttgccagtactacctccgttcaagaatataagaaattttagggttggacacggttattaagaaagtaggtagaattaaatggaggaagattgtgattggatgagaagtggaactaggtgggaaaattgaatggatgattgtgattggttggaaagagaatgttagtgaagaagttgttatatttaatcattcctttgtaattttgtattttctccctctcttccttttgtaaatcttttcttattaattatttaatatagcgcagtaggagcccctcctgctgttccacgtcaaaaaaaaaaaagaagttgttgtattttgggacaaattctgaaggctagaaattgttatattttgggacggatggagtacaacattagtgcaaccaaatattaccacattgtatttcgaacatagattaatggataccatcgtaaaaagcagttccacaaagattgtacaagaagccatcaagagaccaaaaaaagtagaactagcatatcagtaccctgatagcagcaaccaaaaggaaacaaagtatgtgatatatgattgattctacccattagtttgtaaattgaacaggaaaacagctatattcaaatccacaagagaacactactacaatgtgatacaaacctaacgctccttatcattactccctctgtttcatattataagtcgtttgacttttttcttagttaaacttctttatatttgaccaaatttatagtaaaaatgagcaacattgaaaacacctaactagtttaattaaatttaacattgagtatattgagtatattttcataatttgttgttttgtattaaaaatgttagtatatttttttataaacttggtcaaatttaaagaagtttgactaagaaaaaaagtcaaatgacttataatatgaaatggagggagtattagtcaatttcaaaatataatcatcctcaaaagacatagaaaaacataatttttcacaacaaacaaaaaattattacacatcaaacagaagaatagaagatattactaattgtaacacaacagcttaacaaatcgtgccattatttgtcatttttcaaaagataatcatcctcaaaagacagtgaaaacttattttcccaagaaacaaaaacaaaaggaaagcatgtattgatagtaagaacacatcaagccaaaattgtaatataaatttgattgccaatagcccaatacaccgtaatgctgataagaactacaaatattttagcgaggttaatttatatatacagctataattgaaaataatataggaaaatatgcccaaaagaatgatccagaagctagagaaaaaatggccacactaagttatatttgtatcatcgtacacatcaataagtattgataagtaaaacattagatgcagtctaactctagcagcaataagcacagctaggaacaggtgaaggtgaatattaaccaaacaaacagtgcaagagccaatatatggaacgccaaggagataagctgtgtcagttgtactaatccacattgcaatttagggttctattcaacttgaacagtaaatcaatcaaaactaccagacagataatataagcaaccaaagtaagtactatcctaatagcactagcataccactacgctaatagcaccaaccaaaaggaaccaaagtatgtggcaatatgatcagttatgctcattaatttgcaaattgaacaggtaaaatattccattctaatgtacaagaaacctgtataagtactaagtagaccacctagaaaatattagtaaaatgtaacacaaagcctgaatgttccttatcatcatttttcggtttctagacacagtcatcctcaataggcattgaaaaacattgtatttctcaataaacaaaagatcattacatatcaaacagaaagatactactccatcaaaaaaaacgaattccaagctacgaacctggacacacaggtgtccaggttcgtaggtaggattggtcttttttttaggacagagggggtactattcacataatacctaacagttcatgccattacttgtcatttttgtaaagataatcatcctcaaaggatggtgaaaaacatattttcccaagaaacaaaaaagaatggaaagcatgtatacagtaagaatgcatcaaacagaaattattatacaaattttcattgctgatacaccataatgctgataagaaatccaaatcttgtagccatgcacatctatatacacttatacagctataactcaaaacagtatatcaaaatatgcccaaaagaatgatccggaagctacagaaacaattgccacactaagttatatccatatgcatcaatacataaaccacgagatgctgtctaacagtaataagcacagttaggaacataagaaggtgaatactaaccaaacaaacagcgcaagaaccaatatatggaacggcaaggagatatcctaggtcagttgtactaatccacattgcaatttagggttctattcatctggaacagtaaatcaatcaaaaccacgagacagataaggtacgagcgctaccaaatttgcaagcgcacaagaaataaacaaccggaagaaaggatactctggatcctagtcgccgtgttgttgagcttgttaagcttctcaacaaacgcctgctcgctgaacgagccagagccgccgccgccgccgccgatagtttccgcctttgcctccgccttggtgtccgccatcacgaaggcgaaggctccaccaccgaactcctccccctcgcgaacaagctaatcccccgaagaaacttgtacttcttggccggccaagatcgaaccaatcctaaatccccccctaaaaaaggcgagaaaatcaggaatttggaggcgagagattgaagcttggggaggttttgggagggagagtgacgcgtaccccggtggcgagctcgtcagcttgaattcgccgccggtgaacgacgggaagggggcggcgaggccggggtgggcggggaaggggaggacgagagggtttggtttttttttcccctttccgtgctgcgtgtgttcgctgcaacctgcaagcctcttgggttcaacaagcaagggtgagggtttttcacatcagaacatgagagggtgaaaaaaaactgaagataatgttattggattggaattttatcaaagatagctataaaaataaattaaatatataatactattggttttattcatgtgagatttgaaaacgtgtatacaaatatgctatacttttttctattaatatacatacgttaaaacgtgttatttgtttagcgtacaatgcgggctatattaaatatagccataacatttatcgcttgaattatacatatcgcttttggtgatatccttacacatttaatgttatgataagcctcgttcatttattttttccaaataatactcgctacatccctccgttccaaaatataaggtatttgggctggatcggacacattctaatactataaatctgaatttaagattcatagtcatagaatgtatcacatccaatcaaaatcctttatatgttgggacggagagaatatattttagcaacatattaggttgcactttagccctaatgcttatgtataatcacatccaatctctccctcagtaatgatgtaacttgcacgtaaataggagagatcgtcctcatgaggttgttgatgtgccacaaagagagtttgaatagtccaaagtgtaacaaaacaaaaaaaatagatgatccaaagtgaaaaaaaaatcagataaaagtgctccaaagtgaaacttcgataacataggggactaaagtgaaattcactcaataaaaccatgatcacataacatgtgcattaaaaaatatctttacactttttacaaatattataatcaaatgtattagtaaaatggacgatatactcgtagctagaatagtatgaaacattttaccccgaaacatggagggcatgaaaataaattgtaaaatttaggattttgtgttacagatggctcaagacctcacgttttatgaaatttactcattttataatttgaggtactttaaatataacatatttctactatgtttttaagatggatggtcaaccgttatgctaagtgtaatatcatcgtatattaagaggatgtacataaaaaattaaagggaaagaaaagggaaaccaatggtactacagtccatttaactccattcctcatttcccaagtacagaaaactacaatttggtaccaagcggatccgaagagataaactttttatctactactaccgttttataatataagtcattctagcattttccacattcatattcatgttaatgaatttagacatatatatctatctagatttattaatatcaatgtgaatataaaaaatgctagaatgacttacattgtgaaatggaggaagtagatagatacagaaaagaaaaaaaaagaaactaaatatactcgcttgtacattgaagcgctgctagatgttgctccgtagcgctcaatgtggggagcttcaccctgacgagtcgtgaaaaaccaaaaaaaataatggtgggaacgcaatttcattttcattttgaccaagtggttgttcaagggcggaccagttttgggccacggggaaattggccaaccacttggtagaaggcccggacgccttccatgggaaggcaaaaacgtcggtgcacgccgcgagctccttttgtgtgcggtagatgaagttgagcgccgcggcgacctcctcctcgaagcgggagaaggggctcgtggtgtcgtcgtcgtcgtcgaggcgcagcttgcggagcttgcagaggccttccccgagctccatcatggcgccacggtggttctgtgtttgtgcacgatcatgtctaatcacgaattttacagaagtgtttactgattactatgcatagttaaatgtggaaataatgagacgatgaaaatatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgctgtgaggaggcggcggcggcagcggaggtcacgacgagaggaggatcggcgctgcgggtggtggagcggtggctgtgggcggagcaagaggccgcccgccggcaacagtatccgcggtgcggtgggcgtgcgctgctgcggcagtagccgggcggcgtgcagcgaagcggcggagcggcagggcgccagcgccggcgccataggaattcaacggagattgctctgcttttgtccggtgaacgaatcgcgcgcgtgtgatgtagtagcgtaggaggacgtgtggactcaaccagaggtgagccgttgagacactcgtgcatgcagaaccaatcaatggagtgagtcaaagtgtcaaacccacaaaaatatctaactacaggcccaataagcaacagcccatctggcctagccagttttcccagcgtttcgggtttggaataagtctattctaaaccctcctgtcgggcaatttaattgacgtccctaaaccacggaacccgaaatctttctccctaaactatacgaaaccatttgaatcaaatcctataacaatatggaggattgttttagcttatgtggcaccctagtcaaaaaaaaaaagtagaacccacatgcaagtggccttcaacctccacacatccctcaattccctatccgtccacctcttccctctcttcaccagagcgcactgccagggagagagggtgatggctggtgcacccgtccgtggaggcggcagcaacggtgggaaggaaattggcgatgagggccggcctttgatgggcgaccggtgggcagtcacgccgagcgtgaagcccttccttgcctcctccaacgccgacgaagagggagatggcgttgtggtgacaacaccaacgatggtggatctgcctcctcgcccacccatgtcttagcttccattttcccgcactatcagagctcgggccgtctccgccgctagagagatagaaagatagaggtaggagagacccttgcctcatgcaacattgctgaacaaggagatggcggcggcggtagcgacggcgacgagatgatggcggatccacctccctgcccacccacatcttgcttccgtctccctgtgctgcagggagctcagtcaaatgtacgcacgtgctaggggaagcgtgtacggtccactctcgctgcactcgatggcctcaacctcgatctccgccctcaatacccccacttcctcactgtgtgtacccctgggacattgagagcaccacgacacggtgagttcaagggaaaagtaagatgccacacaccatagtctgcttcactgtcaactctctgtctattggcctacctccaccaccaccgttaccatgaaaccaagagctatatcgctcgttgacctcctagatgatatcgtcgtcgacatcctcacccggttccccgaccacttatgcctgtgccgcgccatgtgcagatcctagcgcaccctcatctccaagttgtgctgataagtgggtctggatatttgccatataagcgaaaacaaaggaaaaaaaaggtctatactgttatgggatgtaagttatatagtttaggggtaaagatttatgggtatgggaataagggatgccaatcaacttgacgtaaagttaagggatggttggacttatttctttcgcgttttccttgggtttgacaatgggctacattgcaaatactcgggccgacccacccaacaagatctgccggtaatatacatgggcttaattctcaccaacagcgacgggtgggctcgatttcgtgggccttgtatttggcccgcacacaccaacctgtcctgtcctgccgtcctgcgccgctgcgctgccaatctcttcttctcttcccgcgtctccttcgcctcttcccgccaatcgccaaatttcccccatctcacctcgctccgtagccttctatcccaaaacttccttctgctcttgctaggctagggtttcttccttcctctacctctcatccacagattacgagatcgatccagcagcaggggcaagtcagtcgagtggagagcgatggcgccgctctcgtggcgccaccacacgctgttgcaggcgctgctctcccgcgggcccctctcggagcgcgacttccacgccctcttctcgccatctccggcggcaagaaccccggtatatgcttctgcctgctccgcttgctactctcatctttctcctgctgttcgccagcgcttgtctcattactcgtag

SEQ ID NO: 32469 - DNA, 22948 bp, Oryza sativa
cctaatattgttcacaaatcataaaaatactatgcgtgattttatataatttccggcctaaggggtgttaatattcccataattgaacaaaatggtttgcgaccattcatgttctgtatcactgcttgcagccactcatcggcatctgttcaatgatacactcctcaagatcaacaaggagctcgcatacttgcagtttgagttaagagcaggcataaaccagtatgatggtactgtgtattatggagtggtcaataacattgctgatgaagagtcaaagcttggatcaaagttttctgtgccacagattgcattctacaagggattggtatgcaatcactttgccttttttttggttaatccagctcaatctagtattcgctatattcatgtaattgtactggcagttggaagcaatagttcatgaagctggaaatgatgggagcataacaaatatcgatgctcttaacacacggattgagaaccaggtatctcgtactagtaatacccagtcactatgagagcttttgtttctgtttaagcaaatgttttatatttgtattgttgcaaacttttatggtagtgtgacgaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcatacgatcatttcttgatctccgaagttggttacgtagtaatgatatcccatcatgtgaggtctgcaatgaagcttgcataaaggtgcagatatgtgattacgaattacgattctacatttgcatttatcttgttacccatggtcatatactccactaatgtcattccctgtatttctattacttatttaaaacaggcatcatcttgtcctaatgagggatgcaatgtaaggattcacgtgtactgtttgaagaagaaattttctcagagaaaggtagttacctatttttaattccactttacacatatgaacaggagtggctttctaaattgtttgtgtatgtaggcctcgagagcttgtggttgtggtactgaatggcctcggttggagggtgaagatgacggtgctgaggatgttaacgaacctgaggaagatcaggtcccatcagccaaccagcattcgaggactagacgcagaggagtcaaatctgaactggtggaagaaaatgaaagagcaggcccatcagcgaggatgacaaggaggagtttgagaagctctaaagcggaagcagttgaggctgctcaagaggtgccatctgcagcaggaccttcgcagtcaaccagggcatctaagagaagaaagaactaatgagattgatttgtgcttgctagtgatatatccaggttccttttgtcatgtacagacagtagcagtaggtaatccttttgaagtggcaggcaaaattgcaacttctagttggagaggaatatatagctttaggatgctcttgttactaactcttagaacgtattagaagcttaatgctttcatttggcaaagcaagcctgcttgtgacagcccagttaactgtttgaatagctctcttgcttggtgatgctagtttcatgcatgctgtttttatcctctatgttgcttgtttctttcggccccatcttttcggttatgcttatgcttatcagccaaaaattgaattttcaaccttaaatttggagttgattttggggtttttctcatcaaagtttatttttcagcatttgcttttagatcagaacacatatataaaagttttattcacaaattatttttcgtttgcaaatatgccgtttcgcttattggggacttttgtgtctcttattaaaagggacaatttaaagctcagcacagccagcattgtgtggttgctgactggtataaacactgaatggaaggttgcctaggagtcaggaggaaaacccaaaaatagagaaaaaaaacagagtggatccggcaaaaaagagaaaaaactgagtgaggttagtttcagggttgagaatatcctgaacaagggcagccaagtcacaagtatttttgtttatatcattatatgagtgtgaagatgaagatgatcctcacccagctgacttaactatagatgatggagaacagcttgttgagtcctggacttacttgcttgacgtattctacttgttcttttcatttttctctttttgagggcgtattctgcttgctgatgcagctatggtactctattcgcgaacataggcagcttgcatgaggtacggtccaactcggagaaaagaaagaaaaatagaagaagaaaagatggctgctattattttactagatgtgtgtttcttgcatgcatcattcaggtcctgcagatttaccatattactatatagctaaccaccccgctggaaattcctagtatgttgacatgcacacagctagttgcacgaacaaactgaagttgggcagtcgccatctagacaaaatcaggggatgactgagttcaggcgaaagcaaccatggcgacaattggtgaaaacacgtacgcgctgcaattagttattgaaacgttcaactcttgatttgattgatggccccagatgagctgagccttaagaactaagatacatactttgctaaactagtatatactccgttttaaattatttatgattctagcttttatcgtaagttaaatatttgtattttttgactattaattcttaaaacttcatgtggtttagcattttagaatcaacataagaaacactttcataatatagcatccgcatgttgttaaactatccgaattttaaaaaattgatggtcaaagatacaaatgtataatttaggataaaactaaaactacatgtaatttgaatcggatggagtatatttcttgcggtttgagtaagatcataccgtttaattagatagaagagaaaaggaagaaacacccaagagcctagtatatcctaaggcacaaagctacagctataaattactcgtcatgcagacctacatttccctaagtttcattctttcccgcttacccagcacacgttcatggacagccgctccgccactagcccactatactttgcatcctaattaatcctcttgtcataattaactaaaccaggtcacgacagctcaatatcataatcattatgctactgcctacttatacatgaccagggatcttcagaaagcgttcaaggatacgatttatttcctttgaaataatgtataccccttaaaaaaattttgaaaagagatgaatgacaacagctagaacataaccttggagtaggacaatcaaacaaagtttcagactgcttgctaacgtttggtgaataaaattataaaagagacgggggcagaaaactctcagcaacctcgttggacgatttcgtttttgtcgtcagcacaattgcactgcgtcaattaatggacaaatgaagaaagcgaaggtacacggacgactaggcaagttgatagcacaccagttaaaacgaaagctaacagcacaagcacacgacttgactgacttactattaactacaggcaaggtcaccgaccaacggcaactgaaacttacttacattgttcttttctgattaactacactggccatgttcgaatcaaattttatctcggttttcattagcatatttttcaaactattgagcggtacgtttcgtgcgaaaattttctatatagaaattactttagaatatcaaatacacctatttatcaagtttataataattaaaatttaattaatcatgtgctaatggctttctcgttttacccaacttcatcttcatcactgatgcaggggaggtgccattttggtagagcaagatcaaagatatgatcaaatttacgcttattttgtacaataataacagacacttatctgtaaccacaacttcatcagttacatctgaaactgagtaaatatccgattaattcattcttcattcgcacaaacagaaaacagagaaaaccatctgtatttcaccaattacatctgcaactgcaagtatgcaaaatgctacactggtggtaatccactaatcccctcatcaacagcttgaaatgcaccccaaaattggacactaattatgaaattaattcaattcacaggtataataagtactgtaatatctctctgttcaatgcacagctgttactagctatactaggctgtagccgttaatgtactacccatccaaccatcagcggcggcgccgccgccgccggcgatcaccaccaccaccagagcggccggaccttgaccatgcaccccctgttcgccggcgccgccgccagcttgttcaccgtcacctcgcacctcgccttcacgtccaccgtccacgtccggagcaccttcccgaacctcaacctcaccggcacgatcgcgtccacagccaggggcaccgcgccggcggcctgatccgcggcgagctgcttcctctgctcctccgtgaggctcacgcctcctccggccaacgccgtcgagaacaccgtcacgttcctcggcgcctggtggaacgcgggccacgggccggcggcgagccgctcgccggagtaggagacggtcacctccccgccgccgcggtagtcgatgccggtcttcttgttggcgccgttgtccgcgcgcacggcggcgtcgatctgcggagttaacgacgacacggcgagggcgtcgaggccgcggatggagagggaggcgacggagaaggacggcgcgagggggcggaagacgaggtagacgacgccgacgaaggcggcggcgaggaggagcaggaggaggaccccgcagaaggcgccgcagcacgcgtggcggagccggcggcggcgtgcgggccgcgccgcgagcttcttgtagcggcgcgcgcggtccggcggcgggacgcggaggacctggtccttggggatttggatgatgtacgtgcccggagacggcggcggcgcgccgcggaagctgggatgcagcggcgtggtctccgtggcggcggcggcgtcgtgtcccggcggaggggaggaggacggcggcggtggagcgggcatggggtggacgcggtcggccatggggggtggttgtgaggcaaggtgttcgacgaaatgaagagtgaccgagtggcgtggcgtgcgagtgggagtggtcgcttgcttgccggatatatatgctgcccgcgtagcgtagaacgcgtgagaagagaacaaacagacaaacacgcgggaaacggtcatctgacggtattctttttattttttttcttttataaagataaatctcacgatatcctgttcatactctggtactattaaataatttcactatctttttttctattgatagttagtactctttttttatgtatgccaccgttgctttttcgtataacgtttgactatattaaaagttttagtgtaaatatgtaaaattagaagttaagatttctttggtgacaaaacaaatcataacaaatatttacataatttttttaataataagaatggtcaaacgtcatgtcaaaaatcaacgacatcagacattaaaaaaagagagagaatagtactccctacgtcctaaaatatgagtatttttaggttgtttagaaaatcttataaaggttaagtaaaaagatttcctttccattaaagtagtggtaaaatattaaattatttagattctcctcccaagcatttgattggttgaaaatgcatgaatttttatgcattggtacatagtgacgtaagcgggatgtaaaagttgccacatcagatttgtacttacgtgaagaagggaggacagaagaaaaaagaaaagcggactagatttgtagccaactacacgactggcttcaataaactatgtgacggagatggatggattatgtattattgatgtaatatatattacaattatgtagtatatgagttggtagatgatgtttcaatttttgaagctaatagttgattatattattaaacttactgcaaaggacacatatttttagtttatttagtaaagagtaagctaaaggataaatattccctctcagttgtctcattggttgattttgtgaattgcttagccccccttcctaattacctaagtgactaaaaatacttagctttccgtgtatctgaattctgaagtagtacctggaaatgcttatattgtatatgaaatttaaatagtagaaatacttatattctaaaataaagaaagtatattgtggtacaaattttaaatactaaaaatgcttagggtccttttaatttggaggaaaaacataagaactttggaggatttcaaccatatagaaaaatttcctatgaatgcttttgaaacaaaatattaaatcatatcctatcatatccttttaaattcctatgaaatggataatctcttggaaatttttctttgagtctatctctctcatccaattcctgtatttttctagctgtccaatcaacggttatttctatgcttttcctgtgttttcgatcacttgctttgcacttgcattactattagaatccagactttttttctatttctccgtttattcatttatgagattcaaaggtggagtagtattattttaagacaaggtgctactttatttacttatgtcctgcaggagttggtgtgataatttgatcaaggaaatgaatagcgtgggttcgatgatgaatgtgaatgaaagagtcaaatattatgggggtttactacggaattaggtacaagctactccgtagattgtaatcatctgaaagagaacgttccgttctagcactgatttttctcaaggtgcctcatactgtacctaatttttatatgatcctgtctgaatgtgcttgttatcttgcacttctctgcgtaagatgagatgtttatctattctagtattctactatatccaacttaagatatccgcatattcgaggaagtaattatttttcttatatgcattgctagtctaaacaatcatgtgttgtacatgtgtgaaaactgaagctttttgtgtctgtgaagaatacttccatagtaatcaattatttcctactatgtaatatactagtagttcaaaactatccacatgtgtttgcacaaaactacattaaaaaaaactcgatcttggggaaagaaaaaatagtcccttgggggacggagattaaaactcccaaccccttggcatcctttgaattgaagcttaaaaaaaatggtccatgggttggagattaaaactcattgtaacatatgaatagtgcatactttctcaagtagtttaatgtttagcacaaacttcagccacactttaaaaattttggcaatctattttacaccagaataagtttatataatccaataagtttataatattatgagacaaatctacgtatatcattttgaaaactaagcatttgacaaattattgatgtctagatttttaaaaatgcaactaaatatggtcctaaatgtcaaacatttttaatcggaagggatacatactaatataatcgtattgaacagtgaaccacaactcttgcagtaccgaataatctctgtaaactctgttaaaaaaaaacttaatcctagttactagtgccttgaaggaacaacactttaacttgtgactgttgtttgctactgtacggagtataagttacagaattgtgagtacaccatccatatcttctggaacaagcttctcatctgcctcctcgcgcccaaaacatccatccaaccgatatctcccttttcggtcgatgatcatttgctccaatattaacgcatttctgagaatgtattttgctagctccacctggcctgtgttgccacaaaatccaaatatgcacaccatcttgagatgatagtgaggctgatccacgatgtcatccaaatccaaagggcacctgttcaagctacaatacatctgcaagaaatttatgtcatcattaacaaggagcaaagctaacacgtaataattagggaaaagaagatcaaagattcatgatcgaggaagagaaggagaaggatagcctgtatatcttgtcaaaacaaatgcgggggatggaattctgagattttgttagaaaaaagaagcttttgctctgtttggatacgaatatattcaatcaaggaaacacatggctaatcggtttccaaacatattatcaccttgattcatactatttggtatcttgtacagtgcataaatatggtgatgtgatgatcagggtaaacagtgatatcgatatagcaaaagcttctacagatgtcccaaataattatgattaaaatttacaaagtccactgtcaaatggaaaaaaatgcagttgccaactaatgctgaacaatactactttcgccgggccgaacaatattactttgccaaagctatgttcgatggtctgatgatcgttaaaaaggatcaatagtctgcagcgaatgttccagtttctgggacttatgagttcatggatcatgcatagggcacattggacaagcaggtaattcctaattagattgacagtactggcttagcaggttattctgattgggtttccaaaccaatgaaataacattaaataggaaaaaagaggtaatcggtcaatgagaatacaaaaggcgaactgtaactggctagggaagaaggcaataaaagtagtgaagtacaaattgtgaattctagaatgaaattggggattcaactgttcatccattgagttggccctaagggctaatatgttgagaagagtacaacgcaaaaagacagaaataccccttaacacatacacactaatacatatattcttaacacccccactcaaatgcaatgtgtatacaataacattgcatttggagtgaaaactaaacaagagaacacaaactaaatattagcctatctccaaagtcttgatgatatcgtcgaagtgtgccaattcttggatgatggagaagaaaagatgtatcccctcctcaatgaagtggaccttggagccttcacaaactgttcttcggccctcgataccttgaagccttcacgaaccgttcttcggctcttcattgattcagagatgttgttgatgatgatgacaatagaccttcacaaattgttcttcggtcctttgactgatgatgagacattgatgttgatgaaggcccttcacaaactgttcttcggaccttcactgattgatgatgatgatgagaagctccgatgtggagatgatgaagtgacaatgaaggccagctccgacggggagctgatgatgatgaggaccagctccgacagggagatgatccatagatgggtttctagctttctgctgctttgctcacgaaggactctcccgaagcctcatgcggctgggcgacaagcagacaaccacaacggccatgctgcccagcaatggagacgagcagcgatgacctcggtgcaaggacgcccggccaaaactggagccgttgcggacgacggcggcggcttgccgccggcagctaggacacgctccgcgacctgaagaatggtggggacgagcggcgtggataagcgacgcgacgggcgtggcagcgagagtggatggtggagaagcgggcgcggcgccgcaacggacggcggctgcgaccggcgaatgggaacgcggtgacgacgacgagccgcgggcttgctgcttggagacgaagacgacgactgactgatggacgaggatgaacgacgacaacgatggctcgccggcgatttggcagctagggtttggagagaggctctgataccatgtgaattctataatgaaattggggattaaactgttcatccattgagttggccctaagggctaatatgttgagaagagtacaacgcaaaaagacagaaataccccttaacacatacacactaatacatatattcttaacacaaatgatatagctacttacatccaaataaagatcctccaaaaatggagctgctacgaaaagataagccaactggagactgaatttctatcgaatgaacctctctcaaaagttatttccaaagttacacttcaattgagtgaacttgagaggcgattgtgtaaatccagacatctggagggtgaccaggccacacataggttcaaacaacaagatgtgaaacagaaaatcaaatagaattaaatgtatatagagagtacaagaataatcagacctgagttttgacattaacttcaacgtataacgtttcaacatgaggtaatacacttggaattccagttaatatattttggagggttttctcatcaaaaagtctgatggttgatgctttgatattggagcattcattgagcgttaccaatgccagggaaccgtcgtactcaaatgttgtgagattcggagcatgtaactccattctttgtaaatgacaaccctgaattgacaaacattgcagacggcataatggttccgacacatgtaaattatgcagctggttacatgattggatgcttaaccactctagaacatggcatttcgatattaactgctctaaatgttgcaacctaacattgtcaagagcaagcagtttaaggtttgcaaatccgcagaaatctagaggtggattcaaagtaacactgtcaagccgaagagcctcaaggtaagatccattatgtttgtcgaaaatatgacaaggaaagtcatagttgttttcatgtgatttccaatctggggagaagtcaagaatgataacccttgcctttgatgcaatagcaaacgcaacccagccattgacatggttagcatgctcatttgacaaaccaaacttaacagcaaacttatttaccattgttccacaatgtttttccagaatagcatcaacccttttaatgaacttgttagcacttgatattctacagttcagatcagagcttgttccttttctcttggcattatttccaaggactgttttaataccaaagtacagattaggatggaatgtccaagcctgtctccagtttgttgacacaacactcaaccgagcgacttcctttaatgttaattttgatattacccttagtacaatatcctgacaatgcattttgaacaagcatcagaatacagcctcctagtcctagcacaaaaggagttgagagtttcatgacttcatgtcatgatatgacatacctcgggaagagactgaaaattaagcagacatggtcttgtcctctgtaaattaagctgcccccgacttatcttctgaaaattatgttgtgttcttctcctcttactaatacgttgtccgcaaattatacaattccttttggctgttgtgctcttactcctgaaaccaacaatcagcatgctctgccagtatgcaatgatacttctttcagaagttttaagtagcacacagaattgacttcttgaaactttttttttagcaaaataacacatatgtcagagggtattttgcattattattagtagtaacagtacacaaataaatgaatataagcatataatgtgatggaattctgccatgtaaggatgcctttctttagattctctatttatttattttttggcggggcccttggttaagattccatatcgtattaaaatccaagcaaataaagaaaaaggtgcatgagttgggagtcaccttccatggattttcgaggagacaagaacgttgtcctccattgttgggacgtggaggcagtggatcagggacaagagaaaccctgaatccctccaccgcaggtccgcagcccaatccaatcagcagactcctgatcccagcaaggtagccatgaagggggatggaatgatttatgattctgagacagggagaggctatttagggctggagccgctcgatcgcgaggcgcagcatcaaggagtcgaccggaggttagggatgaaggctcatcttttatgggccttaccggtagatggccgtacggcccatatacaggcccataaatcagcccatatcgattttgactgctagtagtagtatttatttgagaggatataagaatcgtattctttttcttcaatacgaatcggtttcggatttgttgccgcaaaaatcaaaataaaacccgggtggaggaggagggagaagatgaagcaaacgagagagatcgagcttgaggccgggtggaatcgcgaggggatgtcatggcgaagcggcgggcagagtccgagcttgagctggtggaggcggaagcggaagcggaggcggaggcggaggcggagaagaatgggaggcgagcagcaggtagtcaggacggggtgaatcgcgcgttcatcctcgagtgcagcaaacatagcgatggatcgatctacagcggcgacgatttttggcacagattttacaaggtcgccgatacccgagagagtaagttttaacttttaacttcttgcaaaccctagctttttcccctctccaccatgcatcacctaccatcctctcatctccttaattagttccttttcaattttaactttgcatcatctacaatcctctcatctgcccttaattagttccctttcaatttagcttcacttggtagcacctcagatcgatgctatttaattcatgctcttttaacttcaattttatactatattgctgtgtcacctaatttgttccccaggaggcgggcagcctcttgggtgcaatcaaagaagaggtcgcaatctggaaggaagcaggagtctttaaagaatagagatgcaatcccttttattttggttttgggagggcgctccggcatactccattcagtttcgacatcttcttgttggaattctaaacttgtaaatttgtacatcgtaaggaaatttggactgaggggtctttggtcagcacggcaaaataataataataataataaaatctaatttgttcttgtgtatgctcagtactatggaactgatgtcaaattaaaccctttttttcataacatatctgtctagcttgatgtcaaatttagacctttcataacataatctagttctaagtaacactagatattccttaagtactacttcaaaaaactcttaaaggcaccatctaggatatggtatatcttgctttgggtccatgatagtgtggagtttgctgttttaaaccttattcgtatctatttgtttctttcctgctcatttcaatattggggttaacaatctaacttctaatcatccactgatgtgtatggctgttcagctcgtatggaggcaatgatgctgtcaaacccaaccaattgccggccacacatgtgggcttgcaaggcgcacagtgtgcaattcatgatgcagatattctcgctcaagctatccaatatcactgctgctgttgatggcccagttcacttgtatggatactttgctgtccgggatcatttggacccgctacgcaactacatcttcaaccgcaccagggatgaccctttcatcatggggcaagacaatggcgttgattcggataattcattgataccaatgtcaggccccaagagaggcattggaaaccaagttcgtgtgctcatcgagttcgacatgaagatcaagaacggagagacacaagacgatgattttcagctcatcgatggtgccattatctgcagcgaattcgtgcttcccgatagagtgtttacgcaacggattgagggtgattgtggtgcggtcgacattagtcgagccctttttcacgaagcagtggaggccacaatacaagttagcatatcacaagtgcatgtcaatggcttgagcttatctttatattcttataccagtcgaatccctgaaaagattcggctctttgatggtgtcatttccaagccatgtgacctgaatagggtagttgctgtggtggagaatacacctttgtttttaatcttcagggctgttcatagggatggctcggattatgatatccctaaatactgtccattggtcttcaaggttgatcagggggatggctcgtatcgtgtctctgaatattgtccattcaaagctagaagacatggatatgacatgaaagagcttaaacttggtggcgcccgtgtactgttgaaggtgtcttggtcaactttgaagtgattttgaatattcctggggtatacataatctatgctaagcagaaatagcgatatttctgtgtattgactagtaggcaaatgtttgggccttattttgagtacatatttaagttttttatttgttgtagaagttcgacaggtgaaggatgccacactcttatctgttcttatttattgcatattaatgcagattaaatttggtattgctacctgaatttaccaaatgttttggatgcaactcttgtggaattctaatgtttaacttacacaatatactcttgcaagagtgccgaagagaaaagggatcatccattaatttgttccgtcattgtgtctgcgtgtgaaatagtgatgcttatgttaggtaatactgatctgcttctggggcgcgttttgttgggaaaattgaagatatgctactcccctggaatcattttcaggacgtcactccttcagcttgactttgctaaaatggattgtttgcatgataataaataatagatgaatcttcggtgtagcatcgcattgatgaataaaacttttttttgccatctgtttgtaatgatatttttttcctctttgtattttggtcggccaagtgtccgaacagtttggcatcttgtaactaaacaagttctactccttaatacaaagacgtgtgaacctttcgcatgttacctaaaacaaaaatgagtccaccaacaacattacaaaaatgagaccaccaacagcattacagcaagcagataatgagcatgagggggtgtagaaaagaaaaaaaaagaatttatgaaagcatcgcttgattactgaattattgccaggacaaccgttgaagaagcaaaccgcagaagctgcaactccagtccagcggtttactaacaggcaacagacatccaatcatcttatgtttactgaaatagtagtaaagtggtgagggattgccaatgccaatctgccagacaataaaaactgacagggacagagactggagttactaagtgttcagctcagtttactgaaccagctatctaagagattaagcaaggctaagtcagagaggaactgtgtaatgaatgagatagcgctatctaatcagtttactgtctgctgctgctgctgctgctaggccaagacgaggagggggttgtgtctccttgcttaatgagctccaagttgatcttttgggccaagttgagtctcatggctgcgacgctctcagcacttacttgatccatcaccgactcaaaccagcagggcgccgcttcttctgtccttggatgcttcttccaccaccggcagatggccagggcaactgccaacaggtagacgccgcaatcgtacccattgctctgctgcggtgtcgggcctgagatgggcggtccctgcggtggcgccgggagcagtggccggagcgcgtcggcgaggcgggttgccgcggcagattggcgccgtccatactgtcgtggtggacgaagcggccggtgatgttgtccagcacaagaagactccagtgtgacccatcgtcggccttgtccaacctctcgctgttgttcaccgggaataacaccatcctgcgagatgccagtaacagtgcctgggctgtatcagcgacagtctcaggctcatagtcttgcaagttcgccagcagagaagccacggatggcgacaccaggagaaggctctcatcacccaactcggttgtcatgtgcgccatcacaaagttaatcacgccatctaataggaagtttggggcagcaaggctcgcgacatcggagctgaacagagttgcgtcacggtgactcattacgctctttcctcttgtcctcgtcgtcgtcgtcgtcggagacttatgcagggattgtttcttcacagtgaggccgaggaactgcaactgatgttccactgtatcacattgctgctcctgcaaagtacaaaaccatgtattaacaacctagttagtttgataagtaatcaaccgacatggagattagtgaactttcctcagtattaatcaaagagacagagatggactgcaatacatacacataacaataacagtctgcctttcttcaaaaacaaaaacagtctgcaagcgatcaaaaaggacaagtattcacattactcgcattgcgcaaaagaagataaatccaaaattttggcctcttacaattcattaggcatgatgaatttgtagttaagtaaatacaagttacaaatactatggactgtaaatttggagtataagcacagtaagaaattatgaattaggagaaacatccatttctcctacaccattccatctctctaaacttccaatgaaagtgacagtgacctattcttgtgccctctctgtcaaacatgagcagaccttcaaaatgacaaagagcaaacaaaaacactaagagaaagcaatgcgttgacctctcaaatcctcagaaatctccaaaccgagaaaacattagtcaatgtgaacaaacattggatatatgagatgactaaagaagttgggaatgggggaagcaacagacaatgatacatttgcatgattgcacgcacaacgaattgcacacatgggagatttaagacctagtacaaatctaaatgtgatctagagtgtttacgcaacggattgagggtgattgtggtgcggtcgacattagtcgagcccttttccacgaagcagtggaggccacaatacaagttagcatatcacaagtgcatggcaatggcttcagcttatctttatattcctatattggtcaaattcctgaaaagattcggctctttgatggtgtcatttccaagccatgtgacctgaataggtttgtagttgctgtggtggagaatacacctttgtttttaatcttcaaggctgttcatagggatggctcggattatgatatccctgaatactgtccattggtcttcaaggttgatcagggagatggctcgtatcgtgtctctgaaaattgtccattcaaagctagaagacatggatatgacatgaaagagcttaagcttggtggcccccgtgtactgctgaaggtgtcttggtcaactttgaagtgattttgaaaataatgatattcctgtgtgttggctagttgtcaaatgtttgaccctatgttcagtacatatttaatttttttatttgtttaacagaataacagtcgaagaatgccacgctctcatctgtaagatatggttctataaacagatgaaaaaaaaatagatttattcatcaatgcgattctacaccaaagattcatgtattttttagtatcatgcaaacaatccattttagcaaagtcaagctaaaggagtgatttcctgaaaaaggttcctggggagtagcgtatcttcaattttcccaacaaaacacgcctcagatccagatcggtatacccaacataaacatcatgcatgtaatgtaatgtaatgaactatgaattttttttaactaaggaactgtgattttcttaacgaaaccacaaacaacaagcagataagcatgaggaggtaaatctatggaagcattacttgattacttaattactgactggataactgttgaaggagcaaactgcagaagctgcaactccagtccagcggtttaccatcaggggttgccaatgccagtctggcagacaagaaaaactatgccataggcagcgacagaaagatcgtcttgactaactggatatcacaccgcaactgcaactggtgtttcatatcaatatcatctactctcatagctaacctattagcgcaaaaccgaaaccaaataagcataaacaaaagagaagaaacaagcagaaaccatatggacatccattgttccttggatatttctgacattacggacttcctgagaaaagttttttgaagaaaaacagcatgattgctgcacattttgtattaagaagaggaaaagttaaatccagacgccatagagcaagttggaacaaaggggggcaagaaacctgttcagagagctaatactggactatctatgctttacagatctctctgagaaattggctgtttggccttgttttaggcccttgtctcatcattcagtgacctgtagcatcaataacctgcacttgaatctcagaactatctgcagtctgtggatctcctgattttaacagttcatttggcagttctgaataatcttcgtttcctgccagtaatgcttcacttgatttctcttcaattgactcattacgacatgttgcgttagaagtagaagataccagtgcttcatcattgagctgtgcaaatcgtggatccgaatcttcaactgaactcccgtcaatgaaatgtgtcccagtcccagaatctggagataatggttcactcaattcatcttcaagtttaactgtcaagggttgactgatactggactttgagatggattgcactagtacttcctccatacgacacttaaacaatgagttaaattcatcaatggagtctgcttcaacaatatgtgcctcaaaattatttaccttgtaaggggaacacgatgttaattgctcaatacctgcatgacatcaacttcagttgagttatcatttccagtaggaaaattgcaatacataacttagggttaaaaaacagttttacctgcatgtactgtatccttagcttcgaaagtgctttgtctaggcttctggaaaggagatgaactgatatcatcactgaaatcagcattttggttactgctaaccattccagaatttacttctaatacacccacctctgaaattgccatgcctaatattttgatttcttcgcctatatgtgcttccagtgaaccaaataacgtgctgttgttcctttcttgcttggcatcaccgtctgactgactattatgggatttatgggcatcattttcacttatttcatctttctccagtttgaagctattgtgatgcaggctagtagagtgcctaacatataagtttccatgctttctatgccgtcttgctgaaaagtacgaaagaggagtccaagtttcttgcaatggactatcatgggccatattttggttgactgcaagatcaaatagatttttccgtggaaggagacaagacggtgctgaatcaggaacatgtggtaactcgattatttcatctgagccatttgaagaatcaaatgggttctgccttccagtggaaatggagggaacctgcacacggaagcgtgatgcctcctccattttctgtactgcatcagctgcttgcaagtccattaacctcttgtcaagttcaaatttcagaatgttctttgctctttgcagatccatcataccctccagcttgctattattgtccatatccaagtaatttagatcaataacatccttccagttagcaaaatcatctattttcccttccaattgattttcatctgtgctagcatcctcctcctcaagatcatcttcatcatcatccgaagaagtattcaagttgtctctggagaccaatgaagggtggccagtttgcaagtctattaatgggtgcaactcttcaagcattggaataatgtcagtcattgatgcatcaggagaactctcagtaagatcagattcagaatcagaacaagcatcctgtggctcctgtctcataacaggttcccaacatgaactcataaactcacctaactgatattgatattgtactttattgttatcactttcaggattgatgcttccaagttcttgcagctcatcattcttcttgctgttctccccaacgtcttcagtttccacagttacaccactgtaggcaaaacttgaaggcgccacacaaggaacagtatcagtttccactgatgtgataccttttccttcacggtgggtatcctgcaaatcataatcagaagttccatccttcgtatgtatttcctcatttagagcagtatcaactgtcatgtaggtgccatttttctctttcccagtgagtgtcatgtatattaccctcaaaatttctttccctgacatatacttcattactggtagttgttttatccaagtgctcctcgacagcaacagtctcaaccttgtcaatcgaacagtcagtaatggaaatcttggaatttaaaggacaaagtttgttgattttctccaagaccaagaacagcaggttccccataactcaaaagtgctccaagcagaagtgcagttaacaggaagatggagatgaagacagcaagaagttgaatagagaagggcaaagcctgtgtagaaacagcaacaaaacgccagcagctagtactatagggtaatcacaagcaaattgatatccaattctgacagatgaatacattagtctcttgatatgcaacacaatgtcatttgcaccaaaagccatatatatcttcttgaattttaccctcagataaaacgttggcctggaaataggaaagagagaagcaattcatcactataacattatggtgaatattcaaacaagtaaagatttatacttgaacaatagcggccgtacagctcttagcctccatggcagctgtaattgttgtactagtttgaacctcttcccaatcttaataaacttcagccgcgtatcttacgccagcccggcgaaaaaaaaaaagatttatacttgaaacacaagtttaataatgtgcaatacaatcaaactgctcaaataaggtgacattccagcttccttagttagagatctatagaaattgcatgttcaaaaaaaaaaatcatctgcaatggtttaacattcaacaggtaggtggaaaagcaccatctctttaaatgttcagtcagttatcacaatgaagatctctgaattcaacagtatttttgggctataattgtatactatcaacccataaaagagaggaaagtaacaaagaaataaacaaaataatctaatcagaccaaaatcaaagcgaatttacagatcatttagaaaaagattggacgatcagattcacacaagaagctaaattaggagccacctatgaccacacaagaggctaatagtggagcttagcacaagaccagattagcagtagaacgcaaaaatgcacagaatgccaagctcacctgtagcgacaacaccgagaagccaaagccctcagtagcctgaagcaagtgttggtagaagagtggaaaagggaagggggcaataggaaggcaacctcagcaacaagaagcaatggaagaccaaataaaggagataggaagctgcagtgctgtgcttgcgccctttttttctaggattctttgctttggagtaccgccatgagagagaagttttgtagggaaagtggagagcaatcttggtatctttagctgtcactctcacttttaagtttcacctcattcgttgcacacagtcttcactccctctagaatctggctattttaccagacctgtcaaagctattactgtgcctgaaacaagttagatgtcagtatttccccatcggtggaaatgcttggatagcagtcactgaaatcgtagaagctccctctgtacccgtagaagctcatccatcttgttttcagcttccaagctgaatttacaggcgcaagcttagctcttcctttgaacatgttctcataagcacgggacaagtacaatgatagcacataatgtgctcaacttttttctgtggggagaaagcctgtatggatcaatgcatgcgactgctataattttcttaaaaaaagcacaagtgaatagtgataaagaaagaaaaagggacaacacaactcagctcattttagtgatcagctgtacaataaagaaagcacgtttatggaccacaaaagttgtaagtaaacaatttgtcgtacatctgtactatggtgggtccactttgtggactccaaacattgacacaccttatgcaggtcaaagaaacagattttacctccatatgtaacagtctcatttgcgcattttgccagtgttactgaacccaatcttgctgccatggaaacacctgcgaaattgtgaccaaaacctgtaaattcggcagtgaattcatgcgatttcagtcgggtggcactaggagaatctgacgagccaaagcatcatgtcaaaaaaaaaaaactgaaccaaagcagcagcacatggcggagcgagggactcactgagtcactggagccaccgaattttggaactttaccggaactgaatctagtgccctcctcagtgtcctaatttcctcaataaatcccacgagcaactcaagtgcggaacgcctattgtcaaatctatggtacattggaaccgagaggcggaggaagaggaggagaaagaagagtctttacctgatgcgcggcaggggcactccaatggaagcaaccagcagaggggcggaaatctcgggtcgaggagaggggagaatcgagatgaaacttctccttgacctcctcgcattacgtttccgttgaatccatccacgtgcggcgtccacctccgtggctccgcccgcaccgtcttcgccgccggagttgcgccggccgccggagttgagagcgaaggcggcggcgccgccgctcgcttgttgggtagccagtttgggtcgggcccacagcatatgacccgtttcgcaaagttggcccgtttaaacattcagattaaggcccaaaagcccataaatatgggtcgggctgcccagattttgaaggcccaaaaaaagaagtgatacgaaggagtgtctctaatctgtgccgcatattcttaatcggacgtctcac

SEQ ID NO: 32470 - DNA, 17630 bp, Oryza sativa
tcttgcaggtcaggtggcagtgacagtttattacagacatatccattgatattcagaaatattcagactctggaagaaatttggagtctcggaccatgaaagtcacttggaacggctgcaacttgtagtgcccgattagcttatggtcagacacaatttgccggtgctgtgtgtgcttcatgagctagactaagcaggtgtgtggaaattgaaagtggactactcctgttacgcagtggatcagtaagcctaacaaggacaatcaactagacttcttatgtatggtctctctcatctcatctgctattcagttggggggaccaattcattcatagcttcagtaccaatgtgattcagaacttgctctgtatcctgacagaaacacaaacagcaagggatggaacaagtacagtcacacactactgttcataacagaaacaggtagagtgattgcattacgttttggcaaagcaacgcgaaaacggaatgcatcttgaagcaaattgtccacgtaatgctagctgctaattaatgatcatgcatgtgtgccatcttgaatcatggagaagtgaaagagacatccgaaccaatcgatcaaaacaggcaggaaccggccatttgactcacgtattagttgactctcttcacttgagacagtagcgtgttgtatggtgagctcaggaagctgacggcctaacaaagacatttttttacttgacttcaccagttgatacacgtacgtacgtggctccgtttttgcttcagatttcagcaggtgcagcactgcagtgcagaccatttgtcctcgcacttcctcgcactacacgttcgagatgtagtatactactaccaactgttgaatttcctctctgaatactgtatgctagactagagtcaggttcttccataattttgatcaatgattccagccagtattccaagttgcctgaacctcaattttgattagcattacatcatcatcattctagacagtcaagacagtactgatgtagcagaaagaacttttaaagtttcagaaaatgcatgcctccagtcaaattttcagaaaaagaaggatcaatctagacagacaagacagaaagaactctttaggctctgttcgttatgaggagataggggagattgattatcgttttccacgtgcacgcttttcaaactactaaacggtgcgttttttgcaaaaaatttctataggaaagttgctttaaaaatcatattaatccatttttgaaatttaaaatagttaatactcaattaatcatgagttaatgactcacctcgttttgcgtatctccccaatctcctcaatccccttctcctcaaacacaccttaatcagctgactgatgtagcactagagcgtcatcaccattctaaaggtcggcaccatgaaattttctctggttttgactgtttgactccaaaagcaaaaggggctcattgatcgatcgcgttcttaatttccttgtccattggattactgaagaaacggcaacatatatgatcgaccaaacacccgtctgacatgtataacagtgaaagtccagccacaatctcttgcatgcatttggagcatgccactgtttcagcacaaccgaatgattcagaacatacactagctgtggcatatttgctactagtaagactatgctatcgaaattaaattatagtgtttgcaacaactctgcccaaggaagtggccaggaagaacacaacttgaaattaagctagcgattacaaatcgataaatccaagcagaattaaagaaaaaaggatgaaggagaagaacgctgtaattaacggtaatgcatgacttaagcagtccaaaacgatttgaggatactactcacatgtgtgcgtgacttgacgatgtaggagtagtattgtccaacagcacgagctattcaaaactcaaaagaggagtcaagcaagccgcaaagccaacagcctgcaagtacctgacattgacctggtgatgaaaagtctcagcttacacccaaccattttcacatttgccaacaacataaacaacgcaaagaaatgagcttgctaaaccttcctttgttggtttctgtacaagaaaaatgatggattaatgttacataatttgatttcgaaatattgctgaaactgaaagcgtccatttcattctttttctgcgcttactctgattcatgccaggtcaagatttaattaggttaattgcatgtatgagatgtactagttagtactggccgttatatataaacacggtcaaaattaacctaattaattaaacagttgaattgggaaaatatatataatgtaatgaatcaatgtttgaattgaacgaaatatcatatcaccatgtactctgtacgtagtttagaacaggggcacgcgattctgatctgacgacacatcaaaactatgggcacgagcgtgcgttagtcagttagttagcgttgagaaaattagttgaaatctctagcactagcttcttagcttgcatgcacgcgagatcacacctagtttaattggtcaattttgattcgcaaattctgtacgtctacgtgtacgtacgtacgtaagcacatgttcttaatttgtttgtattgtcgttcaatggtacatgtgtattctccaatcaaattgacctcatatatgcacattgtacgcagttgatgatccgtccatattgtactatctgaggagcgattagatcgtgtttgaaattcctgaaacgattagtataggactagctaggatttcagttcattaataattagtaattattaagttaggtacaaataagcatgtacgtagtactatatttgtaggcaactaaggacacatatcatcgatcactctctcttttcactcgttaattagctggtgatatcagagctgaatgcaatcatatcgttgttgtcatgttgtggattagtccaacaacataccaaactcttgtaatatgatcacttgtggttgaagcaaaattaaatcacgtttcaacacctaatgaggcaaccaaaagattgttttgcttcagaaacaaataatttgatgccaaatccccatctatatatgaatttcatttttaaaagtttgtctttctacgagtaatatatatattgattcttaaacttgggtggagttgtcacttaggtcaactaaaattaaaatttcaaaattgcacgtttaaatgcatcagcttggtttaatgaaccacaacaagtccaaacctcgtttgacgggaactcactgttgacatggcgctccacgcaaacaacaattttgcattcgctctcctccgtgtcatagcgtggccccctccacatatagtactaccccaaagcaccccaaaccctctaaatctctacctccatcaccttctccccgatggttagagttttgacggcgagggtaatgtcgcccacccacttgccactctcccttgcaaccttcgcttcgggggagaatgggagggatttggggggattccgtgtaggggtctaaaagcaaaattaccgtcacgccatgacatggaggagggtggatgcaaaattattgcctacatggagtgctacatcatcgatcaacttggttcaaacggggtttggattgttgtggttcattaaaccaagatggtggaattgaacatacaatttttatgtttaggcacctctgctcaattttaaatactggccatgtatctctcttttcctaaataaggttaaaccctaataattttaaggaaaagtaaggttatatatactttttttttcaaaactcttacaaaggaagatctcaaccatctgatctagccgattggtagttaataaaagtcaaaatgaagtcacaatttgccacgtagtttttataaagagtttgcaagtttttttttttacatgtatcattttcatgtaagaagagtaaagacagatgagtttttttttcatgataatcatttttttctctctaattactattattttctaaatctatttgcatatgaaactttgatgacataatttatcattatatttatattaatttattgaacactgatattggtatccaaaccatacctaaaagattcatttcttaagaagaaaaatatcaaggggttatttctaaatttatttgaaaaataaataaaaataacaaaaaaagttgtccatatataggccaccccctcgtctcccctgaagtgtccgtccatccccagtcaagttcgccgcgcgcaacactcgcagcagagcatccacccatcgtcgatgctcaccgccgccatgcacatgctcgactcctccacctcctcctccccttggcttcctcccgacctcatgcctcccccgccgccgccgccgcccgccgccgccactttccaccaccacttccgcgccgccgccgccgcccccggccgccgccgcatcgccaagcgccgaccgcgcccgtcgcggcgccttcccaccacctacatcagcgccgacccggcaaacttccgccgcatggtgcaccaggtcaccggcgccgacgacctccctccccctcctccatcgctctctctacagcagacgacggagctcctcctcccggccgtgcacgccgctccagcgggctcgcccggcgctgcaggcgcgctgatgcttcccacgctcgacacctcggcgttcctgctcggccgccgcgcggagccggcggccgcggcgccgccgtgcgacgagtcggtggcgttggtaagaggaggagcgggtaattacggcagcaacaacaatagcattagcagcagtagcagcagcggcaactgtggtggtggcttccccaccttggactcatgggatctcctgtaaatctagatcatatattgtcgatttctatcgatttctgattcttcatggctgtaattaactaagacgagatcaatgaacaggttggagcatctatctacctgattctctgttcgtgtccttgttaattttaagcttatgcctcgtatacacatggatgattttttttatcagtagtgttattttattgatcttacttaatttagagttccttttcttttaattattaagtgcgactgttaagttcgttttgatcttccttctgctgattccagcatcactgcatcagcctcaaggttcttaatttatgcaggatttttgttcttgtgaaactcttttgctttgtttgattagttggctcttgcttttctattgattttgagtctttgatgaatcctccttccaacagtagagctgctccagcaccatctcactgaacatgtggtttctgatcatttggtgaacaaaatgtaacaaaagatgtttttttatattagtacattttagagaggtgcttagtgcattaattcagctttagctatataattaattaattaatgcaccaaaccactgtggggggcagtagcatgtaaatgctgcttagacagtaagatacgttaggatgaagctaacagttcaattggagcagagcagggttgagaatcagtacttggaaaagattgattgtgagatacaacaataataatatcgtaatcatcgagccaggtttttttagaaaaataaagtattgcaatcatatatgcacacgcatactaagactgagtttagatccaaaagtttttcttcaaacttctaacttttttatcacatcaaaacttttttacatggctgtgtttagtttctgaaatcggggagaagtttggggaaagttggtagtttggaaaaaaaattttgagagtttatgtgtaggaaagttttggatgtgatggaaagttgaaagtttaggggaagtttggtgtgaactaaacaggaccatacataaattttcaacttttctgtcacatcgttcaaatttcaaccaaactttcaattttgacgtgaactaaacacaacttaaggttcagcggaagagtaactttttttaaaaaaacctaaggcggaactttgttccacttttatatttagaagaagataattgacccagtttataaaaaaaatcggacccgaaaactacacaactgtcacggttaattacagaaaaaccagctaaaaaccaccgttacacaactaactttacattgatctaccagtaacatcgttagtagaagtgatattaacataattgtactattaataattgatgtgatagtataaatagatataattcattgtaaagagtactataaaacaccgcagggcggaaaatgaaaggaaaaaaaaagaaacaaattgggtgtggaatcaacatgcatgcttaatggaagaaaaaacaaatatgaagtgtatttgttaaacacatatgtaggcttgatctagagctgagctgtttggtgcttacaagtaactacctctagattgcccctaaaatacaatgcaaaaagggaagttgacaaggaaaggactatatcaacggagaggaagaatcagaggcacgagctgttgactactgagtctgcgtgtgatttctttctcctcaatttgcagtgtacgtgtgctgtgccatcaacaagtgtggctctggctagcacttagcagcccctggtcctgatgagatgatggtcaggcagtcggtccaaaccgccaaaagtctgggtccgttcctggacgatgttaacacataggagtacaatacaaaccaacggctgtcctaattacttatcgatgtcgtttaccgtactactaataacttactaataatagtagaattagcatattttttttaaaattaacaaggaggagaattcatggtccagcactccagcatgccgctgttagtcaaaattcgcggctcctcttatgggttcgtagttcatattttcgtacgtactaccccttcccaaaatatgtgtaaatatgtgtagccatgagtaaccgtgcctaacgtttcatcatccgtcttatttaaaatatttttaaaaaaaatcacacataaaataatatttatgttttatcatctaataaaaattttaggacgaatggagtatatggctacgcagtgagagcgacaaagggatggatgttggccgccggccggccacgcaggaggggacaccaccattgcacttgcaacgatcgatgcaattgactgcttggtttgcctcctctccggtctccgctgccgtcctcatcaatcacttctcatttgtttgtttggacccagcatcccttacctctacactgcatgtgattcctcacagcccacctgacctgacctccctcccggccccaatgcttacaccatcattgcgtcatgctcatgtcataaatgaacatttttacacatcgctgcaacatcttcagaaaacggaaggcaatactgtgttgttcatgctaaacacatcactgtcggctcagctggatcaacagcgacccttgcttacacaacggagacaggaaggatgcaagcccaagcgaaaacaggcaccgactgtgtttgccgcagacagataagcagggtcagctggcgcacagcaccactgatcacgccgcgttggcaggatgaaacagtacaccactgcttcagataatgacagtttgaacctactcacttgacctctacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagttatgctcgccgggcatggaggtggagctcatactttagtaaactgcagctgggaaacagaggcaggctaaactgatggcgaagagtttgaagacggcgatggaactggaaaccagtgttttgatgcttgaaatgccaatggagataccctccctttttccaaaaaaaaaaaaaaaaaaaaaaaaaaaaaaaaaactgcagctgcgacaagccactacgtacacttctccatgtcgccaactataaatccgaatctgcctaaacctagaacgaatgcaaagagcaaaaattagtactgataaatgataaatctaatcaatgagtgagtgagaaatgctggaacatttaaacacaacaagaaaatcagattctaatccaggctgggggtttattgatttattttgctactagctatgtagaattacaagaaagaacagtctcatttgactttatccatttcttttgcctccagagacactactggttgttcctcatgagtaacaaaagaacaaacggcacctttagcaccaatcaacatcattttaaattgcaaaaggtacaaaaaggtggtttgtgtggctttggggaagtcaagctacaacaattccataacaagtccacatggttgttttcaggggtggcagcaaataagtccgggaataagagacactggcaaagagttattgtgcaaggttacaagaacaagtcaaagtgtctcacatggctggtgaaattgaaaacaacaggaaataaaagtatgctcagagatgttcataatgcctacaactacgtgtaatgaaatgtagttgatatcacctatatataaataaggaaataagttatatatatgcactatcaccaacgtacccttgttggaaaagttattatatcagacacccgcctcaacaaattaatatgagagcctgaagtaaggatatcatataacatatccatatatatataccatcccagattacctatttcacagtaacttctttgtgagctttaaatgatagaatcacgttccacgcaagggctacaaaattagcagcaagaacctggaaaaattagcagtatactaggtgagaacaacattcagtcatgctaaagcagacagaaagaagcaaattcagctccagagtacagtattgcactctaaaatatttcatgaaatgaaaatgtgaaagatttcaaagacctgaaatttttgtgggacaaagtaaaaattcaagaactgaaaaggtatccacaattgccaatttgcaatcactgatgataaccactcctgtaaaattacaactgaaaattagctagcagtaaatgagtgcacacacatattatcagggagatgagagaatcaatcagaagaggttcatgtcacctgcttgagctttggaactacaagagaaggctttccctccaaggtgacgagtaaactcataaacactccaatgaaaatgggagagaaaatgaactgaaaggaggagataaaaaaatatcaaaaaataaatacataaatgcataaaagagctagaacagaacaagcagcaacactctctctttgggggcagaagggaaaggaaaaggatatgcatatacctgatcaagtaagaggcgagcaattgcacctgacgcaccattgatcatcactaatttactcaagtacaagtacctgcatgtggcaacaagtaatgaaacaaacagcactgggcagagaacacatgctatcctctataaacattggttgttcagcataaataagattaccagacatgcaatgttggccccaccaggacgagtcccaaaaatgtgaatacaaacgttctcttcaaatctagctttggcactttatcaattgcgagctggagcagtaccaaacaatggcaacagtaaatatctcgtaagaaaccttaacaagataccacaataacaagaacaggtgaaatatcaaatattttgcccaatccatggatgcaacccagttggaatagacattgttttttaataatggaataggacactgttgctggagtaaagtccgttgaggaatcaaataatatgagttacagattagcataggctaaagaccgacacagttgagtaaagacaatatattcagattatggttgacacaggattggataaaaagatatggacctgaaatttgataagaccgtaacagcctagccagttaagagtttcacatcatgtcatatttagaaaacaaggaaactaaaagagtgcagctagggcagaaaagaaccataactcagtaaattgatttccaagtggtattagcaatggataacatttcaatgttgttttgaaggaaaattggtatgatttgaccatttgatgctaatgcccatctaagcacgcctggctatgtgctattgcagagtaataggaagccctctacaacaagagagggagactactggttcattgttcgtcaaccaattaagtagtactaagtaggctgcaatgtatggatgtgaaaatgcggcaaatagaaaacaactgcaagtcacctggcagatgaggtctccggtcagggttaggacggcagaggtaacagccttagtggtgatgggatgcttatcaagagccagcaggtacctgcaaatcatggcgcatttcagtaattttgcatttagataagagtattgcaaaaagcgaggcacaagaccatgtcagtgcttggccgcaggaggcaccgggaatcaggaagaggcggaattggatttaccaagccagcaggagacgccaatccatttctccttttgctccaccaccaccacctcctcctccggcggcgactccggcggcggaggcggaatcgcagcaggaggcggcatggagcttcgagaggcggacgcccttgcgcgggtggacgacggcggttgtcgccgggagcgaggcggggcggggagggagggcgaggcggcgggagtggaggagcggcggcgcggtgggcctcggagtcggaggggtggagcggtgcacaaggaggagcgggagggtggaggccatcgccatgggtggtgcttgcactgatgctgcaactgcaatggtgtgaggaggagcttgggttttgggtcgcactggactagggttctactagtagttgcaattttggggagaaaatgatgaggtagacgaagatgctagcaatggatgatgggctttgcatatttgggctctcggcttccttgttgggctcttggcccacctacatttatctatctatctattatattatattattaaaacagctttaaaagaggcaccacgtttgctgtgggggataaaaattctcacattaatcggagaaaaaggaaaaaaaagaaaaggagagtccaagtagaaatacaatataaaaatagatgaaattcggaattaaaaataattaatattgaaagaagtttccatataagtacccaatacgagaataatcaaaattcgaaataaaaataaaataaaatccaaaattagaaaagaaaaggataatccaggtaggaatataattttaaaatagctgaaattcggaattaaaaataagaaatattaaaagaagagtctatataagaacacaatacgagattaatcaaaattcagaataaaaataaagtaaaatctaaaattagaaaagaaaatgagagttcaagtagaaatacaatttaaaaatagctgaaattcgaaattaaaaataagcaatattgaaagaagtttccatacaagaacccaatacgagattaatcaaaattcaaaataaaaataaaataaatctaaaattagaaaaataaaatgatagtccaagtaggaatacaattttaagatagctgaaattcggaattaaaaataaaaaatattaaaagaagagtccatataagaatccaatacgtaatcaaaattcggagtaaaaataaaaataaagtccgaaattagaaaaaaaaaagaagagttcaagtaggaatacaatttaaaattagctacaattcggaattgaaaataagcaatattgaaagaagaattcatataagaatccaatacgagattaattaaaattcagaataaaaaataaaataatattcaaaattagagaaaattaaaagagagttcaagtaggaataaaattttgaaacaactgaaattaaaaataaaaaataaaaatattaaaagaacacgatacggtattaattaaaatttggaaaaaaattctgaaattataaaaagaaaaataagatttcaattaggaatataatttataaataactcatttgggataaaaataacgactattgagagaaaagaccatctaaaacacatgaccaaataaattaagtaacatgcttataaggagtagagtggtggcggttgatacgatatataaaaactgttaataaaacaccaaatagaatcctaatgacaattaaaaggaggacgacaggcaggccgcaaacaaacaagcaggcagttgccgggacttctataaagttaaaaaaaaccattgataatcaacgacaataaaaagaagaaggagcgagcggggtgtatagagtatagttgcagagccgccgatggttgacgggtcttctagaaaataaaaaatgaatttcaacgatagttatgttcgatttttagaatcacaatgacaataaagagtaggcggcaaacgggtcatagaggagcatagtgatattgtttgacgggacttctaaaaattataaaaaatggaacccaacaagacaataaactctaaaaactataaggtctaatttttaaaggttcggaacttctaaaaagtaaaaaaaaccaatgataatcatgttcaattttaaaatctcaatggcaataaagaagggagggagcgggcgagccgtaaaggagtacaatggcaaagccgctaacggtttggcgagacttcttgaaaagtaggaagtaaaaatgaacccaaacgataattatgttcgaattttaaatctcaatgacaataaagagaagagacggtggacgggccgtagaggagtataatggcaacgtttgacgagacatctagaaattataaaaacgaaacccaacgtgactataaactttaaaaactataagatctaatttttaaaggttacaagaagaatgaatagaaatagcggtagatcaagcaagtaaataaagaaggagatgacataaggggtagtagctggtgtgacttttaaaaactactccatccgtttcaaaatgtttgacaccgttgattttttagaacgtgtttgaccattcgtcttattcaaaaaatttaagtaattatttattattttcatatcatttgattcattgttaaatatacttttatatacacatatagttttacatatttcataaatttttttaataagacgaacggttaaacatttgctaaaaagttaatggtgtcaaatattttaaaacggatggagtatataattagaaacatatagatgataaggtttggtctttcgaaatcttaagaaaatgaggtagctatttaataaattttaagtaaaatcatagtaaaaaatatatgttttgtttaggtgctagtttaggtctaacctaactgtgcccatctcgccggcgccgcctccattcttctcatcctctccactgcggcgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtacatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttgctctgacgattcggagggaggatgaatagcggatcacaaaacgagatgattgattcatgtgagatccaagcacccatcttgagctgtattttctttagagttcttgacggtctggaatcctaatgtgttctctttccatggaaaatttttgggcatttcagtttcagagcggcaaggagccaaggatgcagcagcactagggtcctagtccaaattgtcagctgggggatcaatggcaatggcggagacggtgaggctgcccgaacagcagcgtcgcaggcctctcaccattgccagcctccctgaagaaattatgtcggagattctgctcctgctgccgccaaaatccatcctccagtgccgtgccgtctgcaaggcctggcgggacgtcacctccgaccgcgccttcctcctcacccaccaccgccgccagcctccacagcgcctcctcaccttcatccgcgacgtgggcagtcaccacgatgacctggatatcctggactactgtgttgaagccgttgacttccgcacacaccagttccagtctctggcccggttcactggccaagattacgactgctcactcgaagacagcccattcaccgtccacgcttcttgcgatggtctcctgctcatgtcctacaacaactatttgcatctctgcaaccccactacacgtcaatggctttgggtctcccccccggcgcttcaacatgacaaggtcgtggggctctatgcacatggacatccttccgaataccgagtattgtactatcgagaatttggtttgggacgtacattctacatcaccactgttggctccaggaaggagaggcgcatttggccacattcatcatcagaatccctgagaaagtggtgacaaaagggacagaggatactgaattcaacaagcctttcctgtttcatggaaacctgcactggttgccacagtcaggtcgacaaaacaagatagtggtgttcgatacactggatgaggcgtttcggtggttgcatgtacctttcaagatgcacaatgtgtcctcattactcgagattgagggtagccttgccatgtcaaacagccatattggatcatcaaaggtggatctttggcttctgcaagattataagcatatggtatgggtccacaagtatcgaattgaattgccagtgatagagattcgccgtttagtagaagatgatgtttggtttcttcatattgtttcccaagagggtgatgtcttggttgatggatcttattggcagtttcactacgacatgaagggtaatttgctggagaaatttcaatgtagtggccgcatgctgaacattactccacatattctccaagaaagtctcgttccacacgaagtgttccaaattctagataatgaaagtagacatgcaccacatttcttcagggggttgtagagcatactttctgtactgtgaggctatttcacacttttgggcgtctattcattggatactgcaattttagcgatggaacttaattttgtagtgaatggtcaatgatctgttgttgcaaagggcagcattcactctgatcagtatttctgtacctccacatgttcatctttaacatcgagggtatcatttcagtactgtacgtgggaaatttaaatgcctgagactgttttttcctggtttgtggaagtctgagactgaacagttgattatgctcgttgtttatttcaacatcgcaagatggttacttccttcgtttcacaatgtaagccattctagcatttctcacattcatattgatgttaataaatctaaatagatatatatgtctagattcattaacatcagtatgaaagtgaaaaatactaaaatgacttgcattgtgaaacggagggagtactttttattggcttcttgcaacttaattttgccactctggtattgaaaggtcattgtctacttgtgttggtgatgcgtatgtctgatgagatccttagtgccatttattttgagtttgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctggtcgaatcgcctccttcaatagcaaaaccgggtataatgactccctcatctttgaaaaccggtgcaaatcgactcttttggtggtttcagaagcggttttatcctacgtgacacttgtgggacccacatatcggtgaaaaaataaaaaaataaacaaccccacatgtcagtcatcctaatctcaaccttttttttttctcaccactctctctttcgtgttctctctctcttgtcggtggagaagaagctcgactactacagcggagaggggcgcccgccgcaacagcaggagggggggaggaggggcgcgacacagagcaagcagtttccgaggaggaggacgcgaaaccgcgtgagcacatggcaggggagggaccgatgggtgggaggacgcggtcgccaccgcaacgtccttctctgctccttggctcgtctccacggcgtcattccgtgcggggaggagctccaatgtgatgggttgctggtgctgtggggacgacagggtggagtctatttgtgcatagagtctatttcaagaagaagaaccggaggaggaagaggtagaagcatgagagggccgacttgttccacgacgttatcgcgcccacgctgcagccgatcacgcacgtggagaggacctgggcggctacggcgtgtgcggagaagagaacaccaaccggctgcgcgtgagggaaggagccgcctgccgtggcgcgcgtagacaaaggagctcgccgaccactactccgccggcaaatagagaacgggagaggtgaggaaaaaaaggatgagatgttttttttttcattttgctcttactgatatgtgggtcccataagagccacgtaggataaaaccgcttgcaaaaccattgaaggagtttatttgcaccggttttcaaagataagggagatgttatacccggctttacgattaagggagacgattcaacaaagggtaagagatgagggaggcaaaataggcttattccatgacgaatgcttctctcccgtagcagcccaggtgcacatggg

SEQ ID NO: 32471 - DNA, 2553 bp, Oryza sativa
tgttccgcgccgcgcctccggccctcgccctcgcgctcgccacccattcggtcaaattcctcggcgcccatgctgcctcctgcgaccgcgtcctcggtgccgcgctgctcggcgtcttcgcgcgctgcggcaggatcgcctcatgccgccgggtgttcgaccggatcgcgcaccccgacctgccggcctggaacgcgctgctctccgcctacgcgcgtcttcgtgccagggacgtggcctgcgccacctctgcggcggatgcaatcctcgagctgtttgtgcggatgctatccttagccattgaacccaacgagatcacgctcgtcgccgtcatcggcgcgtgcggcgagcttggcgctgtcagccacggggtgtgggcgcacacctatgccgtgaagcgccggctcgccgtcaactgcatcgtggccacggcgcttgtggagatgtatgccgggtgcgggaggctggacctggccgagcaggtctttgcagccgcttcggacagggacacgcgctgctacaatgcgatgctccatggcttggcagtccatggccatggccgtgctgccctctccctgttggacagaatgcacggtgcgggcgtgccggtggatggcgtcactgtgctatccgtgatgtgtgcttgtgcccatgctggattggtggatgaaggtctggactacttcgacagaatggagatcgaattcgggattgagccaaggattgagcattacggatgcatgattgacatgctgagccgggctggtcgacttaacaatgccgagaagctgatccacgaaatgctcatcgtgccaaatgccgcgatatacaggtctctgatccgggcctgtggcattcatggcaagctggagctcggtgagaagatgatcgcagaattgatgcgacttgaaccggatgacagtggaaaccatgtcctgatttcaaacttctatgcgagaacgaaccgatgggaggatgccaagaaggcgaggaaggagatgaagtccatgggcattgacaagaaccctggatcaagccttgtagacatcaatggagttctccatgagttcttggtgggtgacaagacacaccctgcctcaaaggagatatacaccatggttgaggagatagaaaccaggttaatcgagtgcggacgccggtcgagcacctcgtctgcgttgtttgatgtcgaggaggaggacaaggcggatacactgtcctaccacagcgagaggctcgccattgcctttgctctgatcgcttccaatccaggagctcccattaggatcatcaagaatctccgggtgtgtgccgattgccatgagagcgcaaagcttgtatctcgggtgtatggtagagagattgtcatgagggaccgtacccggttccatcacttcagagacggggtgtgttcttgtggagatttctggtaaatactcgttgtgttgtattgtacattatacagtgtaatgtgctgtagatttctctcataattctgtggtaatgggatgtgctgtactggtctcacacatttgctcgagatcacaggctgtgtttagttccacgctaaaattgaaagtttgaagaaattagaacgatgtgacagaaaagttggaagtttgaagaaaaaagttggaatctaaatagggccacagttcattcggttgtagtttgcatggttcaatatcagtttttttttacaatcattttattgatgacggatcaagtgttacatggcaagtggtcaaagaactgaaatgaaattccgaaacttggccgtcgtagttcaatatcagttgtcagaattcaaacagttgtagtttgttataacttgcgcaattcgtgcatatgtggctagatagttcatatgaaaaagaattatttcggggcatatgtggtctattctttctctagatagttcgtatgaaaaggaaggaaaaagtataaattacccctcctccccccccccccccgaactatgacggtcgtccgaattaccccccgaaccacaaaaccggacattcttcaccatcaactatgcaaacggggcgaattacccccctcgacccaatccgcggtggttttagtctcgtggcgtacgcgtggcagtccagtcagcattttatttattaaaaaaatatgggacccacctgtcatactcctattacactattcctttctctctcttctctcactctcaacatctctctctcactcttcccctctctctctcctctcactgtgaactatgcaagcggcgggcggaggaggcgaggcgaggcgaggcgtggcggcggctgcggccaggtaagcgcggcggcgggcggacgcagagctagtggccgtgccaccggcggtgatgggtggacgcggaggcggactaggcggccggcggcggaggcgaggcgcccgggcggctggtggcggaggcggcggacctggcggccggtggcggaggataaggcggacctggcggccggcggcggaggcgccctagcggagctcgctcgaacggtcgatgacggaggcggaggcggaggcggagcatgcgtc

SEQ ID NO: 32472 - DNA, 12864 bp, Oryza sativa
tgattttgtcaaataaacgtgaactggttaaataggcgagcacagtcagctaagacagcaagtctgggtggggtagttggttatcacgttagtctcacacactaaaggtccccagttcgaacctgggctcagacacaaacatgttttttccattttttttcaacaatatgaatatttttcttaataacaacagcataattacatgcaaaaaatatttctccataacaataaccatttttttcaacaatttgaatatttttcttaataacaacaacataattacatgcaaaaaatatttttttccatttttttcaacaatttgaatatttttcttaataacaacagcataattacatgcaaaaaatatttctccgtaacaattaccatttttttttcaacaatttgaatatttttcttaataaaaacagcataattacatgcaaaaaatatttctccataacaataacataaaaacttgataaccacatgcacatgattttttttttcaaaaattcgaatatttctcaataacaacagcataattacatgcaaaaaatatttctccataacaataacataaacacttgataaccacatgcacatgattttttttttcaaaaattcgaatatttctcaataacaacatcatacttacatgcaaaaaatatttctccataacaataacataaacacatgcacatgcacatgcacatgcacatgatctttcttttattttaaaaaattcaaatatttctcaataacaacagcataaccacatgcacatgatctttttttttaaaaaaaataaccctccatatcatcgagcaactttaacagcataaccttttctttttcaaatatttcctccataccaacagcataaccacatccacatgatatattttttttcaaaaaaaaaatcttcatatcatcaagcagcagtataagctgcaaaaccatatgcacatgaagtcaaatatttcctatacgacctatatagcatcttagcagcacaaccatttgcagtaatgcagatgatctcattcagagagttaacagggtttagtgctacagcttcacatccatatgatctcatccactaagttaacagagctttaattctaccacagcaactagcaaaagatatagtaattgcattggtggctacaggcctacgacatcggcaatgtacagcacaaaatgtgagggtctcatctcatgccacacaaagcagcagtccttgctacatttccactaacccaccaccacaaatacagagagcccctttatcactttatgctaccattcatagagtagcttaatatcctgcaaatgtaggatggaagcattaggcagtcacaagagaaatagagttgccatagtttcagatctaattgttcagtttgtcaatatcgtatacattcttgaataaatatatggcatgctaagcttaagttgaaaatatatgcttatgtaccaaagcatgaaaatcaccacgtaggtgcctcaggcgactgtaaccacataaagttgttttgagagttcttgacttacatgaatggagtgatgaatcagctacttctaaaagagattattcagttgcataaataggttggaagaatgcatttcccatgaagaagcagtttttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgggggtagctgtcatcgccatggtcatactgtacagcttgccaaaggagattaggagaacagctatggttcagaaaacgagccacattcccttcattgtttgctcttatgatgattggtagcttcttaaagttcttggttgtcacagccgtacttttttcttcaagtaattctgctcccaaattccagcttaaagccttatcgccgggacatgaagcgcaaaaggtatatttgtcttcctcaacatctatgtccatcttagtttcatcaatgacttcaccggcgtactcacaaatgaatgtgccagcacggataggatcccaagaccgcaggccccagccacggtctccagtccagaatacctcaaagttcagttttatacccttctgtgtgatcctgtttcgacaattatgagaacactgacagttagaggagcactcataaaccattggagtgtgctttgccagcaatcccgttgcgctgtaaggaagatcaccaccattctgttgcgcacacgaacaattagggtcaccaggcaagcaaacactaggacatttgcaacattgtaatggttttgtcttcctaagaggtctcaaatacttcactccagcaacataattgaagtgacttggccctttttcatcatcaacatcattaacaaggcacacaggtaggtgttcaacctttgatgataaatccaacaatatagccttttctcttgtggcaggatttgctttccacttctcagtcatcttccaaagtgaaattccatcaggctgtcctgggtcccttctcagcttgtacttgaaaacattaaatccgttctttgccgtgtctgtccaagtgtcttcgatacgataaagcccatcataaatatatattttgcctgagttacaaaaggggtcttgtgcgctgcgcacaaccctgatctgattcttcttgatcttgctgttcatgagagcaaggttacctctctcaagcttctgatcatgcttctccttgtgacgactattgcctccctgtcctgtgtagaccaaaatgtcagtgtcatcatcgtcattctcatagcctccagatgaaatgatgcagacagccagagtctcatctttgttcttagaagagatgtaatcaatgccacccatggctggtgcatgcaaaccaatgatgcacatttcaatcctaaagaagaagatatcgccgacttcaacaccaggcacatgccctatcatcttatgattgttgattctgaggttgttctgcatcatgagggtgccagctttcaggtcagcccgcctgcttgcatcctccttttcatccaactgcagtacacggcgccgaagggaatcaaacatcatcaggattccttccaccgattcctttgggttgtctgatgaggatgaacacaagttgaactcgttgtccaggctcctccttattgatctgcgcttgatgttggcatcattagatttctcagcttgctggggcctcttggctctctttggcagcgttggttttttctgcctgcaaaagggcttgtaatcttgatctgatgattcatcttcatgttgcggtgttggaaatgccgctgagattggtgtagcttttataggaactggtgactttggtaagggcagagaaaatgaagctggggcttcttgaggctgttgtgatgaatggtgtggcataaactaacaatggattggttgattgagtttccacatcatatcccaaaatagtaggaaactttggcgctaatgagcgcaatggctccaattccaagggtagtttgccattctctgcttcatcttcagagttctccatggtgaactcttggagaaattctggcagcagcaaaagcagaagtcaataaatagtctgagcatgatacttgtatgtatcagcagatgaatgatgtctcagaacttgatatgttaagaataagtacgcgagataaatataaagaaaacatcgttcagtgcaaatacaacgtagagcaaagaaattgaataaaaagaaaatagatctgcaaaatcagaaagctgcatcaacttctgaacaatcagaaacagaacaatctgcatattttggccattgatcggtcggctgagcactgatggctcacttaaagataaaaatgtgtcaatgcgaagtctctgtggcatatgaatcatggatgttctgtccggaatctatttggctcacataagcattaacatttcaaagttctacttgttccccccttacaaattaaccaaaacaaatgcaggcactagaatgacgaagatggaaacaaaatgcattgcaacttccaggcgctcatctggggaacccaaatacagtgcgtccatttgttcaacaaacccatagttaaactccaggcaaccatttgcagtacacacagacaataacactaacaatcacacgaacttgctacaatcaaaaagatgatcaggaactaggacttgcagaaaattagttagaattctaggaaaaaaaaacaatggagagaaagctgatcaagaagcatcagatgaggagtggtgtaccttgaggatgtcgccttgctggggagtgtgaaggggcacaggacagcagttccactatcggagacccctagaccaaaccgtcaaatgtatacatgtatgtggacacaggcaatcgtgtcagtgtggcactaagcactagctttacaccatctaccgtcggataatctcgagatgcgcgcctctggaattggctggaatatactgagtgagatacttaatggtgattacttaaacataaatttagaacagcggtgtacttcatctactgtaaaaaaaaaaggaacagcggtgtagttacagtcattcatggcaggacactggaagtgttcaatttctgataaactcatttcactttcattatctaaaaaagcaccaccttattttctccaaggacacagacacttcattaacacatttgctgctccagcctatgagcttgtctctgattcttttcaggtcaaaagtagtcaaagtacagtagcgtttttaatctccttgcaagagcaaaacttgcaatcttttcactgaacgtatagcaggaaaaacaccaaaactgacaaaatgtagcaaaaagcaagtgatgccccttaggtatagtttctagcatcaactatagtagattctacattctcgacgcaggaaagacctatgcgaattttcacctagggctgctaactcgttgcatggtgagcatcttcagttcgagaaagcgttttgcgcagttggacagacacgaggcttcgctgttgctgaagctgcttccaatgctcccagtgatgcatttgtcccagcaaacatcagtcagcttcgccacgaactcgtttgccattgccttcctcttctcctcctgaagagggaaagaaaaacaaaaatgtcagtaacatttctgtgagtaacaagcaccgcggttctgcaattgaataggggatcttgaaaatgaacacatggcttaattatccattgtccaaagaacagagtacacaaaataatttcttgtgcataaagggaagcaagcaacttctgccattctcattacatatcagaaacccaggacaaaaaggtcctagcagcatactagatgtaaaaaggcaattcccttttttccttaagtcgtttaatttgcagactgatgacctttctatgttagtatttcctttcacataagagtatatcggtatgtcaccgggaaaacatctttggttccttgcaacgtgtcagaatacccagcactatcattttctaacataacaaagctggtagcaaatcaaatttaataaaacacctcactgcgctatatgcattagcggctagcacacttgggatttgggactactgcaatttaagaaactactgcatgaaaataaataatttgttggatatcatgagagagaattgtaacttctattagtaatgagtgaacagccataatccttaaatacagagcaccacaaaagcaattgggaatgacagaatatcacctcagttgaagcgttagaaacttttcaagctatggctattttttaggaaagacttcatgaaccaccaggaccattctgatggtgcctaaaactagactctatccaaattagtttggttcacagtcagggttactgggtacttgggtgatagtcacaaccacaaggagccccaagaacataccctagttctccgcaaggaattgatcaaaagccacaaccacaagctggattaactccagttatgctatggatttgggaccctatcaacaacagaaccggctatgagatttgaggccaaacaatccttggatataagataccgcaattgctctgagcacttgatatactttaaaataaaattgctatgatactagatacctaagtaacacaactaggattcgaataccgatctccacctgaactgcaactcccaggacatctgttaaaccccaaaattagggcacaaccttactcttagctagaaaaaccagtcgtgatgcctaggaattcctgcagactgaagaatattgctaaaacaactgaacaaaataaataaaatgcatacataataagctaatggttggaaggaacagggcaaaaacttggcacaaatcagcaaaatttcgcccaaagctcagcctttttcacgaatcttcgagtagatctaaaaaggacaaaaaattaatcgcgagcgtagcaacaaacagatgggctgatgggatcaaaagaagggggctgctaattaatctccgtgttagggttccataggtcgggtactcgagtgtgcggctcatctctaaatctccctaatacattatgggtttattattacctctagcatggcctgcagccgcgggttgctgagcgctgaagcatccatggctcctctcctccttctcttccgctcttcttcttcttcttctctctcctctgcgattttctctctccttctctctctctagtggtggtagacttgtgcttgcctcgtcggcggcttgcagagaggaagaaaggagagaagaggccgtgggctcttttcgttaatgggctatgggcttttttagaaatcagatcgataaaaatgggctatggacttttttttacattctggcccaataccgtttgcgaaagcggccctcaaccgcatccaattgcctttccccgtgtcactgtcaaccggagccaacctaagcaaagtgaagagattaaagatttttattagggaataataccagaaattaaagatctatagaagagtgagaaatcaagagtagagtagtggaactggaatgaacacttgtgcattatattctccaggacagatgtgacgattactgtcgcatatatatcttgcaagcaatgcaacttcttcttcaattcgtggatatcaatcatatctcgagtgcaaacggacacgcaagagagcatcagatatatatatatatatatatatatatatatatatatatatatatatatatatcgagaaatcataaatgagctgctagtattattatatatgcaacattcaaactcaagctagatatatctgtcgatcgatccatggatgaatcaatatgtttgtgttgcagtgcacgcatgcgcatgcatttcagtgatttctgtcgatcagaatcagatcagatcagcggtaaatgagtcacatcgctatcgcgcatgtatgatcgatcgatgttccttcacgtttagacccaagcaaggcaacgccattatattccatcaatcattacgcatgaacgttattttcatgcatgcccggtcaatatagttcctcaatttgacggcacataatctgggaaatttgtttcacttgctgtcctgcatggctacatcttactaggttcttaactaatcaccacttttctttaatcaatttcattctagccatgaatgatcagaattgcaacgttgtcgatgagggactacctacgaagtggatgactaattagaggtcctaatttttttcatatcttaatttatgccaatttgttttaatatgtttaaagatctttcactctctttttttcttttttgaaaaaaaagtactcttactttttttattaatgactagaatgagtttgtttcttcagctttggtaagtagtactactaattatggccaccttaaagaggcgataacgatacgaacatatgtttcaggcattacaaattccatttttccacataacaaaaaaaaataaatcactacatcacaccacaattctttttctaaaatctatttcttttaaaaaaaaattcttccgacttagttagagtaccaccatcaatttattcttttgtttcttggcatttttctaaatatcaatttatgattcgtatcggggactcagattattaggtacggccccacggaattgtaaaacaaaacacactactcctctgtttcatattactcatcattctagcacttttttttaaaagacaaaacatgaaggtatggtaaattactgaactatcctattaataacagcaatatttgtacttcatattggagttaaatgggtattttatacaagcacaatagttgagggggtacaatgaacttaataaaatgtctaaatataacagtgttgtaccttttttttccttctttctgtatgcaagaacatgcgctgttacctagtactatgtagaatgaacatgacaatcttcactgccacactgctcaccaaatcctaggagagagctacttgtaattttagtcttgttgaaatgatcaattgattagaggctatgtgcattatctcatactttggtagtactaatacaaactttgtttttgcgaggaagtactaatacaaactttgacggaggcgcaactgcctcatcccttgtgatagcaaggaaccatgaagaaccgatcctcttttgtattggtgtgctctgtgtatgatttcgtatgtgatcgatagctgaaatcgctccctaccgtttccattgataactctagtcgttaacgttattgccaaaaaccgatgaaagtcagataaatttggttagaaagtttcatttttttaatctttggccaattatggttaaatacagccagctcaataggaaccatgacatatatcgtatttgaatccaggctctgctctgttgagatatttttgttttcttttggacaccaatcatgtactctctacatccccattttaagtgcagccatagttttccgcgtccaactttgacgattcgtcttatttgaaaatttttaaaagaattttaaaaatataagtcacgagtaaaatactatttatattttatcatctcataataaccaaaacactaattataaattttttttaaataaaacagatgatcaaagttaggcgcggtaatggatggttgcacttaaatgaaaaagagagggagtagattagatagagtcaggcagtgtgggccacggagatgtctgagagccatagacagatgatccatttcattcgataattaaatacagtactgtagctagggataatcaatccctcgtgtctgtcggtgggccccgcgcacccaaccgccgcgccgaaccccgccgcagcaagcaactgctacccgtgccgccgcccgtctccggcgtccgatcaccatcaggcggccgcgcgacctcctctgcttgcgttgcgtgcctccccacgaggtcgaggtacacttcccttcaaagccactgtctctctctcctcctctcctctacttaacaccaaagcctcgcgctctgtccgtcctgctcctaatcctcgcggcagcttgcttggcgctcgcctccctcggccgcacttctttcttcctgattcctgacgtcttggatggtgcgctttattatggtgagaaattttgacgaaaatcgtttactgctattcctgcttgtcttctttggttatgcggacgacctgttcgacgaaatgactgatacaagggaattgattggtctttgtgttgtttagcctcttccgctctcctaatccttaacaagttgactgtttcattttgttgtctggtgtcaacgcttttatgattttctaaaaattgtagttgagcaaatgatgcaagtgttgttatattgtagacatggttttggacatatcactgtcttctctatgtttggcctttcgtttcttctaatggtatcgctgttttgatgccatctagtaatagcatctgcttgtccgatgcctatctttcttagttgacttctcatgcatactgtatcatcttctggccttatttgttcaacagacacacgacctgcactagtgtttacagctccaagtatgggttccagagaacccttcctgagtgccatcttcttcttcttcttcttgcttttgttctgcctcggctgcaagtgtatagcttcagagttacacttacacacgacccagactgcggtcctcaaggttgatgcctcactgcaacatgctcgacagatccccgacacgctatttggaatattttttgaggtaaaccgtaagatacatatagtaattttgttttgcacaattgcattatatcactttgtcctttcctctggcactttgttagcatgtctagaataagtcaggtagactacatgtttcactatgtcctgatggcaatttcttggctaatattgtaggaaatcaaccatgcaggagctggtggaatatgggctgaacttgttagtaacagaggtacttcaattattctttaatgcaagatatgcacttattttgttccatcgtccagataaaacataatttgcttctggatgaacatgaataacttattctgcaatccgatggaacacaaacacatggctttaaaaaaatccttttgttatttttttttgctgggccggcaaaaaccggcagagttgtatattaagaagaaaagaaagttttacaagtacaccctaagccaggggtggcttaggctacagtgaatcgtctcagcgatttagcctacagacaaacttaggctacagtgaatcgtctcagcgatttagccagcatcgatcgcgctcaacaggccggcggccttccatgtttcccactcatcagcgatggtagcacagaggtgtaccgccgatgtggtttttccatcaaacgcgtgcatttcgttccttccaaactaaccacgttaccaggataaccccggcgtcgaaggtcttccgatccgtcttatgaaccgatttgtgcgcctcgcaccaccagcacagtaggaaatccttttgttattgtctttactcgaaaattctccctactatcttattaactaaattatgtttttcccatgaacttaaaaaaagagtttaattttttttagcataactgtaattctgtaaacttggaacacaaaactttgattaggagcataaactggatgggatgcaaaataatatgccctttcatggaagctatattgacatgtagggcttagtataaccagcttatgagttttatgcacaggttttgaagctggaggccctcataccccatcaaacattgatccatggtccataattggagatgactcttccatatttgtggcgactgatcgaacgtcatgtttcagtcggaatactgttgctctaaggatggaggttctctgtgacaattgcccagctggtggtgttggcatttataacccaggattctggggcatggtatgggtttatgtattgttgttctttagtttgttttcctcatagtactgctaccattttgctgtattttctatgaaattacctagtaaatcatggacctccacacgttctgtttcaaattttcatgtagcgatatttctttcgtgcacttgtgttgggcaaaatatggtaaacatttgctttcctaacttttgcaatgcttcctttccaatgctttgatcgcccttaattgtcatatcaacctgcagaacatagaagatggaaagacctacaatttagtgatgtatgttaaatcaccagaaactgtggagttgacagtttccttgacaagttctgatgggtcgcaaaatctggcttcaagtaccataccgtcagtgcctttgctctcaatactgggacaggagaacaaggatgtctgcccattcccattagttgaaagaattatattgttgcagggtttctggtgcgtcgaattggacaaaactggagcagaagttggttgctaaaggaacaaatagaacctcaaggcttcaaataacaactaccaagaagggagttgtatggtttgatcaagtctctctcatgtctgcagacacttacaaggtacattatattttgttatcaaacttcgttactggaaaaggaaaacgatatcatggactttttcatgctatctctatatagtgtatgataccacttaaatcttcatgggctttttctactgcttccaacatttcttttacacattcagggacatggttttcgcacagaactaatatctatgatgttggacttaaaaccacgattcttgagattccctggtatgagctatattttccaattgaaaatcaagttcttgatatctgcacatatatgtcagacgtgtctgggataattgacttgatttccattcaaacaattgtaggaggttgcttcgtggagggtgaatggttaagaaacgcattcaggtggagggaatctattggtccatgggaagagaggcctggacactttggggatgtttggcattactggactgatgatggccttggatattatgagtttctccaggtaccagtttagttgacattatttccgcccttcattttcttatcactccctaatcatatattgcctttgaattctatttttttttctaatgaaaaatttgaactctacatcaaagctttctgaggacctgggcgctgccccaatctgggtgtttaacaatggtaataattgccatattttttatatctttatcgcca

SEQ ID NO: 32473 - DNA, 7854 bp, Oryza sativa
tgagaaaattgatactatcttcactaccatcgtagtagtgttccatcttttatctttgtatatctaaatattaaggatcttcgttgtgcagatcctaagaatgcaactgcatatgatgtgtctcattgactgatgctaaaactcttgccttgttttctcatgattgaaatagagctgattttctgtgtaaaataaaggatggtttgggcttgttcttttacactattagttcagagagttctttaaaaaattttcacaaagttcacaagcagtgatgatgtttaacctgaatttgcattctgatctacttttcctgaattgagacggtaacgtacctatccaagaaaataccaaatatcttttccttaattgagactatggtagttatcataacaccacttttgttttgggaacgtctcctgtctctctacaggacgtattggacagtctagaatttgcaagggggagtgcagattcgacatggggttctgttagagctgcaatggggcaccctgaaccattccctgtcaaatacgttgcaattggaaatgaagattgtgggaaaaaattttaccgcggtatattcctcatccaatttcatattttatccacttgaccatataactgcataagttgaagaggcttgtctggataattaagaaggtgtatgatcgaggaaaaggatatgcacatgaaccatgctaattatgtaaaatatattttatggatttagtcactcaactcactctctatccactttcaatactgggctttgattttgtgattggacgtgtatttcaaataatattagctcaataaaataaatctctacatgaaccagagggaaatatagtccacaacttctttatgatgctgtttctgtttcctgagaagtcgttcattaatttagtcacataaaatctccatagaaaaaccttacaaggtgacatttgtttcttacactatttcaattagtatataatattaatttttttatgtcatatgttctttttcctcttttatactcacagtaatatacgttgttattttttatcgttgcaaataaagtaggattagtaatacataaaaacaagtcctggaagcaaaaactactaaaatgtggttattttcattattttttaaaaaaattgggatgcaatttttttatgtttgatcataatccccaatggtactgcacaagttttacttgaactgtgtggagagcaactgttgagttctccttttaggtatatgcatgatgttctcttatccgttatacaggtaattacctcaagttttataatgctataagggaggcctatccggacattcaaatgatttcaaattgtgatgcttcatcaagaccacttgaccatcctgctgatttatatgacttccatgtaaactactcatcctctggagttctgttatgcagtacttctcattctgtcaccaatgtcaaggtttttcccatttattaaattctaataattcctttttctctaggtctatactgattctaagactttgttttcgatgaagagtgcatttgatagatcatctcgtaatgggcccaaggtatgttgtatacctggactttcattgctgtgtgaaccttttcatttatggagatgcttgtaaaacagcactgtgaatctcccatctttcatttatattttacattaataatccaggacttctcttggtatattcgtaggatgaccttggccatctatgttttaacaacaattcagtaacatccacagttcatctatgtcacgtgtgatgattttttccatgttttggataattttggaatctcattgcttctcttgcttattcacttctatctttacagatgtgctgcctatttatctcttctcatccctattggccattaaatatatttcttcatatatgttttggttgcaggcttttgtcagtgaatatgctgtttggagaagtgatgcaggtagaggaagtctacttgcttcattggcagaagctgctttccttactggactggagaagaataggttatctttccttgaaacaatcttttctttccgggtcgtgtgacagatcacatttgagctttcctgcgtagggctttattaagatctactaacaaatgcaatgagatatttactgtaacttcttgttggttctttgcagtgatgttgttcagatggcaagttatgcaccactgttcgtgaacaacaatgatcaaacgttagttttgatggctccatggtttctttatttgtgtttttgtttatttaacaagtactgtaataatgcttcaatcaaacaatcaggtggaacccagacgccattgtatttaactcctggcaacaatacggaactcctagttactggatgcagactcttttccgtgaatctagcggtgctatgtttcatccaattacaatcacttccagctactctggttctctggcagcatctgcaattacttggcaggattctgaaaatagcttcttaagagtaaaggcaagaaattttgttataaacctactctacatctgtaggagaattgcgtacctcatggattgatcttgaaatctcctgtgcagattataaactttgggtctgatccagtgagcctcacgatctctgcaactgggcttcaggcccgtgttaacgcactgggatcaactgccactgttatcacatccagcaatgtgatggatgagaactcttttagtaacccgaataaggtaagcaaacatttctgatttcttactggatgtaatgcacatatcaatgtctagtagagtttgtggttttggtcatctgaagccaaagctttgctcatgataaccaatgcaggttgttcctgtcaaaagccagctttccaatgcagcagagcagatgcaagtcacgcttgctcctcactctttctcctcattcgatcttgcgcttgcccagtccaaactcgtggcagagatgtgaagcaggaacacaaggttagcgacagaaacacaagaaatacacgagatgtgatatgcgaataccagaatgcagtccatatatgtgcatgtatcttgaagcactactgtatagtgtaatacacaggaaatgatgaataaaattcactccaggcttactttcttcttttcgtttcgtttcttttcttttttttttcttttttttgctttctccatatttgtatcggatgagactagatggcgcattgccaccgtgttgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcatagatgagaactgtgtcagtaaccccggataaggtaagcaactgttttctacttttatctctggatgtaatgcacaagtcaatgtgtggtagaataggtggttttggccatctcaagccatagcttcgatgcaggagcagatgcaagtgtcacttggtcctcattcgatcttggtctgggccggtccaaagtggtggcagagatgtgcagctgcaacgcgcacggggttagcaatagaaatgcttgtgcttattcgtcttcctcgatatatttctgtcgaatgaatcaagatgagcagataaagaagaggaaaatggaagaaaatatgcatgggctggctgtacatttttggctggaacccatgtgaacttgtgaagtgaactagtaacttgttggcaattttagcaagttgactgactctgtctaactaaagcattttccagtagtagatcgtgcaacctcgaataatcattttggatcgtttcgtgtaactcaagtagtgtagttcatgttacactaactgaagcctccatctggcagaggaatttctgtgaaatgaatcaagatgagcagataaagaagaggaaaaaaggaagaaaacatgggctatggctgtacatttttactggaacccatgtgaatgaactactacttgttggcaattttagcgacttactgtatctaactagagcaatttccagcagtagatatcgagcaacctcgaataatcaggttggatcgtgtcgtctaatacactactacaccagctagcagcctagcaagtagtgtagttcatatcaatatatcatactaactcaagcctccctctagcaagtagcaacacaatccaatccattgtcatcgcagtcgcagaatgatgagagtgtggccgccggcgacgacgagcatgctgtccaggcaagccattgtcgtcgtcgtcgtcttcctcgttctgttcttcgtcggcggcggcagcagcagatgcgaagccgagacgttggagacggcgtctctccatgtggattactctgtcgctcgaagaatgccggacactttgttcggcctcttcttcgaggtgagactagctacgtctcttttctttcttttccatttcttctcctgtggatgcttgcttttcttttctttatcaaaatctgcattattattatttgtgcaggagattaaccacgctggaagtggtggcctttgggctgaactcgtcagtaacagaggtaacaccacattatagtactactccctcctttcctaaatatttgacgccgttaatttttttaaatatgtttgactgttcgtcttattcaaaaacttttgtaaaatgtataaaactagacgtatacataaaagtatatttaacaataaatcaaatgataggaaaagaattaacaattacttaaattttttgaataagacgaacggtcaaacatttttaaaaaagtcaacggcgtcaaacattttgggatggaggtagtattttatttggcttccgagctgaaattgaccattaaattaaagaagagagcagtggagtggtatcagccgttggatgtccattcaacggctgattggtcttcaacctccagttcattgacacgatttgtctctctttttatcttctctctatttttttttctctttgagaactcttctctggtgaagttgaacattaaatcaagagttaatttcactttggactatatttttttaaaaaaattattttggatcaccctttgtttccaattttttcactttggactaagtaactttaccttttgttgtataatagatactccaatccacatcttcagcacttcaatgactctgagcaaatcgttaacgatatgctggcgaattttcatacctatacgcatgccatatctttgccaaaggaaacaatagacatggctagcaaatagagttagggtggttcattatgcaacaaaggtaaaagtacctattcaaagtaaagagattgggtatatggtgttgcaaattgaaattttggcgataaaacatggcactaagtttaattcactcttaaattaaagaagaagagagcagtggagtgctgtcagccgttggatggccatccaacggttgatggatcgtcttcaacctccagctcatggctactctctctctctctctctctcctcttgaacgattccctcctgcctcctccctccccgcacctgcacctgcaccatctccggcgtctctcgcggccggatccgccgcctcctcacccaccgcccaaggcctcccctccctgtatacgaagccccgatgaactgctcctccctccacaacccctctataccccgccagatccactccacggccccaccccaacccaatatcctaatccattcgccctctctcgccggggaagaaagccaaaaggaggaggaggaggctcatcggcgcagggatgctcgggattcaccggccagctcgacctcgttttggtgggggtggtgtgtgtgagagtgagtaacgaaggcttgaggttgaagaagcaacatggatggtttggatttgtgatctactgccaagaatatttggggagaaatcaatcacctcatgtatggcaaatgcaaggatttttgaggagaaatcaaccggctgatgtatagcaatgttgaataagaaaacattttcccccctcaataaataaataaataataatatttggagtttaactttaactgattttttgtctaatttcttgctttaggttttgaagctggagccaacacatcaaacattgacccatggtccatcattggagatgaatcctctgttcacgtgacaactgatcgctcatcctgtttcagtcaaaatcctgttgctgtaaggatagaggttgtctgtgacgattgtccagccggtggtgttggaatttacaatccaggattttggggcatggtatgagttctatccatttttataagtgcattcctatatgaataatatgcaaaatagagcttgtaattgaaagtagtatcctttttttttacgacagtttacaataaacagtgctgccacagaaagaaactatagcaaagttatttattctgttcgaaatggtgaagaaaacaaataattaagctaacctattttttgtttgatttcaatttgcatttatcttttccttgcataatgctggttttttatcagattgttgtgcattgctcttggaaaagtgtaatctatagcttttcttcgaaccgttttcattttaccttctcatattttaatgggattttaccttctggttttgtgacgaatatgatcatttcaattttcagaatgtagaagaaggaaaggcatataatctggtcatgcatatcagatcattagaatcggtggagttgacagcttcactcacatgctcaaatggatcgcaaaatcttgcatcaaattctgttcggtatatattttttccgtaacactgagataaaaaaggtttttcaatctctctcgctcgttcgctcgctaaccgaaaggattgtacatcaaatttctgcagagaaactaatttgtcaacttggacaaagatagagctacagttactagctcaagggacatgcagaacttcaagacttgaactaacaactaggaaaaggggagtaatatggcttgatcaggtgtcacttatgccttcagaaacatacaaggtgcactgtcttttacttttttattgctactgtcatcatagcttgatctggaatccggtatcatcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagggccatggttttcgcaaggaactcatgtacatgcttttggacttaaaaccacggtttctacggtttcctggtatttcgaatgttttccaactggcaatcaatttcggttgccctgtaatttaatcgctcgcattacatttggcagggggttgctttgtcgaaggcaattggttaaaaaatgcattcaggtggaaggaaactattggtccatggg

SEQ ID NO: 32474 - DNA, 4528 bp, Oryza sativa
cacaaaccaacgaactgctcagggttttttatcttgtaattagggatgagtcaccatgatgcagttaatggaactatgctcgcaccttttataaaggtatgttttcgatgccctacattttttgaagtatggatgagatgaagatggacttctcatgatgtaacagaaaacagttgtaacatgtgaatattaacataaggccttgcatttattgtgatcccatgtttcttatttcgagatgctttgattttcttgctacaggatgcaactgacagtcttgagtttgcaaaggggagtgacaaatcaacatggggctctgttagagccacgatggggcaccctgaaccattcccactgaagtatgttgcactagggaatgaagattgtgctccattcaagctgatataccgaggtaaattttgcataataaacaaatagtattgtccttcgtgttaatgctgcgatgattggctaaattcatcattctgttttttatcgatctgcaagggtaatagcactattttatttaacttcaccctttttagtactatctgattgcataatggagatattttggagaaataatagatgaaaaaattggctgcatgccttgtggcagaggccagggatgtaaaatatttccattataaaaaaaataatagatgaaaagaaaaacaagaagttaatttaccagtctgctgttatgtttcgaaacagactttaccagtttctagaaggttcattagttttacatttgattgaggccaaattggctacgacgtataatgctgtttcagtacatttaaatgggctactactatcataaatatcctaattttcccttgatatcatataaccatgtaattctgttgaacagaaaattatcccaagttctacaacgccataaaagaggcttatcctgacatccaaataatttcaaactgtgatggctcgtctgggccacttgatcatcctgccgatctctatgactaccatgtaaacaactcactgagactaatttatttctatcattctccctatttttaaattctgtcttgctggtttttttcagacttggttatgtgatcattttctccatagatttctgagaatgttacatttattctgtagatatatgaaaatgcatccactgtgtttttcaagaagaatgaatttgataggacatcacgtaatggtccaaaggtaatgaatttgatataaagtggcttcttttgggaaattaagttcttttttttattttttttagagaagggtattttttacccggcctctacatccaaccggatatatgcggccattgaaatagggaacttagccccacaaacaacccaatctgaaattcgctccataggagatttgaactcaggaccttgggtactaggagattcgctccataggaaattaagttcttagattagatcagtcttacaaaggcagcttctctcatgcgccattatcctcgacattttcttgaatgaaatatgcttctagttatttcgaaaaaaaagtgtttctaggtattagtttcttccatcttcttccatgactgagactgaatctataagatcagaatatatgataacttgaataatatcccaaactagagcaatctactagtacttcataacttgaactccagatcgcttctagagcaatctgctgtggtattgattgacaacaagcatagttagtaattatgacaacaagcatgttcttcttcttctcttccttttcccatgagaagaagcctaactatcgaatagcaaaacgtaagacgctgttcttccttttcccatgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtcccttagtgtaatcttttgcttttgggaggttgctccggtgacaacttccattacttcgacagcttcttgttgaagttataactttgtatatttgtatatattcttcaatcttaagtaaatttggttggcctttcttggccggcccggcaatttattcatctcattaccctttgatgttggatagacagaatataagtgagcaggaaccactgactatgcaattgtttcactgcaggtatttgtaagtgagtatgctgttaatggtgaggatgctggcaatggaagccttcttgcatcattggcagaagctgctttcctaattggtttagagaaaaataggtgatccctctggggatctctcttaattctttatcttgggttcagagtaaatataaaatcatgcgcagagttgtctacttgtatccagaccatgcatgaatataagagatcgttcaatgggattcctggataaattgttgatttttgtttgacaactactacctcatctttgtacttctccacaaggaaaatattttgagtaaatgtataatttgtaaaaatttacattgagcaacagtaattccttattgcaagttattgaattggctctcatcatgcatgcttctttgcagtgatgtcgttcagatggcatgttatgcaccactcttcgtgaatgacaacgatcgcgtgttagtatacatggtcttatactttctttgttcaaggattctagcatctgtttcctctctgactattgctaatgtataaatgtgataaccagctggaacccagatgcgattgtcttcaactcctggcaacagtatggaactcctagttattggatgcagacatatttccgtgaatcaagcggtgctatgattcatccaattatgatcagttccagctactctgatttattggctgcctctgcaatcacctggcaagacgctgagaatacctttctgagagtgaaggtaaaccatccattccagtttcttctaaacttatatgcatttggttcaattcattagacatgcgccttattgtttggaatgatttagttacaacgatacaaaattgattcagccaatgcatacttgcataacatgcatctgtctttatatgtattactgctggagtaatatgtttggatcttagaacatcctgatcttcaaatgatcttccacagatagtaaacttcgggccaaatgctgtgaacctcacaatatcttcaagtggacttcaagctggtgtagatacggcaaaatcaactgtgactgttctcacatccagcaacttgctggatgaaaattcatttagtgaaccaaacaaggtatgaccaattttgctttgatcagtaattattggtttcagactttcattactatgcacagaatttagaagagggtaacttctccattacaaaaatctggtctgttacaattagacatgcaggtggtatgcctcgcatttgtcaagtagtgcgtgctacataaacacctttgtagatatatccctactctgccttttattttgtcatgtctggattatttccttgtctttctaaagaacacagagaatctattgtaacacacgatatctcagggtacgcaagttggtctaacatacaagtttcttgtgaacacgcattgcaggtcgtgccagttgccagcgagttgccgaatgcagcagaacagatgcaagtcttacattttccttactcaatttgttcgtttgatcttgctctggtttagccgtttaattagcacaagtttatcaggctaacatgttgggacgctgtttctgtccttaatgacatcccaggatttcatagtgatcaaaagctaattattccactgtatcagagcccattaggccaaggatggttttaattaaagcttagtttgaacaactcgctttatttataatatatccctttattgcttctaagaaatcatcgagttgtttgtttggatattagtaatgatatgaattattaagttgaccagataaaaatgtaaatgcatcaaaaaggaacttggtatcaatgagatcacgtctcctttttgtttgatagccatggatatgatgtttctataatatggggatggtgatgagtctctcttttgttttcttgcggtaatgcagctctgttaatttctctattacggtttggcaagatggccggtgtctccggatgtgattttttttgagtaaatttcactttggacctgttttattgaccaaagtttcaccatgaactatgtctaactcgaccttttcagttaacaccaggtatgattaccttcttttgcaatttggaccgggttttaagacttcgggccaccacgctggcttgatctgagcctagtgaactcagttcagggaagagaaattatcgacggaaactagcgcatgggagaggaagatagtgccgtggaggcgcggaggcggattttctcaacgcctcggtctccaccctcaccactggtggctcctgcgcctgcggagcggcacgatgcggcggcggcgtggcactacgcggcggccgtgtgcacgtctctggct

SEQ ID NO: 32475 - DNA, 2981 bp, Oryza sativa
gatcaaggcattgagcaagtccccctccacgacactatcttcctcctttcccgtgcgctagtctccctcgataactctctgccctgaactgagttcaccagctcaagccaacgtgctggcccaaaagtattggtacccggtccaaactatataagaaggtaatcatacctggtgctaactgaaaaagtagagttagacttggttcatggtaaaactttggccaaaaaatcaggcccaaagtgaaatttactctttttttttttgataaaatgtaacttccattacccagctctcgggagaaagccaaacaggaataaacagggtgttatacaaagctcataaactaaccaagagcattcatctccggtaacggacacgctacagcgctaatatgttgttgcctcccatgcggcgcagtccacaccaaaacgaccagacctctaaccccacaaaagaaagagtttagacctaatagggacggtaacaacttgctaggtaatttggctctcaagaaatgatgtggtttttataggaaaactgtttcttctcctttgcaggttattttcttaattacacattggctctacattggctctgatcatgggttattctcgagaagcccaatttgtagggttttgtcacttcgacttgtctatatttaaagcaagtgtcaatgagttttatacctcggtatataggtgacgacctattatttgggttgtagccttgtagggtcttgatcttgcaagctgtttttttctcttcttttgagtgtgttggctgtgtgcactatcgtagtgcagaggctgggagtgttatcaaaacttttgagtgaaatcaataaagcttccattatcttaaaaagaaagaacccaacagactgacacatactaatcccagcaaaaacttttgagtgagatcaataaagcttccattatcttaaaaagaaagaacccaacagattgacacataataatcccagcagaaaggaaactacgatatactccctccatcccataaaaagaggattcctagcatcccaaggcaaatttagtgagaagtaaaatgactaaaatgaccctcatcaatagaaaaggtagtactggtgataggtaggtaaagattatttaagagataaaacttctcgttttatgtgttgaagataggtaggatggtagaagttggttttttgtgggataaaatttaaactctagaagttaagttttttttttgggatggagagagtatcaggcaaggtctccggttcctgcagcttgtccatcagctccttatgccacttgtctgggcaatctccttccatttgtagcagtttccatctttgcacccacgccagggctttgtagactacctgcaaaggtgatttagcaattttattttcaaaaacccactcatttctatttaaccaaatcccccaacagaaccaagcaacgaacacaattgtgaggtttgtttttagtttcttctttagcatcctcaagccatcctcaaaatcatttggtatttctgacagacccagagtttctctcaacacacaccatctaaatttggcaacagagaaattaacgggatatcgattctacagatccgatatctgatatcggaatcattgattggagatgatcgatcaggtcattgaatgccatgcaaaatgctgtacttatgtaattgacacgcaagggcatccagaaaaccatctcattcaacatcatcttacagagaaggtccaagatcaaatccacaaccacaatggcgtcatcctccaatgttaacaatggcgtcagtgttctcttcctcttcgctgttctcctaattgctgcgtctcagctcgccgccggcaccaactcgttcctgtacggtgcatgcaaaccatcgccggcggcagcgagctcctcagcgtcacgttctgcatcgacgcgctcagctccgacaaccggagcagcaacatcagcagctacaaggaattcgcggtgatcggcgtcgaccttcttacgggcaacgcgacgagcaccaagtctgagatagacggcaagctccggaacggcagcggcgacgccgctgcgaaccggtgcctctagtcatgccagtcggtgtacggcggcatactgtaatctcaggccgccgtcggcgcgacggtgaaggcaggcatgttccaggaggcgatctcatcgctggagaaatcggcgagcgcggtgaaggaatgccaggacgggttcggcagagcaatgtgacgtcgccgctctccgcggagaacgacgatgccttccagcttgccgagctcatcgttttgctcatccgtgacgaacagatcaacaatgtttcgccttaattgctttttttataagggcagtcccaacccataacactggatatggtttccatagaaactagtactagacactactcttccaatgcaaacaccactattccatacttcaatttaatgctactttatctcacatgatgtcttagatgttgtgtagaaaccatgtctcgtgtaagacatggtttccttctctttcctcatttattcacttgccacatcattttttttcctaggtgacaacttatttaatgctatggacaccatcctagtcattgggttgggaatgccctaatgcatgttttccccgggttctcaataatatagggggctgtttacttcccaaaacaaaaacttttcacccaccacatcaaatgtttggacatgtgtatggagtattaaatgtggaaaagaaaaactaattacacagtttgtgtgcaaattacgagacgaatattttaagcctaattgcgccatgatttgacaatgtggtgctacagtaaatatttgctaatgtcggcttaattaggcttaataaattcgtctcgcagtttcctggcggaatctgtaatttgttttgtcaatacttcaaatgtgtgtccgtatatgtgtatgacaaccaaacctaaaaatttttccc

SEQ ID NO: 32476 - DNA, 8630 bp, Oryza sativa
aattgtttgatattaggtcacgttttttttttatcaaaagcttccatagtcaatgttcaatgaatttggtggaagtataattcaatggtgcaaatttcgtattcatttatttgatgtacaatacttattttgcccttgtttttagaccctatttttagggttttgttttccctccttttttaaaaaaacgaaaccaagttttgctctattttagatgaacaagttaacgatgttaaattttggcaaaaagacattcataccttattattgcccatattttatacatgcaacttgcaattttgaaaaactacaatttcaacaaaaaaaatgtttcaaaacttacattcttttgccacatttgataattttgggcacaattttacgctactaaaaatttgggcacaattttttttacacagttatgaccacctttacgcaccgagccctcaccgcctccctgtaagttcaagtgccttaatttggtttcggtgattaatgacaaatctaattatatgagactaacgtttttatgagtctttctttgactagtattatttggatataaaagtaaaaatgatgggaggtatgtattaaacttcacatattctaacttggtctctcttgtggatccaaaatatagtgtgagctccctcattgatcttgattgattatgtgcatatgcattccttcatatccatatgtatgcacatcttgagggggagcttattctatattttgttcattataagatctctaccttgatttgaaattatctttcatctcatctctttgtattgtttatatcggattattatctatcacagaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattctttggtgatggaccttaatcatgacaagaatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaagatatgtgtttttttgtttatcttcatcattactacatatgccttctctatgtgtataggataaacccccattggttcttctttacttatgcatacacttgtctctcttgtatatttctttgtatgcatatacttagggggagcaaatcctatacatttattgtgcatgttttagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttaagactaatgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttagtgtttggtgtagaccggatttgctagataggcgccgtactatcaagaggggtctatgaagcgagcttgtggatgatcttgtgccatattagttcatatgcatgtaggtgtatttggtgggcttgtctagccaagtgtggtgagttttttcaagtcctaaacaaagagagatgtgggcaaatcctataggtttgggcagcctcatgtggttatgtccggtggagtatcctttagagtgtgagccctttctccctgagaaaagttgtgtttcttggatggattgttcatgggttggatagccctttgaataagctttccataaagtccaagaacgccaaattccgagacccgagtcaagagatatcgtcgttttactaacgttcggttgagctgaaaagtgacatgcgatatgaccgtgggccttaggccggtctgaccgggcctgttagcaggtctgaccgacgtggtaaggccggtctgaccagccccactggtctgttgcactggtctggtttttggtggcgatacagagccgctagagctgcaaccggtcagaccgagccgacggcggtctgaccgagccgtggacggtctgaccggccactacactgcggtcagaccggccaggttgagtgggctcaatgattgccctgtaacggctagttttctagccattacaaagtagtccggtctgaccggcctcacaacggcggtctgaccgacagagcacaaagttggggatttcggttccaacggttagttttggtggttaggggtatatatacccactccccagcagcaagggtgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccacgtgcgctcgctgccgctgacaagtggggcccacctatcaggcctgtcgtctacctccggccggccgccggccgaaccctagcgccgcgccgccgtcgtctctttccaaattcggccgccccttttcttttccggtgaaatcaatagaggggaaatgatcttcgggatctcctctaccttttctcttttggaatcgtcggcttaaatcgtttggaaatctgtggattcgatctcgaatcggattcgtctctctccccgaaccctagaccttccttcgccgtcgccggtcgccgtgggccttcgccgccgcctccttgcccctataaaaggacccccaagcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgtcggagcaccgccgtcgtcgtcaagccgaaggttgccgccgcttcttcctcgacgccgtcgccgtccgttgatcttccgccgccgttttggtcaccggtgagttcgccgcgtcattctctacgtgctggtgccctccgttcgcgtcgtcgcgccgtcgttcgccggcgagcttgtgcgcccgagccgctgccggtggtgacgtcaccgctgacgtcatcgttgccgtccgtcgtggtccggccgtggacggttgatctcggccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagatcccaaacaaccctttgaacatgtttatcccgtttaaagctattgtttctattcaactattgcatttattttcgaatgccattgggtggaattaacctattgtttgttatagtccttttgttcttgattactttattccttgataccttggattattataacttgactagttgagctttatatattggttcagctagatattagatatgattgcttagccatgcttagaaatattagcacacaattgggataactaatgtttcactattacttaatgatggatatttaatgatagctcatgatggttaatcatgattggttaattaattaaattgccaactaaaacttgataatggtgggttgtgagcacatggttttgagagtcgtgctcatgacaatttaggaccggttcacgagtttcggttgtgaaacattaaccgtgccaaccacaagccagcgtgggcaacggctttaccttttgtatagcatggttcattgcggagcaccagactgagaagtggcggagataagcccatgggggtcgctggggagtctatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgtgcacttgcatatttgctacgtggcttgctgagtatgtcatatactcaccttgcaatcattcatcagaggaggagttctacagtgatgctgatggtgtggatgattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagggtaaggttttggcactccattgcattatcttgaacccttgcaagagctctcacacccttgtgcacttagtttatctagtgaggtgttagagagtgagttaagccaatccaagtgcattgcttcattgttttagctagtgtggcacttgatcatcctcggcaagcatcctagacttgttactcttggaggttgccgcctcctagacggcttgtataggtgttgcccggtgacctctccgagaagattgtggaggaggcccggcaccgtttgtgagtggtttggagttcaccaccttcggagtgaaggaagaactaccccgagtgatcgaggcttggatagtcctctccgtgggtcggctcccgccttgcccaccccttgacgaagggggcgtgcggtggcttcgtgattgagcggtggagttgggctcgcctcaacggggattaggaaaccggcgagtttccgaacctcggtgaaaaatttcttgtctcttgtctcatttatttgttgtatttacatttgtgctatttacattcatagagacatatttgagcctataacacataggtttgcaaaacttaacttagttgcttagttaaccttgtaccttaccttgcctagcaacttaggttagttttgtttaagtgccattaaattttaaaaccgcctattcacccccctctagtcggcctgcttgatcctacactccctgcgctgagtcgctattgcatcgcctactcatagcagccaccccgcgccgaatcgccgtcgcttgccctactcgccatcacctccccacaccaagccgccgccatctcatcgcactgacctgccgtcttcctgcgttgaactctagctaggccactgactcctccttatgcagagtcgtcaccaccgtcacccctccctacaaggagccgccgccgcctagccaggctatcaccgattcctcctccctgtgaggagctgccactgccattgcctggttgggccaccactgtcgcctcctccctacaaggagcagctgcctggctgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttgtggtaacttccattcgaaattaatttactagctgaatttgattgcattaattacgaactctatacttatacaagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgaccaatagagggagcggtaactattctctcaacgaaatgtgcaaaggaattgatttccttccagtagcacagaaggaatttatccatacaaatatcatcatagagaaaagcagtacaaaatgatacacattgccatcagctgctataagagcttgaatatatagatgaaagtatggttatactatttctgcagccaaaataaaaaccttaatgataccaacacaaaatacaatggaattgtggaataaaaatatgcggcaactttaaaacagccatctactcctggtgacaaacagccatctacatctggagtatgtagcaagagacgagtatgatcacgagtttactttgtctgtacagcacagataagtgacacctggtgagcaatgccatcgggtgaacacagaagtcagcagctgacttcatttagatgttaacattttagtggtaataaaataaagagctcattttgattcctgcatcctgaagtttttgcccatgttctatcgccactgtcccttggtgagacaaatgaaaacaatggaaggttaataatctggaatagatgcaaaggtataccctggtgctcctctcgaggaatagtaagcaactcgagtctcataaaaacctacaaaacaatgtcagaacaatataatccttctcgctaaatggatacaatagtagagatgtctgtctactatctacaataataac

SEQ ID NO: 32477 - DNA, 4179 bp, Oryza sativa
caggaagagaagcgaacatcctaggaggaggaggaatagtgccagggcaattgacttccacgggattttcctgagggattttggggtgtaagtgaaccgaaggtcaacatcatcagtaagattgctgtcatccctgtcctctgtaggaaggggagcatacccccgaacattgcgtctagacgccatagtgcagtgtctgcatttgaaacacatactgtaaaatacatgtagaaaatgacatggtaatacacagtaagatctaagagttcaattgacaaagaaaagttgaaatccacagttgctgctaatgataataaaaaattacaagctttgaaaaaataaggtgcaccaaacagtaacagagatgatatgacaaacaaaactaaggttgtggttgccgtcgcatgtgccatgccaagggccttaatggactgcatgtgacatgggcatcacaaatttcatgtgaatcattctcagaaaagaactaatagtttttatagaatgattagcaaaatataagaaaaaattttctgtaatgcgacatgtaatttgaagccaactcaaagaacagaatcaaagacaagaacaggatggcataccagacagattttttctctaggttgttgcatatatcaaataaaaccttatgcaacaagatgcgtattaaaagctttgatcatctacaatcatctgcacgaactaaggctaaaatgagcaatctattctacaggataacaatcagaaaatatgggctaaacaagacacatctaccctgacctccgaacacaagtactaacaaaatatggagtacattagtaccttgatgtgcaaattagttagaatctgaaatagtactaacaaaacatgaatacctcagatttttatatctgaaaaaacacctcaaaatatactagtctttagaacctttccaaaactgtatcttagttctgtatactcctacattatagccaagaaaatcataccagcagcctactgttagtaagaatcaccaatctgagcctttatatgtctcctagctctgaaccagatctatagaagagggaaaacgaattacaggcaagtcagcaaaactggtccgagtggtaaacaaatcacagaaagaaatcagaagagacaggggtggcaacaccaacgcttgtctcaggaaaggattgaaggaacgaggaggtctgggggaaatagaagaggaacaggcgaggacgagagcacgtctggagactggagtgacgtgtcctctcccttgatcctgatttccttcggtagccatactgttggcccgattggacctttattatcatgcatatagaggtaccatctatgggcttggagcccctaactaatgggggtccagatcggtcgtccttactgacctgcctcagggccagccctgtgaacttcacaagtttataaacatcgagcagcaaaatatcatttaattaacataaaaaaaaggaaaaccctacaataacttataattctccaggtaaggaccttctgaccccttccccccctctttttttttgtttcttttttgcaagtagcagggcagaatgtgatagaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctggctaacagtacagtgttctaggcttaattttggcaaaaaaaaaaaaggaaagaaaagaaaaaaaaacacagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaactatgctttgagcaacaaattatattgtacatttggcatcatatcagcttgtcgtggggcaaggaaaacatacaaaatcttgtaatttcacaggcaaaatgttcattctctagttcgttcagacagaaaggtgttaaattcaatcgtaatgtcatacctaatatcaacaaggcaatatcacaagaaacctctcaaacgaatttctatatgagggatgtccagcaatcaaatgccataaacgaatttttgttacctttttttcctagatggagatgtccctcggtgatgaaggggagaaaggagacaaactgtcgacgaccgaggccaccgtgcgatggggtggtgggaggccggattcaggaggtggtggcagccgcggaggactcggtggcggcgcgcaggcggccgtcgaggtggagatcggtcgcggcgcggaggagggcgaggggagcggcggatcgggggtggggaaacgcgataggcagggggattggggatttttttttttttactatttgacatctttccaatgccacgctcccaaatgccatcttccaaaaaattgtagctgaattgccattgggcccccacattagttgatttcctaccattttgggtccattcttgacgccacatcagcagccacctcatgacactttaagaaaatgacaatgatacccctacccgttcagtacaaatttaacacagctcacagcaaataaaatgaaaccaacttcaatgcacaacaatttcacaagcaaacacagcttggacatacaacaaaacttgcaattgggtggagccatggctccctcaaatctttctgaaaaccaaaccctagacagatcaatctaaaaaaagaagcaaagatcatgaaaaaaattgatgccaaatcaaagagggaaatacaaaggatctgttcttttacttgggattgtatcattgtttggccaccgccagcggagtcgcctagagcagggagtgacgcgaagtcagacgaggaggagcgatgcgaagcctggagaaagtagcgatgcaaatattagagtttttctcccactccctatacgtaagggcaaaatagggatttcgccccatccaatgctgatttgacataaaaaggaaaaaaatggctgagaatcaactaatatatggacccggtggcaatttatctagaatttttgggaagatggcatttgggagtgtggcatcggggaagatggcaaatagtcaaaaatcccgggggattgagggtggccacctttttttccccctttttttatggtatagaattcatctggagtatttctgctctattccgcattagaactccctcggctggaaaatataatatatgcgcattttactacctccatttcaaattataaaatattttgactttggtcaaagttaaactgcttcaagtttgactacgttcgtagaaaaatacaataacatttttaacccaagacaaatttaatatgaaaatatatttaattactgatttaatgaaactaatttggtattataaatattactatgtttttccataaacttagtcaaacttgaagtagtttgactttaaccaaagtcaaaacgtcttgtaacctgaaacggagggagtagttttttctagactaatcatggattttagtttttattaaaattacgccaaaacatgtagatatatagtacatgtggtgacgctatattcgtatttcatatgaagttaattttataatatattgatataaactatcaaagaaattaatgatcaaagttatcaaaggccatgtcaaaaactaaaatgacttatattcctcatcgaagggagtgcatactacgtaatcatgtacttcactgtatggtctttctttctttgcaaatccatataacttaggtggtgtttggatccagggacttaactttagtccctatatttagacactaatttagagtattaaatatagactacttacaaaactaattatataaatgaaagctaattcgcgagacaaattttttaagcctaattaatccataattagagaatgtttac

SEQ ID NO: 32478 - DNA, 14250 bp, Oryza sativa
  unsure (1)..(14250): unsure at all n locations
taaaaagttttagtcccatctatacagggccttaacctccttgatccttgtttatttcaaaattaaaggacatgacaaagggatatgctaagaaaaaaaaagactatgtgtatataaacattgtctcttgatatcagtgttcctcattgagtaacaaagcgccaagcttggcgagctcaaagctgtcgtggttctctgtggtgagcaatgacttgacattactcttcccgaaccctttctcgcattcctccaccatgttggctgccttctccaacgccgacatcgcctccggaaacctgccagcctgcacgttgtagaagatgccaagctgaccctgtagcacgctggcgtatgctgcctggcacgactggaagcacaccgtcgtggcgtcgccgggtttcaagccgttgccgtcgtccttaaggatgttgtctatcttggccttggtgctcgtcgtgttggatgtcaggaggtcgatggcgatgatggcgaggtcactgtagtagctggcgctgaggctccggctgtcggaaccgagcgcgtccatgcagaacgtgacgctgatgacgccgctgctgctgccagcgacgatcttgcatgcgccggacatgaaagagtcagcgttggcggcgtgttgagcttgagacgccgcgacgagggcgacggcgaagaggaagaatgcattgacgatgccatgggaggagaccattgtgaaacctcgatcgatctgcaagatgatgtcgaatggtttttttggatgaatacttttgtggccttgcgtgtgaactatttatggacaggttttgcatggtgttaaaaacgaacagatcgtctccagttaataattagatagagtagatccgtaaaatcaattattgattccccgtaaatctctgaccaaatatggctgaggcatatacaatgacaatcattagcatgttttgaagttattaataagatgattttacttacataaaaaagagaagacagagaaatatatttgttacttgtgacaacgacagacttttagtgtttctaaaataacatttgtcgcatgagaatcgataaaagaaaagaaagataataaaaaaatagttttggtgtattaattgttagagtagtattttaccatctctactgctgttgtaaattgtaataagatagtctctaaatgaactaagaacctatactagctttaactttaatcatgcctaataaaacatccttaccgttgcatagagttgatgatttttttttatatgctgtaccatcaataattaagctcgtaaaactatactatatatgcctccgattcatttgatgttaataaaaagactgacagttgctagtttcctataacatgttctactctcacatcatttcagggaagctggaggtctggagcatatatatatagaagcagacaagagagccaacggtttgaatcaacgatgagattgagatatctcgcactgactgaactgcattccatgcaggtgacggcggatcaatccctaattagctgtggaatcagaaaatcgattgatatatagctcgagtttcagtcattatctttaaaaaaattatcaagtttcagtaatctatactcgagatatatctgtgctggactctatcgtcttgattattgaccgcacgatcatgatcaactggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagccgtcgcagcgcctgccgtgcctcggataccccattctaccggccgaacgcctccggcaagccattgtgttgcgctcgggcagcaaacaccacgagacttatggcgctcactatgtatctcgagataaaattcgatacctctagatactaagtatctcgagatacatctagatatcagtgtaaaattttctagttaaaatctaattcctatgtatactaagtatctcgagataagaaaaaggtgtaaaatttaggtgctaagatatcttctcaaggatcgtaaaatttcacttgttttagagatgtcggtacatgatgattacaagcatgcatgatgcatatcatattttactataaagttaatgctcaataactgctaaatcatttttttttgaaaaccgaagccagcttaagctggagttatattaaggaggagagaaagtatttacaatatcaccaagaaggtgaaagaaattagagggggcgaggaaaaaaaacctaaatagagctacacattgaacaaaaacctaagtggatattctcgcgatgtcttttgctccacacatgctccatagcttgatttcgtcttgtattttggcaagtagctgcagcattgttttttcttgacttcgaaacaccctcctgttatgttcacaccatatttcccatgccaccaacaagtggattgacttgagtgctttagccttgctttttccaacttgagatgttcttttaatccaccattccaaccgagcttcattttcatcatgtgggtggtctatggcgtggcagtataggctacttaaaaccctctcccaaatctgacgcacgaaagtgcaatttttgaaaagatgttgggcggtttcaaggttcctatagcatagttggcaaagtagttgtttggccattgtctgacctgtagcctgtccgctgtccaaatcctattttgtaataggacccatgcaaaatgttggcatttggaaggtgcccaatgcttccaaatcagttttgctgcagctgagcttattctgccattgaactgtgctatgtaggctgactttgcactgtactttccatttctcgtccatctccaagttatggtgtcctcaacaccttctgtaggaacaatgtcttccacacatggtagaacacctcaaagaattcattgacaagctcgactgtgaggctgtgcctgatgtctattatccattggtcatttgctaacccttcttggaccgttctacctttccttttggcatggttgtataaggccggggctaactccttcagtggttgttctccaatccaatttgattcccaaaagctcgctttccgaccatcacctatagtcaccttggttggagaagcaaaaagcttttttgtccatttcatcacaagtagggggtgtccctgcccaaggcttgttcgggctttcccaactgaaccatagccatcacactctcaatgctcgtgcaaatttctctaaatccaagactcctagtcccccaaatttggtgggtgaacataccgttggccaatttactttgcatttgcccccactaatctcttggtcgcctgcccaaaggaacctcttcctaattttgtccatgtcatgtaggaaatttttggggggttttagtgctgtgaggaagtatgttggtatagaggttagtaccgaagtgacaggggtcttccttcctgcctgttgcaacaacttccctttccaacctgcaagtcgggatccgagcttgtccatgactggttggaggtgcactctcttgattcttcccattgtcaaaggtaaatctcagcatccaagtgtgtcacctcatcatccactttaagttttattatttattgctttggtcaggtgtgatgtaatatgcattagtacatttgcttgtacattcttctttattgcattatattgtttgttacaacaatgtgtgcatttatgtcatttcgtaaaattcagcagattatgtatggaaggggacaaataatataatgtactcgcacatggaaatcatccagctggtacatgaagagaacaaacaaaatggagacacaaaaagtgagatattggttaagccattgttggatgcacttaatacaggcaaatagagtatgcatacattaagaatgtctttgccatttctgagtgcataattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacggaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgatagattcgtcttcatttcactttttatgaaccttcaaacctttgttagctgatcatcaaattcatcaatatatgtatgatgatggggaatcttcccctgttcctctaaaaaaaaatcttgtttgacggagattctgtgggattccactaaactttacatgggttcagtagtgactgcggacgatctttggagttccctttgttagtgtttggtagcggacttctgttgcggcagctgcagtttcaattttctagtaggtctaatccaatgatgcatactgttttctgttaaatttcttgctgtttaacaactcaatcgattccgtactcttctttttactgctccttttcttactctatatttctatatgactactagcgaagtagcaatggtctgaattacagtttttactgacctactgttgttcggcaggcaggaccgagggcatgggttccaaagatgcattcttttgcaccttctgctccttgcttcttttttgtttcagttccaaatgcctatcttcagagctggacctgcctcagacagcactagtagaggttgatgcttcatgggaggtttcacgaaagatccctgacacactatttggattattttttgaggtcagattttgcctatttagctctgtcagttcatcttatcgcgtcactttctctgccggcatcaaaatatgttaggatgagatcaataatttagtcaaccttacctaactgctgcagctagtcttttcagttgaatttaccattgttcacactacactgcactgtattaactatggtggttcttcatatatcttcatgcaaatcttctttctggtttcagaaaataactcctatgttgtacatgttttctcattccactgtttccttttccaccactattttgtgtggatgccggtgttataattttgtctgcattacttctagtcagggaaagaggagggattggggtgtgtgtgcgcgcgaagatttcttttgttagcgcttgctttatattcattatgtgttcactgcaatctgaatattctagattatgctcgtcagtcatgataactagatcagtgaacattataggaaattaaccatgctggagctggtgggatatgggcggagcttgtcagtaacagaagtaactctcagtttgataaacattcctcatggaagctgtgagaagtgaatggatgcacttgactaagttgaagatttgttatttacacaaaaatagataaatcagtccaaatatcaagcagtgaatcagtttcttgcactgcgcacatgtcaaaaagacacattgcaggttttgctgtataagaaatattcttatgttcacatacatccaatagtcaatgaaggaaattaaagtgtaaagtgacatttttgtgcaagtgatacacaatgctattttacaagaacaatatagaactccttgtcaacattcgcaactgcagccctttgcaatgctcaagtttattcatgagaaaaaaaatcaacccttgtcaaatgcatttactatatttatcctcattcatattaataactgacatcaggttgcttaatttctattccatattttggcttctaagttgctacagaacagaaaagattacagttctgaattaaaaccaaatgaaacaaaagcatctgtgttttataatttgtcatcaacattgaagtcttgctttaactgactaatgcatggattatactccaggatttgaatctggagggccccacaccccttctaacatcgatccatggtctatcattggagatgaatcctctatatacatcacaactgatcgctcatcttgtttcagcaaaaatagtgtcgctctaaggatggagattctctgtgagaattgtccagctggcggtgttggcatttacaacccaggattctggggcatggtatgagtccttatcgatgtaaaataactcattgtccaaataatcttttttctaaacaacagttactgtacaatgctgtcacttaaaggaaatacagcaaagttgtgatcttttttccaaaaagttaaactaatagctaacgttacctatattttgcttgatttcattttatgctcatttttctgacataatgttgtctttctatgcaatagttctgttttttttacttggaaatatgaatatctgttatagtttttcttccgaccatttctacttttatcttctgatatatatatatatatatatatatatttatttatttatttatttgcttgggattttaccatctgatttttggatgaacctgttcgttccaacttccagaacatagaagaaggaaagacctataatctagtcatgtatatcagatcattagaatctgtggagttgacagcttctctcacatgttcagatggaatgcaaaatctggcatcagtctctatacagtatgtatctttgacataacactgaaataaataattcttgatgtgtttttcttttatgattgaaaggattgcatattgaaatgttgcagagagattgatccgtcaaattggacaaagatagagatgcaattattggctcaaggaacatgcagaacttcaagacttgaattaacaagtatgaaaaggggagtaatttggtttgatcaagtgtcactcatgccatcagacacatacaaggttcactgcattttcatcctgctattggctactgacagtcatgagcatgctttgctatgggagtagccagtgaatattcatccactgctttgtgatgcaactaatgtactagcagaattataagttattcataaatgcgtaggaaacatgttgattcaatctcattgttaattagtgatacttaataaatctacttatattcattttcacaaaactttggaaaaaaaaagtcctcatttgtttattgctagaccatgcttattagtttccgcatttgttaacgggaaatttcttatatatgtacagggccatggttttcgtaaggagctaatatacatgcttttggaattaaggccacagtttctacgctttcctggtatttcttatgttcccaaaaatcatattttaactagaattagaccaaaatgaacatttagataactaaaactaaacctgaacatgcatacaatcataagaattttatgatttttgccgggtaatatgaattaatagtgataatatattgtatttactgtgtgattctattttgtggttatgcatgctttgcaagaggacttctaaaccaattctgggatactaacaagcataaataattaagaaataatactctagagtaaagcatcaaaaagttgtggtcaattagtacgaaaccagcatgattgtagatttatctatatttgcattatatatggttccatgatttcagcaactaacttttgaacaattctacacatatattgagtcaaaattttgtatcacaattatgacagggggggtgctttgttgaaggtgattggttaagaaatgctttcaggtggagagaaactattggtccatgggaacagagacctgggcactttggagatgtttagaattattggaccgatgatggcctaggatattatgagtttctccaggtatatgttgattaatgcaatctgagttttttttatctcttctgctaccaacatatctaaccaaatatttctaccgaaattttcatggaaagcttgctgaagacctgggtgctgcccctatttgggtgttcaatgttggtaatacattctaattatttaaaattttcctgttttaccatatcttttctcatcgctagcatgcccattaccagcttacaattttaccttgaaatttagggatcagccaccatgatgaagttgataccatcataattgaaccttttgttaaggtacgttaaatgccaaaagtaagaatagtcatccaaatagaactgggtagaggattactccggtttgacttttccttattgcagatgccatcgtagcaaaacaaaatgttttctatgcatttgtcattctttaagttcattattttttttctatttataggatgtattggatagtcttgaatttgcaaggggaagcgcagaatcaacatggggctctgttagatctgcaatggggcatcccgaacggttcccactgaagtatgttgctattggaaatgaagattgtgggaaggaattttaccgaggtatatttttattaatcagaatttgacatactactgatcccatttgttgtcaatgccatagttgttttccttaggttggtacatctataggctgaaatggtgtgatggccaagtgtacttaacacaaaatccctcatcatatatgaatgcatatctaaaaccacttattttccttcttctttaccccttgtttttctttgtttgtatgccgtcgttactttgtggagtcaactacaattatggcaaaacaatttcatccttacagataagcataataaaaatataaacattcgcaacaaataatagatgaaaatagaatggatgtaactttgagctatttatgtcatcagtttctgaggatagattttctttgcacatgaagttactataacattcactaatttcatgaaaataccagagagctagccaatagtatcccacttgtccccgagttgcccatgatggttttgaatcctatcttacaggaaattacctcaagttttatgatgctatacgcaaggcctatccagacattcaaatgatttcaaactgtgatggatcatctaggccgcttgaccatcctgctgatttgtacgattttcatgtaatcttcattccattttcactgtttaaatactgtctcattacttctaacagacttttcattgtgcttttattaagatgcactctgacatattttttcaggtatataccagtgctgctaatctttttatcatgaagaataagtttgacaggacatcacgcattgggcctaaggtatttttcagtccttgtttggatggtcagggatccgtggccatcacggcccatccaaaatatggactttgtttttgtgatttattctggcaatagatatatcctcgaaatactcctatatgggttggtctttaattgacctatcatcctaactttggtggaatatttttaggacattattttttttccatgttattctacctgaggctggccactggcatgtttatttattaaatttcttcagaaattatattgaagtcataatattatatgtgtaacttccattaatgatagtgttctagtgtcacaacacttcagccggctttgtttctctgtatcattacagttctcttgcatcccgacgccctaggatattggatacacagaaagtacttattaattactatgctatgatcctgttccaggtatttgtcagtgagtacgctgtcaatgaacaaagggatgctggtaaaggaagccttcttgcttcactggctgaggctgctttccttactgggttggagaaaaataggtgatctctctcacttcttcctttctttggataatctctcattccatattcttgggactaactgaatcgtgcatgcagctgtatttagatcattcatgacttttccaggataaatttcagtattgtcttggataattagtagtttatgaccctattcagataatcacatttggaacaaagggaaaatgtctgttgttcagaaattacaagataatgaataatacacgtattgtaaatattaatagtgagcagcaagaatactctatcatgaataaattaaaagtgtatgtcctgtttatctgcagtgatgttgttcagatggcaagttatgcaccactcttcgtaaatgacaatgacagcacgttagtacctccagctttgctcctttttatttccaacgttcttgttggtcacaagtacgcgagtttgactagaccttaatgtaatgatcagctggaacccagatgcaattgtgttcaattcctggcagcagtatggcactcctagttattgggtgcagacatatttccgtgaatcaagtggttctgtgattcatccgattacgatcagttccagatattctgattcattggctgcttctgcaatcacctggcaagactctgaggatatctttctgagagtaaaggtaaactaaccattccagtttctcctaatttgcatacccttgcagcaattcattacacaagcacctaaatgttttgaatgatttagttacaacgatataaaactgattcaactactgcatacttggataacatctctttggattttagaacatatgttgatcttcaaaagatcttctgcagatagtaaactttgggccaaatgctgtgaacctcacaatatcttcaagaggacttcaagatggcgtcaacactgcaaaatcaactgtgactgttctcacatccggcaactttctggatgaaaattcatttagtgaaccaaacaaggcaagacaaccattgtttccatcacaagtttcttgtttcataaccatgcactgaatttagcagagggcaaccttaccattacaaatttacagtctgccaatatatatgcaagccgtatgacttatttaatcaagtagtgtatgttatacataaggcataaacttttgtagtcttatagatgtcctctcctctgtctttttttttcaccgagccctctcctctgtctttcagttttatctgtaagttttccaggaaatagtttatttggttatgtctcaatgtctggaatcatttcctacaagtatttctagaagttgcacctttttttgatagagttgccaaaatttagtttggagagtctgttagagatgctctaacacgcaatattctcaggtgttggcgagttcatctaacatacaagtatctttgtgaatgacgcatgcaggtcgtgccggttgaaagcgagctgccaaatgctgcagaggtgatggaagcagtgctccctcctttttcattcacttcgtttgacctcgctctggatcaatacagcaagctcgtagcagagatgtgaagcaatgatgcatagtttcaacagagaaacaggatgtttacatgagatgtgatgcctgaatttcagaaacacttggtgtgatcctgctgtttatgacgctgcaagcatagtttaaggtttgtcacgttattgaacctaggggtaacgctaattaatatccttgtcaataagctatccccttgatcactgaactctggttactcagagcttgaatggattctcagttaatctggataagcaaacagaagggaaaatgtagggttgatgagaaatggtcctgcatgtttaccttgtgttcccccaagtgataagattgacatttaataatgcagcagaacatatctgtgatatctcaaacgtaagtccaataaaaactgatcaagcctttcagtgaaggtttcttaccatgcgatagtgcagtaaattaatgacaaccgtaatcatgcactaaatggacacatggtaagagtaagacaatggtgtctttgcttagggaactgcataaacacaagcgtagccaatacatttccccatccaaataagtatagtacatacattttgtaatgctaccaaatacatttcagttttttttcctacttgtctccattcaatagcatcgcttccatagggcagaaatttacatacaagaggataacaatcatagtagcattttttttaatataattcaatagtatgccaatcatctcttgacccagcgagctttccttactggacgaaaaaaggaaattcaattaagaaacatcgctgatatcgtgccaccaaagtaaatgactttcaggcagccaaagagatttacctcctcttagggagtcaatgaggacgaagtatgaggggatatgtacaacaccagccactgctccagcactgcatgaacagttgaataacaatgtgagcaaccataattatcatttaactaataggctcaaaacttttgatgatctcataccacagaaagcaatggtccttgcttaaatttgctatggaaggcaaatgcaagtggctttgctccatctccaggtcctcttatgaatccactgtatatgcacattggaaattcgtcagacaatggtccaaaattatcaagattcaatgttcatgaccaagataacatggtaaattagaggactgcacttacactagtgaaactgagacaagtggagatctcctcacatcatagacagcaacaaggccatgatacatttcattaccatctttgaatgataatgccaagcgctctcctgaagaatcccatgctaatttatctatgcctcggctagatgaaccagagaaagctagcataaataagtatatggactggacaccaagtacttttctaggctgtaatggatgaaatgatagacttttgaacatgtaaggttcatcctaaatgaagcatctgagtatatactaaatggcaagagacagactttttacaagccagatctaaagatattttgaaaaaaaaaatggttgaggcgcttcaattgattagggagaacttgcctttacttgctaatgatcctaagttacataccataagtgatttatttaaaaccatacaatccatatcatgaatgacttcccaaccagatgcagatgtggttattcaaaatatcatcagttaaagttagcattgaagacagcagtaaaatatgttccatcgggtccacaagaagttaggagtatagaatggtaggtactgccactgttgttacctgacaatcagagaggaaatttcaggtagttcgactggtaggagatgggcatctgaagtcaatgaacacaacacaatgttcaggattcagacaataaacataatactgtaacttcacataaaaatgctgtggtgagatgagggtagctgtccatacctaaagatggtggctttgatgagaagtgaattgagcccagtgttgttgagttagaaaaggataataatgcagtacggccttctgggtcccaatttgctccctggtatgaaagcaagattaaaaaaaaaaagcatcataactccaaaattaatcacaacacccatatttcattcaaaatactgctttaaggggggggggggaatgtatatattacaagtgaatgagaaatgtttgctgtaaaactgatcttatgtgatatacttgggaaggttcaaattaagttgagctttatgtaatatttacaatttataaagtcaactgaaccaaaaatcaacttttgaacaagcaattgatcttgttggcaaacaaaagtatagctgttgaaatgacaatacattaacaagtaaaaaggtactgcaaggtagtcataaatacaaaataaacccaagttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32479 - DNA, 764 bp, Oryza sativa
ccgtcccctgtccccgctggcccaccgtcgcgggccgccgcgagggattgcggccgaccgcctgccctcgcacgcgccgccgtgtgccgcccgccgctccacttgtgcccgtgcgtcgtgacgatgatgatgagagagagaggggaagatgggaagatgaggtcttacaggtgggccccaccattttaaaaaaagaaaatgctgattggatttcaacctcagcgccacgtgtatgccacgaaagattcataccgcttcagattgagtgaggggggtaatttgtccggttttaatagtttgaggtttaatatgtctggttttgtggtttgaggaggtaattcggacgatcgcgatagtttacaggtaattcgtaccttttccgagattgaatgattttgtcaaataaacgtgaactggttaaataggcgagcacagtcagctaagacagcaagtctgggtggtgtagttgggtatcacgttagtctcacacactaaaggtccccagttcgaacctgggctcagacacaaacatgttttctccattttttttcaacaatatgaatatttttgttaataacaacagcataattacatgcaaaaaatatttctccataacaataacataaacacttgataaccacatgcacatgattttttttttcaaaaattcgaatatttctcaataacaacatcatacttacatgcaaaaaatatttctccataacaataacataaacacatgcacatgcacatgcacatgcaca

SEQ ID NO: 32480 - DNA, 642 bp, Oryza sativa
ttttaatcttttcatgcagcgtttaagttgatcaaaggcagcctccaaattgctgatttattttctgggattatttgtattttgctggcgagggaagggggtaaggggtgcacttttgttagtgaaaggttgagtatggcattgacacaatgggatcagtagtatgtcaaattctgattaataaaaatatacctcggtaaaattccttcccacaatcttcatttccaatagcaacatacttcagtgggaaccgttcgggatgccccattgcagatctaacagagccccatgttgattctgcgcttccccttgaaattcaagactatccaatacatcctataaatagaaaaaaaataattgaacttaaagaatgacaaatgcatagaaaacattttgttttgctacgatggcatctgcaataaggaaaagtcaaaccggaataatcctctacccagttctatttggatgactattcttacttttggcatttaacgtaccttaacaaaaaggttcaattatgatggtatcaacttcatcatggtggcttgatccctaaatttcaagggaaaattgtaagctggtaatgggcatgctaacaatgaaaaaaattttgttaaacaggaaaatttaaattattagaat

SEQ ID NO: 32481 - DNA, 299 bp, Oryza sativa
agtggtacatgggatcactatatgtacatcatcatctgtcatcagaagggcagcaacttcatgttggggagttggggccaattgcaatgtacaaaactcacagtgcatcatcagcaaacaggggaaaaagaaagaccaaaagagctttgcaaactgcaaccagaaggaaattggggtctggtcattcgtcacgctaagacgagacccggaaaacgaggagggcacaatgcagctccagaacaccaatactgttctcgtcacagattgtgatcatcggcgacacaaacttggagcttgct

SEQ ID NO: 32482 - DNA, 576 bp, Oryza sativa
aattccaaatcactgttcatagctgaggctgcatacttaactttttcaggacaatggcagctacatcatgcaaacagtaggggagccaaggcaagaactgttcaatcaagtggtgctcaataattacatgtgctctttccagtagggaggagagggtgagagacaaaaggctaggagaagggaccctacattgacaataggtaatgtagcaaaacgttaagtggaagtccttttgctatcttcagttcaggattgtgtaatctaacatcattatgaaaaaaaaatagtagtaccatgtaagatacacacttagatactcaaatttcataagactgcagcttgagttccaaaattgctcaggtttgtgtaatctaacatcattatgacaaaatcaatgccatgtgaaatacaatgttgggatactcaaatttcacgagactgcatattatttagaaaacggataacaatccggcctttgcttcaaagaagatacaaccacctagttacgatgtttcagtccagacaactccaactgcatatgacaatcttgagtttcaagttcaagattagtagtag

SEQ ID NO: 32483 - DNA, 635 bp, Oryza sativa
cgcggtggtgttttatctagaccagtggatcccccattcttgacctaacccttggaaaagctctacttttacaagagcagccaacttcaccatcagatggaagttccagatgttttgatcgtagttcacttgaaaggatttctcccagggactctctttctcttgccagcacaagtgcacgtatagatgaattggatgattgtgtcgagggattgtcattgcttcatctagcatgccgtgttgcagatgtgggtatggtcgaacttctcttgcaatatggtgccaacgtaaattctgcagactctagaggtcgaacgcctcttcatcacagcatcttgaaaggacgacatatgtttgcaaagttgttgctatccaggtatgcaaaaatcaacaatactatgtaatttggattttgttgtatgcttaggttttgaaagttatcattctgggtttaatattgatgtaaagggaatgtgtcaatattatcaaattaggaattgtacctggagagatgatcagtggtagttggttcctacaatgtggttcttggtaagcataggaccttaggcctttgggtacagtacccatgcttgcttcctgaagcagatttgaacacatatttccataaacaagca

SEQ ID NO: 32484 - DNA, 476 bp, Oryza sativa
tgaaaaaataactggtgtcatcgcttctttgctgagctcccaatcgcccgaacgggttagtgagtacttaggtggggttagttacatagccagattttgatttatctgacactaatattttgtttcagcgtcttctgtcgagcccaaagggtagcggccataatcgaactgccagcgaaagtagttcctttagtagctcgacagaacttgaccattccattagtgaagactgcatgctggaaaggaactctggaagtgggtattttgaccactctggcagagccatccagcatcaccgaaccagcatgaaacctgacaagccaattgacttgcttaggaaagtggtcggcaataatatttgtgctgattgtggtgcagcagagcctgactgggcatccctaaaccttggaattcttctatgcatcgaatgctctggggtacacagaaatctcggtgtgcatatatctaaggtaagc

SEQ ID NO: 32485 - DNA, 1561 bp, Oryza sativa
tgttttctcaagtcaagagtctacttatctgttaactgttatcattttcgtgtacaagtcggaaaacgaaagaatttcctccccattaattcctacagaaaatgaacctcatccaccaaatccctagaaatttaatcccctgacaaataaatccgaattagcaaagtgccatttttttcttcgttcttggctgtaacgagttgatggcgcagagtacaatactgcacgtacatatatacgtgtgcgtgcgtgcgtgcatgcatgtataatgatgtggcatgcaagaggcaaacgcacgtactccatccgtcccaaaatataagcatttttaacacaataacaagtcaagcatttttaactttaactattaatagcaaaaaaaaagatcaatgttactagatttatcattaaacaaacaattataatatgtaactctttttattaataatatcttacttttatagatatttattggttaaagtagcatctcggagaccgtgtcaaagtctaaaaatacttatattttaggacggatggggtacgtatatacgtatccgtcggagaagaatacgatgcaactacggcagtatcgtacgtatacgagcagagcaggcatgaattgccaagcctagtataatatagtatccttgaccttttagcttgtttgtgcatgcatgaacagttgatccagtacgaaattaattagctgcaagtatacatacatgtcatctcgaggtacgtacgtgagtagaatttatgtggcaggtcaatggaagtgcaaatgttgaaaaatgtacgctttggatacagtgaatatatatataatcatacagaaaaaaataaaaaaaaatcaagaacttgtacagagaataaacaattatgagcaaattaaagctaggcagtgatctgtacagtgacacatgaaggctaggtctaaaaggctcaagtactattccatctactacaatggatgcacggtcagtgatgagctctcttcttacacgcctccaaagtacatgaagaatttgtcagtacggcactaggtgataatcaatgaatagtgatcgaacatcaaaagatatatacgtgtatataattatacatgtttagagaaaatcgacctattttacgtcactgattttcaccggttccatgatttgtcactgataatattcctttctgtaatataacattaatgaatcaatgatattgttactttctctaatatatattacattgagtttatagtttctataatatgcgattaataagttgggccagatacttcttttaaaaaataccaaagacccttatagatgttaaagattgacaactaacttatccgagtgaagtttgaaattatgatatttttatagcatccttatacgacatagaagtatatgtataagtttcaagatttttgcattattattattattattattattattattattattattattattattattattattattattattattattattattattattattattattatataaaatatgatttatttgttatatgtttttttttgcggggg

SEQ ID NO: 32486 - DNA, 2151 bp, Oryza sativa
cacttcacacttccagattaaatcccacatcttcctggacttgtcatctgacgagctggagctttcatccatattggccagagacattgccaatttataagcacttctgacagagaaacgtcccatcttgtccggatgccaagctaaaaaatcctcatcctgcctcattgaagtccgaatcctcagtatttcttcagcaccacagggaaggaaaacccgattatctttctgaacgtcccacacaccgtcaagtcccaagagctcggacacccatttcatcctgcaattacctttccttgttattggccgtcgagaatggtcccttggaatccagggatcacgccatatgcaaactgactgaccatttccaactctccatatacaacccttcttaatcaattccaaaccgtattcgattgctctccagccaggtgaagcattcccactaaagcaagtatcaactagagttccatttggaaagtactttgctttcagcactctcgcacacaaactatccgggttcacaataaggcgccaggcttgtctagctagcagtgcttgattgaacaatttaaaatccttgaatcccaagcctccatactgtttggccttcgtcaaatacttccatgccctccaatgtgttttcctttttccctgttccgcaccccatcagaaattccgagccaacttgtttaaatcttcacaagtcgagtccggtaacttgaagatactcataacatacactgggatagcttgtatgactgcttttagcatgatttctttgcctcaactagagagatagttttctccccacataattattctcttccaaatcttctcctgaagactttggaacttgcctttgttcattctcccctccggggttggaaaacccaaatatttatcttcaaaaccattgccgacgatttggagtgtacttctgatttcaacttggacactagcgggagtaatatcatcaatcagcatggagcactttgctggattaataaactggctagttcctacagcatagtcgtcaaggacttctcggatcacattagcctggccattatcagccttgaaaaagagtagagtatcatccacaaacagaaggtgggagattccaggcgcccgccgacaaacttgcaccggggtgattgccccttgaagtaccttttcatccagcaggagtgatagcccatcagcaacaaaaagaaacaagaacggagaaagcggatcaccctggtgaaggccgcgagaaggagcaaatgtactcagtaaggttccattgagtttgactgaatatctcatcgaggtcaagcacgtcattatccaactgacccaccgatgagtgaaacctaacttatacattgcttgctccaaaaacgaccagtcaacccgatcatacgctttagagagatcaagcttgtaggcacaagcagcttttccagggctcttgttcctttggatggaatgaaagcattcaaaagctaatagggcattgtctgtaatcatccttcctggcacgaaagcactttgattctgagaaatcaaatcatccaggataggcctaagcctatttactaagcatttggagacaatcttgtaaatcacgttacataggcttataggcctgaactctttcaactccattggttgattaaccttcggaataagcacaattgcagtcgcattgataccatctggcatgatcccagtgtggaagaattccttgacagccctaaccacatcactcttgatcaggccccaatttcgttggtagaagcgagccggaaaaccatctggcccaggcgccttaagtggaccaatctgaaacaaagcatctgcgatttcttcatcagagaaattcctgcagagggaatcattcatttcggcagttactttctactggaacagccttgtgactctagaatgatcaacagtagggtctgctgtgaacatatccttgaaataatccgtggaaagattctcaaggtcttttgtcgcactataaacagtgccatccgggcctcttaacttggagattttatttttcttcgctctccatcttgctctgttatgaaaaaagcgagtattccaatcaccctctttcagccagctaattcgcaagcgttgtaaccaaagcatctc

SEQ ID NO: 32487 - DNA, 5924 bp, Oryza sativa
tgtcgaatggtctgtacctgaaataagtactcactttaaaatatgacatgaatttccatgctgaaatgtgagcctgagcgtagacataagcaagagtattaacttccaggacaaccagaatgtgctaccttgccctttgaagctgattgcatcaccgcctcaatcattttgtgtgaacttctaccaattgcttgtattccatcaccattagggggaatcggtttatggccatttggtgaccaacgactttcccgatcaatttgccttttaaactcttgcatcctctctacaagagcagcttggctcattagttaggaccggtgtcccttggattgctgtgcataagcaagaacctgaaaaaggagaatccataatgtgttacaaaaaaccgcaaatgagggtatagaaacatgcatgcacatacagaaaacaattggtctttagaaatgaagtgaatgttgcatacacatccaacacttaaattacaggtattactaggccttagcagagcatgtcattttgaaggaaatgagcagaaatttatgttttatataaagtgcaagaatgactaatggcccatcggtgacataaaatattggtgtatccaataataagcaaatgtgcattggcctcaattaagtcaagaactagcatgaaacattcaggtataggaatacagcacaagaaacattatgagaagaatggtcatggttaaagacttatacttgattgatatatggctccatctgatggagtagctcatatccctgaaagaaacagcaacagtggaaccttgaaccacattcatatattactaaggatgtcaaaatgcaaattatgacaatagattacttgtttgaaatagcgcagatgtgcatccattgtcccactgacagcctctaaaaattcaaatcttttcttggcctcgatatttgaaagtgcagtcacctgaaaattaaatagataagacaaagccacggtacatacaactacagaaatcagaacagttatacagggaaacagtgcatgtaccaggttgaaacgagcttgctcaaatgaggatctggcactatggagctcctggttgtgtgacatataaattagtaaggatgcagtgatccaactttctaaatacaaatatgaagacaaatgatagaaggaacatacatcctccaccgcagttgctacatctgtccgtgtgcctttcttcaaggataaatacctctcacgagcctgagtgagtagacaaacaactagaagtcagtgatagataaactcttcctaaaagatagccatcaacttttaactttttgttaaacatgcagcaccaagtacaagtgaacatggcaataccagtgcttaactgcagtgattctccttatcctaaaatagtttgggtatttttgtgcaattccttcattatcaattagctacacctacgtataattggctaatggaaccttcaaggttccagcacaagttgattatcatattggagagcgagatgatagaaacattattatgtcacctggtcatagagaaggctagccttgtcaaaacgcttcctggcatcctaaacaaacaatatcaaagttaaaacattgtatgcagatccaaatatttatccaatgttaatagaagattatgccagtaccttcacatcatgcaaatcaatgtccacaaattgcagcaacttgtcatttagcatattctcaacctaaaaaaagagtatattattagtaataccactaagtggaagtatggttacagcttctaataaaactggggttgtttccattcttggtaatgaaagcctggaacttgaactatgatacaataacatgaattatttcaaccatactattcccaaatgactagtaaatccagaatctcacattaaagtagataagtcatacaactggctgacaatatctgaaagagtgacaacttagaaaagaacattcagaatttcagattttccagaagagagaatgcatgtatagtaatgtatatatgaatgtttacctgtgagcgcaatacttccttgtaagttccaatttctctcagggcaattgtaaatttggtcatgacgggtcctggaaaaaagtgaatgccacacttactaaaggatcactaattttgaaggcaacaagctggggaatgaaatttactgaatcctaggatcactattttgaaggcaataagctggagaatgaaatctactgaaacctattttgtagttctcaacgattcgtgccaattgtccagtttggaaataacaaaaggattcctcgatcccatgttataaaaacttgaataaatatatctgaataagaactgcattactaacctccaaaagcaacactgattggatcattatgcccccctccaaatgcttccagtgaacttgcaaatgcaatatctccatcatatgcttcccctagtccttcactgtaataagcaaacatatatgtttttaatgctagatagcaaagcataagcaaaacgaggagagaagaatatagagagcccaatggttcttgagttaagagtccagaccatattttccaacagaatttgcaaataaatgagcaaacaaacttttggtttttgtaagtctaaaactgcagactaagttaccacttacgtgtatttgcggcaacctttatgaaacctcaaacatctctctctcagcaattcagaaccttcttcaagggattgtatctacatattgcaaggataaccatttaaacagtgttcatgaaccaaaaactttagaagacatgattcaaatcaatacaccacatttgcccaaactgcaaacgtttataatatattccccataacccttgaataaaagagtccctccattttctctatgaatcacgataattataaaccacttgttcacaatcagcgaaagaatcaaagaacccaaataatgtatgattcagttttagggtgcaggattatctcctgatggaattgaacaatgcccctgtcattctggaatttcaaacaggacccataccaatataacattattcgccaaaattcacacagaaataacctaaggtcccctttgcatcaggaattcaggataataatcgagtgccgaacacacacatgagaaaagaagatattctaacagaatgcaaaatctactgcagttgtgaggaacccaagccaaaaataacgcttacaggagatactttactcacacgctcatacgaaaaatacagaactaatgacgctaaattcttccatctaggaatgaaaccgtcagaacagcaacaaaaaaattttaagaaacctacgatacgagcagctccatttcaatttcaaatccacaaattagacccccccgagatagagggagatcacactttctccagccattcccatcgtcacagcccaaaaaacattcgatagatccaacccgccactctcagcgcaacccagaagccaccagcggcaagcattacaccaaaagctgcatccctttttttcttcttcccctacgcttccactcgcctgacaccaacctcccaaccacggcgcacgagcgcccccaaaccgccacgaaccgagatctccactcactcacctgcttcctgaacatgggcgagtcatccagcctggtgaaaaacatctccgccgccgcccgccgccgcgaccaccacactgctttgcctccctaccaccacaacctcatcaacgccctctcctcgcaccaccaccacccacctcgtcggcgacgcactcctctctctctccaccaccaccaccaccacctcctccgccctcctcctcctacacctccccgcagtcagagcagctcctccagggcggcgtggggaaggcggcgcagtgccggggggagggcgacggtggcggagcgcgggcgaaaccctaggaggcggccggaattgggcgtaatggcggcgattcggcggaggaatcgaatggctcggcgaggcgagaggagagaggagagaggtaaagcggaaaggagaacggggggaaatgaaataacggtgcgcttttctattaattatttttttcctcttcgagttttaatttatttactattattgggctaattaagcgtgggggagtgggggattaagcgctaatcgtgtggggccacacgtggtgggcgtggtgcacggtggggttgtggggtggtggggcccggtgtcagtgagagcctgagaggggcgttggtggactcggtgtatggaagtgtggggtgggggtttggactcggaggaggctgctcacctgccggtgagtgtattggtggcttgccctaaccacaattttctctctttttgccttttggatttattttttttctatagctttcagtttgttcttttggtttagctttgtgtttgatgacaaatttgcagtgtgtggtgactgctaaagtttgatgtttgatggtacgtcttttaaatacccgcaaaaaaaactaaaggaagtttacggtggcgtgcgaaatcgtcgagcctaggcgacgacaaagaatgtttgctagcatcgtaaaaatgttgtgcgtgtgttctcaacgaaagtaaagtggaatgaaaatgctagtgggggaacttggtggccatctgaccagtccgagaggtggttccgccactgaaagttggagctgcttagaagatactatctaaatcgaggaaaaaaagagagtaattctagcctcaatggtcaaaaagaagaaaactaagtaaaaaaaccggcgacttcttaaaattcaaaacaggagttggtttgatattattagtaacagaattcaaaatataagtacataaaacaaaattccaggcttggtatgtccaattgtgcacgacataaatccgtacatgaaacatgtactacttcgtgctgtttgttgtacagctgcgtcctctcccatctgtgatgaacagcgtcctctcccatctgtgttaaacacaaatctttcgtcatattaattgcattattattgctgggttactttaactgtttgctcctgaccaggatgttggtcaatggctgtagtacgatgcataggtaattgatcctgaactaaattacaatggtcaaacataggcattcgctaacgaccacaagtattggaagataactaaatcccattggttaaaagttgctactattactggctaattaatgtgctccaattgatgttaattactgtacattttgatctgaactgctatctctgggccctgtttggttccatgggctaatgtttagccctcaccttttagcctcaaattagccctcacctttgagcctcaaattagccctcgaaacattagcccctccaaggggtgctaatggggctaattttgtgtggggaccatcaaaaagcagaactctctctctctccttctctcctctctctttctactctctctccacattttagccttgaattagtccatagatccaaacatgtcaccctaggctaatgtttagcctaccaattcatgactaaacattagctctcaaaattagccctggtcacaatacaagtaagtatttgttctattactagcagttaatagtataaaacttaaaaaaatatagcaaagttataatattttgaaatattttttaagattactataacattttcaaaagttgaattgaaatatttaaaaataaattaatgatgaaagttaaaaacacagccttaaaaagtctcgtgcgacatccgtcctttgaaaaatcaacttctcactaggatttatacatagcgtgtgtgtgtgtatatatatatatatttaaagctcgaagtttttctttaaggaggaataatgctttatcggagggagtatagtaggtgaaaggttgaaaatgatatattttaacttgaacatgttgatatgagttctacatattat

SEQ ID NO: 32488 - DNA, 28736 bp, Oryza sativa
  unsure (1)..(28736): unsure at all n locations
atgatcgtttgattggaccacaggaaaaatacaggaaccagatgagagagatagactcaaaagatttttaccaagaggttggagctcttgctaagtttcctccaaaacctatatgcaacaagccattccataggaattttataggatttgaaaaacttcaatccttcgaatcaaagggctacataggaaaatttcctataggatttcaatcctatgaaattccttcataattcctttgattcaaaggggcccttagtattttgataagtgtgattatgataaacgaggaagttgtaacctgtaaaagccaaacacctaccgacttagcccatttggagtactcactccgtcaaaaataaaatagatgtgacatatcttaggcctgtttagatcctccaaaatagcaagagttctgctattttggagcattttttgctattttgaatctaaacactagtagcaaaagttggcaatttgtcatttgccatttgctagtccatagtagcaaattgtaccaaaaagtgctttgggaccatacactctctctccccaccaaaaagtgctagaatggcaaaaaaaaatttaggatgtatctaaacaccagctagtatttttgcaatgccaaaacttttgacatttaccatttgccatttcaaatggatctaaacatgcccttagtacaacgaacctggatagacttatgtcgcattcagttttagttttagttttaattttagtttttttttacacggagggaataggtcttgacacaacctatgggctaatgctaatgcactaatctttggtaggaaatgtgtgtggacagaactaatgacagattgcaatggggacatacatcattgtgctcaaggcagtctccggtctccaggcttccctcctcgttttgagtggggttggcgcccacttctgatgagagttcggtgttcttcacggtcagcttacctctgtctactcagcttttgcattcacacaaaactgagataatttggtgtttcagtaataattgagctgagagatttgttgcatgattaaagttttttatctttggaaagatatgcttttggacttatgagaggaggtgtcggcatgtatagttttatgtgagacaaggggatgttgctctctctgtctcttacctttgtctcatctgttttttccttgttctattagctccaatttcgaggactggaggagacacacggttcttttcccatgtaaatttgtttcaacatagcagaaatatgtttcttgcaaagttcttccaacatagcaaaaactagtgttaggaattattttcataaacttaatccaacatatacttgatcacctaaattgcttatgcggaattggtgattgaccagtggtactgacaggtgcttgacgaagacaaagaaaaacgtcattagtcttattagcaatatatgtagatgtagtgctaacgaaaacggggtagcgaagcaactgtaaggatcagcgtaggcgtcaggctgtgtatgcaatcccatgtttctaagccctctccctcgttttccacgcgcacgcttttcaagctactaaatgatacaatttttaaaaaaagtttatatacaaaagttgcttaaaatattaaattaatctatttttttaaaaaaattagctaatacttaattaatcatgcactaatgaaccgctctgtttttcgtgcaggagggattgttttccatcccttgattaggctgtgcagtaacatgacaccagagagaatcagagttattggagctcgtccttcggtctccctctagcgcctcacttaaaatcggttttggggttttgaggaacatatgtgatgatcaccaccgtacatgagttaggcttctcagttcttgtagcgttagagagtcagctgggacaagtccatcaagaatgaggcgtgtaatcccatcatttcgcgccttgtgatcagctcggtggccaaaaatcaattaacaataagctctgatctgcactttggttttctttctttcagatatgaatgtcgatgctttctgattcctgctagttataaggaattctctccgtttcatattataaatcgcttgacattttttttaagttaaaattctttatgtttgatcaagtctatagaaaaaaaagaacttgtataacagtaaattagtttcattaaatttaacatctaatatatttgttttgtattaaaaatgttactatattgttacaaacttaaagaaatctctactattataaaaattgaagatgtttttgccggtattttggtacgtcatccgtatataagtcggtttttaactttgtttgtttttggaaatgcatatccgtatttgagtcgttttttgagatcatttacttttggtaatacagaaggaatcatataagaaatatgtttaaaaaactcgcattctaatttaagacgatcggactcctaactgcagctcatgattttctaaaaatatatatatatccaagtgaattcccacagtgaattttatcttaactaaaccatataacaataataagattgaaatagactttacccgttacgtacgggcatttttttctagtttaattaaaaaatcaaaccacttataaattataaagcgaagggaatattacttctacttggttaatctatccgaaatcagcgtgtaaaactagccacttaactagtgtccctctgtctgttgccacatgagcagagacagcccgtaaagatgccacctttctggggacggcaatgatgctcgcacggtgccgccccggcggtcggcgcggcgatcgtccggtcaccgccggtgaccggagcggaagcgccggcaagaaggcttttccggcaacgtattcccagatcgatcggtccaagcgcggtccttattttcttcctaagatgtagatttttatcccaaattttattagcatgttttttaaacgattaagtggtacatttctatagagaagttgttctaaaatatctgataaatttatttcttaaatttataataattaaaactaaattaacttatttgctaatagtttttttcttttgttatccgtatccttacttaatattttcttcattagtttcgaacactaccgtagaccgcagcaagcaagcaatagccccgtgacctccgctagtttgcttcccagcttacaatcgcaacgaacattaaattttaaaattaatttttatattttatattagattttaagtcgttaataatatatgtatttttatatatgttttatcaataaaaatatttttcagtcgataatgaacaatactgcttatataatcagctatagctatgtgaaagcaacccatgtcgttgcgagtgatcgacgagatatttaactatttatcatttttataagtggtagttaagaatttattagtagacccacatttcaaatacataagagcttatgtatgatagtctgcaagtgacaaatttttaattaccacgtgtttacttaaatactccgcgatcgacagcatgccaagcaggtctgtgggggcccatctagctgccaatcaaaagttggtgaacattgaagtctctgctaatggcttctcacattttcacatcagttggaaaggaatgcctttaatccaaggaatctgtccgattaataccaactttctttaaatttcttgtcgctgctgctgctgctgctgcttttctttgtgtttggtcatccacagatccactccaacctggagaagcttcacgctaacgttatggaggagtactagggcctcctgtggcgaagctttcgacggttgtatcttctctcagggtgagtttgaggataaggtgatcgaggagattgggaagatacgtaaaatgaggtgagccattagcttataattaattgagtattaattattttaaattttaaaaatggattaatatgattttttaaagcaacttttctataggaaatttttacaaaaaacacaccgtttagtagtttggaaaacgtgcgcgcggaaaacgaggtgttatctccctcaatgttacccgaacgaacacaaccttagtttagtcaaatagtttagtttttaatgtagatcttaagaattaagagctataaaattcaataaataaactaaaagacataaactaaaaaaaatgcctatttcatattttcaccggctgcttcttataaaaggaactatgagtgtgttctcaagtacacttttccaacttctattttctttctccacgcacactttttctatacttataagcaataattcttttgaaaaataattatagaaattttgttttaaaataaacatattaatctattttcaagttttgtttgctaataattaattgatgagctattactttcttttttgcgcgggagaaagctttagagcttttcttgtcaaacattcattcaaacacagccttatatcttcagctggacctcgagtcctcggttagtttgtttagctgggttgatgaggtgtgttctcatgtttggtgatcctctctagatatagtggtatcagtgagtgtgtcaatgcatgtgccatgctcatgcttcaacagaaaccatggtttgtttagctgacgcaacagtctaggaaagatttcttctttttttttcttttttgaaagcaataagcaggctatgacgctatgtatgagaatctgaacatgtagtagagatggaaaagtttcagataagtctccgaagatttggaaaaggcaagagcgacttgtgcgttggattctaacacccggcagtaagaatttttgctaaaatttgattaaattctgatcgaatttactgtttaaatttgagttctgaaaattattcgaaattttacttggaatatcaatatgcttccgtcccccatcaaattaactactccatccgttccataatataaaggattttgagtttttgcttgcgttgtttcaccactcgtcttattcaaaaaattttggaattattattattgttttttgacttactttattatccaaaatactttaagcatattttttgttttttatatttgcataatttttttaataagacgagtggtctaacagtaaaaaaaaacttaaaattgatttataggacggagggagtacttgtctgaccggggtgatcgattagacgcaggaggttgactggtagcgagagcagagagactacaatgagcccatacacgccaacaaaaaccgtggtgtttgctaacagcaaaatagtcttttttttttcaaacggccggtcataattgactggcgttatatcgatagaaggagaaaaagtacaaatagccaaagggctaagaaagagaaaaactgtacatgacgacatgcaaacaagcttgcatgtagcctccctagctcctcatggcaacattctcccaatgtgtttagcgccggccatactccaccaacctaattcctcttggatacgactaatcatctggtgtactgtcgcctcctttgctctaaagattcttgcatttcgttccttccagatttcccaagcaatgagcaagaagagagttctgagtcctttctgttttgttgcttccaggtcgcttgttccttgtgtccaccaatctaagaggtttctacttgtgttccattttgggatgatgtgcccttggtgcagccatgtgagaatcccaaaccaaatttgctttgagaccaggcattcaaacagaagatggtcgattgtttcgaggtttcgaaagcatagctggtagaaataattatttggccatcccctgatctgtaaccggtcagctgtccacacccggttttgaagaaccaaccaactgaagattttgcactttaccggagcccatgcctcccaagacaactttgttgatggcaagagtaccattccattgaattggaattggtacgcggattttgcactatattccccattagttgtccattgccaaacaatcgagtcttgtaccccctctgttagttgtggggtgttacgggctaaaatttcccaaacatggaagaattcatcaagaaggggaatggtgaggctgtggaggatgtcgttaatccatcttccttgttgcagggcgtcttggacggtgcgggttttcctcttcgaatgcctataaagattcggtgcttgactttttagtctttggccaccaatccaatttgattcccaaaagctcgccttttgtccgtcaccaatctggactctcgttgatgccgcgaaaagatccttatccaattcatcacagggtgtttcagtccctatccaaggcttctctggcgtcctccattcgaatcataaccatctcagtcgaagagctctggcaaacttttctaagttcggaacccccaaaccaccgtaccggacaggtgagcaaactttaagccaattgaccttgcattttccgccatgcatattctcgttacctgcccacaggaaccgccttcttgctttgtcaatttcttgaagagattgtttcggcggtttcagcaccgtgagggtgtaagttgggatggcacttagaactgagttcaccataattcggcgcccccccatgtacaacaatgatggcttccatcccgagagccgacctttgatcttatcctggagaggctggaaatgcaccttacgtaggcggccaggagtgagtggtagccctaggtaagtcagtgggaagctggctcttgcccccgaaaaactacacaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcataaagcgaagtcctcaatctagcatggcgacttccgatgttggttagttgcccaccttcggtcgccagatgtagaagcctttgtagggggtcgatagccaggataaagagatagggggatatggggtccccttgcctcaagccacgtctgtgtgcaatgcattccccctggtctccatttaggactaccttggaagtggcggtggaaaagagcaaacagatccaatttctccaccgggggccaaaacccatgttttgcatcagttcaagtaaatattcccaggagaccgaatcaaaagctctagcaatgtctagcttgaaaaaaagtgttggctttttgctggcatttaggttcctgagcatgttccgaacatacaggaagttgtcttgaatgcatctttttttgatgaaggcgctctgtgcaaccgagatcaggccatccatctgcctggcaagccttattgctagaactttggatatcagcttggcgacggagtgaatgaggctgattggcctaaaatcggtcaccaaggtaggggcgttcctctttggaagcaaggtaattgctgctctgttgagtactccaaagtttcctcctgacaggttatacaaacactggaaaacatccatgatatcctatttaattagttgccagcatttcttgtagaaggtaccattaaagccatctggacctggggccttttctgcttgcatttgctttaaagcggcccaaacttcctcctctgtaaaaggttcatctagttcatcggggttaacctgtggtagatcgatcgcgttccaatttaaggtgcaatttcgcgcctccttgttgcctaggattgagttgaaatggttgaaaagcgcctcacttttttcctcatgttctgtcaggatagcacttgttgtatggagttggtgaatgtggtttttccttctcctcgagtttgcgtgaatgtggaaaaactttgtgttggcatccccttcttttagccatgtcaatcgcgatctctgccttttcttcgactttgccactgctgccagccccaaaattcttagcttgaggtctttcctgagctggtgttcatcagcagtaaggatcctatcttcctgggccaaatccaatcggagaatcacctcctgagccacgtgaaattgcattttgatctctccaaacagacttctactccacttcctgagagctttagcggtggctgtcaatttgtggctgagttttgtaaatggatgtccaccaaaagtgtgagatgaccaggcttgttgcactacctccatgaatcccggcacccagacccagaaattttcaaagcggaagactacccttttgggtgggcttacagtgaaagcaagaagcaaagggcaatggtctgaacaggatgaggagagggcttgcagtgtgtggttggagaacaggatgtcaccatcaatattacaaaaaactttgtcaattctttccagagtaggcgcttcctgctcattgctccatgtgaatttcctattttggagcttgaactccttgagacaacatctatttagagtgctcctaaattgccccatccttctcctatctaaattcagattatttttatcacttgcttcacaaatcaagttaaagtctcccaaaacaacccagggcagcaatggctgcggcactaacgattctagttctgcaaggaagtctgatttatgttcatcctccgaaggcccacatacggaggtgagaataaaagggacatttcctcctatcacttgggccctaattgaaacggaaaaggtatgaatttgtgtgttgtcgacctgcacctttgtgtcatcccagaaaattgctacaccacctcttacaccatcagcagggagaaattcaaaacgcctcagtcgggaaccacctatttcccgccctaaaaactggtctatgttagctaatttagtttcctggatgcaaagtatgctcgcatctgcattattcgcaacctcacagatagcctctctccttgccgggttgttcaaccctctgacattccaattcagaattttgaggccttcaatcattcttgaaccataagtaactcctagagatgtgcactagtgcgatcaacatgctccaatggcaatacattgctccaacagcccacttacatagtacacaaatggagaagtagttcatttccaactgaccaaaacaactactcctatgattggccaaccaccaggtaacacagatcaacagagcactaaaacctagcttaaggctaggtgccattggcaacgctaatagtctaaatgacaacaaccgaacatatagtaacagcgctaatcgctgacgaagggtctgaaggaccactacacaagttaaagaacagagatacatgattcatcaacgacactacgacaacactcatcacaagccagagctcagacccattccggcgtggcaccatcagcctcctctgtcacatccggcggcagaggcttgccgctgtccaacccagtaagcgcgcgaatcccttgcaccacgaccgtcggcaaggggtcctggaagcgcttgatgtactcagccactgcctcatcacctaccggttctcccggcttaaggaccctcatctctttcataatgcgaacctgagctcgcatcgagattagaaccggagatggccgtgcctcgagacgcttgctatgacgactgggaagcagaactttcttgcgtggcctcccgcgacgacgcactggcggtgttgccacaagcggcggtggcagaggagcaaaaaacggctcaactcctccttgcatgggctgggtcgccgtgccttccatttgctcccccaccagctcgagaagcccaagcccaggagaagctatcaagccaggggacgcagctgacccatccggcccaagaggcgccaccggcccaggagaaactggcccaataggcgccaccggcccaagaggagccgctgacccaataggaaccgacgccccagcttctagggtagatgcgttcgctgacttctccgcgtggaacgctgccgccaccgccagctcgagaaacatcgggtcctccccctcccgtgtcgcccccaccacctggccgtggacagagcagcagagggcgggatcgacgagaagaggagcatgggcagcagaagagtgcgctggtggtgttggcgctgcgccgctgggtggcctgcccgaggcaggagaggcgagcctgctgctcgtcttgtcgttgtcgtttcctccgccaccttgggaagcgcacccgcgaagacagcgactctccgagaccgcacgacgccccttgcttggcgagcgcgaccggcaagagcgccggcggcgagaaggcggcctggatgggcgcctggctggggagcgacccacccgatggccggcgaagtggcgattgccgccacggggggtgcggctgcggtaccggccgtcgtttccgccttggggctcccttgagcggccacgacggaagagaacatcagtccaagaacggcctaccagagcgcgtccgttgccgccgccaaagttttcgtcgtcgtcttcttccctctccaggcgaggcgccagcgggacacgacagccgccctactgacctcgctgcgacagccggttacgcaagtcaatgccccgctgttccggtcgcccgcgctcctcgtgaagtctccgtacaggcagtggcggctgcggaggctgcagcggcggcggcgaaacaccgtcctcatagcccaaatgccagtcaaagcggtgcacgcgccgcctcggtggatcatcggagtctgtggagccgctggagtttgaggacctcgccggcaatggcctccagtcctccaccatgtcaagatgaatgagcagatggcggacacgacccagaggtgccgaggcgacctcctggctgggcgtgggcatgccacccgtctccagcacctgccctaccccggccgggaaaagagtgaagaccgacacccgaggaaggagattggggttctgcatccacacccagcaggcgaaggcagcagtgttgactctgttcttggtgtcctcttcgatacggtcgacgatgcagacatcttcgagcaccttctgacgtcgtagttgggagttcccacttgctgctgcaacgcctgcgccatctccttggcgctgacgtcgtagttgggcagccgggccttgatgacggccccatggttgtacaaccgcatagcttcgtgctccattgcagcgtcagcgacaaccaccgcataaccacaagcaggatggttctccggcaacccaggtatgtaatccattttggggccaagcctttcgcgcactggtgctttgtggccagtcagtggagggaaggcaaggggattggggatttcttgcttggagggtggtgctggatgagtggagtagatacaggaaaatattgagggtttgttcttgtattttgaagggcaaccagaagatatgtggccactgcgcttgcaaatgtagcatctgggagggtctctgcagtctgcaattttgtggtcttgagcgaggcaacgcaagcaacggcctaaagttgctggattgaagggacgccaggctggaattactccggtggttgggcgcctggacgccgtggccggaagaggtgccctgccctggcgccaccaaaatctcggtttcacctcttgccagattgatgaaggagctccaggttcgcctttactcaatcgattaaacacacttaactttctcgtctccggaacaacaatagctgattttagtcttgcttgcttccttgggctttccccccacaggaaacagacaccgagcagaagcaggagtaatggcggaggagatggcttttcttccaccttctccgctgtcttccttccttgaggttgaagcagtaaatggggcactaactacgctctgccggggtgcagctagaggcgtagcctcatgggcagcggacgcctggccggccatctggcgcgcgggcgacggcggcgactcgacgacctcgtcatcgtcgctgaaatcccagtcgaccttctcctggctacccgaagaggagccagaggaacactgagcggatgtggctgctggactggacgcccctgccggagcggccggaggcgggctgttgaggtcgccatggccagagtggccggtggcgggcggggagagctcccctggctctagctccatagctagcttcttatgctgtgtggtaggctgctccgagatcgcaacagcaaaatagtcgttgtgttatgtgtgattacacctatatgttgaattttcttgttagggtatgagattaatgttcggtatcgccggcgtcgctatcgccgtccttagcacgccgccatcacctataccggccggcttgtgctccgtcgcggccattggcaaaggtggtagcaagcctttgccaatctaaaatgaaaaagctaaatctaaaatttaaattttcaaacttaattttaaagttgattttaaaatattttcaacgtagttttcttccttattagcttttaaatttctaagaacaattatataaaaatatttagactcaaattacttttttatcgccaataagccgttacagctacataataaatcgattaaatttataataagtcttttacaacggataagacacgaagaaaggggatctaggaggaagggaaaagacgcggtgaggaggaaggaggcagtgtcatgtcagcagccatgacagagggagcggaactccggcacacggccggcgcgcgaccacgaggcggtggttgcgttcttttgacactggtagatgtgtcctaaccttcgcgagaccatttataagtgggctcgtgttttttcaagaaaaggaaaaagtacactgaaggtccctcaacttatcagcaagatacaaaaacgtccttaaaccgtaaaatcagatatatggggtcctttaactatacaaaaccgttcacccgaggtccctgggcagtattgacgccagatttgtcctacatggctggctgagtcagcgtgggtcccatgtgccagatgccacatcatctctcttttctcccttcctctctctctcattggattggccgggccggtggattgacgccgccaccgcacaccgccgcggaggcggatgcggacgtcaccagctcgtcgcaccacggggagggcctcctcgatgaccatcggcggaatcaccctaaactcgtcggcggagctggagcgcggacgacgacgtcgacgacgacttccaggctgccgccgagccaccgacaagcgagcgagcgagacacggcggaagagcgcgagggggagacggcggtccgtgggaggaggacacgcattccggtggccgggctgctcgagcacttcaagctcatcggctgcttcgacgacggcagcgtggagttcatgaccgtcgctgcacgtggcatgggtaaatgatgttaatttatgctcaacgtggatggaaattgatcaaaaccatttacagttgatggattacagaaacacacaactgccacccttttggaactcacaaaccaagatttgcgagacagcaagagctatatagcttaagaatattaacgcaagaggaactactaaaacagcaaacaataaaaccagggcctccttttgtttcaacgcaagaccttttgtttcgacaacacgggaatatgaaaataagcagttcaatacgcaccttgatttttgcttgcaatttggttgttgctcctggttccttcttagcatttggactctccaggttttccttcccagaatttatgttctcagattgtccgccacttaccagcacctcacgggcttctgccaaagcagcagcagtctgcacatttatctgcttcacaaatcctagcgcattgtaggttctatcagctgggctgacgaagtatgaaccctgggaggaacatatggccacaagaaagttcagcagagaaaacaacagcaagcaatgcccccagtgcgtgacaatatcattgattaatgaaaaaaaatactctcaggcatgactcaataataacaaattagaaatatatttctatccgcttagattcagccatagtccaccaatttaaatgcttgttccgaacacttgacaacttgagctctgcatctcaaattcataaattttacaaagtgctaaatgtacctgaaattgcatatctacgaaccaaggggacttccatgctgaaggagattctagtcctcttttgatgcatggggtatcagccaatctaacaagagcaaggcttcagaattcagaatggcatattaaaaggaacaaggatcaagtaatctcttcatacttcagtagcaggaaacaagcggggtttaattccctaatgtagtatcttaaatgcattcatcagtaggattctagtgtttcttcaacgttctcgtcgtcagcgccgagatcgtcaccgtcgggcgtcggctggtacagcggcaaggaccagagaaagctcctcctctactgctacttccgcaccggctaatgagcccgacacgagtcgccgctgcacggcgccgacgcctcctgctcccgcatcgccgcgccgccatgtcctcctcccgcggaccgccgtctccccctcgcgctcttccgccgtgtctcgctcgctcgcttgtcggggtctgcctctgcggcggtgtgcggtgggggcgtcaatccaccggcccggccaatccaatgagagggagggagggagagaagaggggaaagagagagatgatgtggcatctgacatgtgggtcccacgctgactcagccgccacgtgggacaattccagcgtcaatactgtgttgggaccttgggtgaccggttttgtatagttaagggaccccgtatatctggttttgcggtttgaggacgtttttatatcttgctgacaagttgagggacctttggtgtactttttcctcaagaaaaaagtactttagtccgactgtagaatgggccgcatgtacgagacctcccgttctggcccaaaaagaatcccatccagcacaaacataacgggccgcacggacgcccagcccgttccggcccaacctgaacggactgcacgagatctctgtccggaacatcacaagtcactctgtttaactggcaaaatagttgatagcaaatactccctccgtcccaaaaaaaattaaactttagagataaatctggatacatatgtgtctacattcatacctagagtttgattatttttgggatagaggagtaatttatttagagagagattgataaaaaatattgaatgatgaataatgtgcaactttaatcacagcccatgtattattacagaggcagacattgtctcatcagctcacggccatggcgatcaatggcggccgccgacctcgccgtgagctgcaagagctgtataatctccgatccccttgcaccatcatcgctaggaaaagaaagaaatcaaaaaaatttctggcctagcggttcggagaataaaattctgaaccccttggaagttcagtctcatttgcatatcgatcaggacaagtagaaattcagtcaatgtgtagttggttacagggagattggctgaatttgcatgctcaaccgaaatgactgggattcagaagctcgactgaagatttgatatatttgtgaatgcatgtagaggcccaactcaaaactgcttacgggtgacttcgtttttttctttttttcttttaaaaaaagggcatgaattcttgatgcttgcaccaatggcaaagaagatagtggtactggaggagacaggagagagctatgggccttgccgtcgcttaaatccaagctagctagtgttcggagattaaactctcgccttgcttgaaaaatgaaaatatatatatagagaggggaattccggtgcccgagcccctgcctagttgacccaatcccgtttcggagcagcaatgctgtgccacgccggcatccgtgaatcctgagcaccactgcggcctcttatatagtatacttggtcaagctcgcgagcctaaccgagtttgagccgagcctgtttaaaagctcaaaggtggactaggtttggctcgagctcaagcttgagcctagacaaacaaacttgctcgagctcggcttgttgacagccctactaacgaggaggccttgatgtctcgccgtcatggtgatcgacggcgggcggaggcgacatgtaccagctaggtgagctcgacgtctcgtgcaccttcaatttcaccattggacctttctcaaatgccatttacatttatcccaaatcctccttcacagttcatctagaattgccatgaactcgatcagccacaaccgcacagtgcaatgtgttacaaacaaccttcatctgaatttctgcattaccaatcagatcatatcgatccactataggccctgtttggtagagcttcaaactccaactctaatgggagatagctcttatagtagctgaggtgggtgtgaaagtgtttggctagactggttagctccacaccatcacatcccttgtcgccatttcgtcaaacacttggttggcatcgccttgccgttgccgccgctgccgccgtcgccaccggtccgcccatgtgccgctggtgatcaccccgtgcgctgcagccgcgccacccacccgccaccaattgccactgccgtcgatgccgtccaatccatgcgctgtcacccatcatcctgatacactcgcgtgccatccgcagccgcgccacctgcccgccgccgctgacgccgcccgccaccgccgcagcagccaggccgccagtcgctaccggaggaagatggggaggactgaggagagagaatgggaggagagggggtgtgaagggggtagtttaatggtatttttgtgtaaatacattaacaaattaaagggtagtgggtcttttggcaggaatatagtagaactgtggagcagcaagaacctagctccacccccgtggtacaattttgcagagcaactctgctaactctgctccagaaaatagagagtttataccgtttggcacaactccagctctaggtatgttggagttgggagctagagctgtgccaaactcaactgtgatattgaaggccttcagtactgctgagagtactgctggttctctctcagcaatgctcggtttcaacttgtgattctttttcttgagctcaggctgattcattttttacggctagactactgtcattctattttgacggcaaaacagttggcagatgtatatgcaactttgatctcattccatgtaatactattacagaggcaaatactagacagagtttccaataaaaagagcagcctgtcactctatcctagtataacataattcttgaaagtacgcagctaaaaacggtgtgtataaatctaaagagacaatatagaagccacctggatttacacaaaagcattcgatgaatgattatgatgaacgaggcaactattattctgcatcctggtgacaaggggcaagttcagcactccaacatgcacatacagtagtacagtgcacagagaaacgcagttactacatgatgcacgcaaagaaaaacatgagtgttgtgttactgcatttcatttccgctgttactttcgagtttcgacagtaaaaggttccataacatggcaacggctgcaaggctcaaccacatttagtctaaccgtggagggaacttttccctcgatgtatgttctgatagcgaagagtgctttagaggcttccatgagatcatcctttggcattcgcgagcatctaccaagtttgccgggagaacatctgaaagactcaaaactggtgtccaatgtaagacattcgactgatgtattctcgaggatatgatatgttagctccaacaagctcttcacggagcggaatccagtgatcttcacattccggaggttgtcatggcgttgctctggcaactgccttagatgtgaggggttctcgaaaattgaatcgttctctgggtgttttgcggatacctgaaaatgacaagtccattatagttgaattaattggttccagaaagtagtaactagacaagtttacagggtgaaggtgtggcttacatccacgatgaaagtgtccaaggaagggcaggcatcgagaaaggaaaccagagacaaataatcatatgatggagagagagttactgcagaaagagtaatacacaagtacttgagatggaggaatgtgttaggcaccattggtgtactgaccatctgcagaaagatgcttcagattgactaaataccatgttcaaatgtgtgaacataaatataaaaaaaaagtttaagagccaccgagaaagcatacctcacccaatgagcgtatggtaagagtttcgaggtttggaaaaatatatggtagctccgcgcaagcatgattgagaacagaggaatacccaatacttaggttcttcaccagagatgactctccaaaggagagttgtatagggtgataagcttgataaaaaatgtgcaaactgtgaaggtttggagctttgttctctattactcgcagcctggagcatccacgcacttccacataggtcagccgctgtagcacacaaggcaacttcatgtattttatatgacggcaaagccggagtttcaaccactccaaagcaaacgaagcggaaaaaacgcaccccaattcatcccccgtgattctcacatactccagatgcagcctcgtcaagctttgaaagcaaccaatctccgcagtggggtgaaaggtacagcagtaaagatcaagaagccgaatcgagcttccactcccatcagatagaagtgagcaaggaaagtcataatatgcttttcccttggacatcgagaggctgagctcttcgatccttggtgtaacagcaatttgaagccatctttcgaggtaactgcgtgctttggtactgaagagaccattgaactcaatcgtaagagccttcacaccaatgcctgagtgtttttccataacgcgatcaatttttctgatgaaatccgttgtaccttcaacgatacccatcgtttcagtactaaaggagagtttgggacggtttctccatgagtatagaaaggcagaagacaagcaggcagcacgggcagcgtctttcattggcataagggaatgtatatgctgccacatttcctgcatgcacaagcatgagtgaaccattacattggaaacttgaaggctaaaacaactggattgtaactgcggtagttaaattgagcattgtgtagagaagggctattagttattactagcttgtatacattttactgctatggatggtattgcaagacacagccaaaaaccttaaaaacattatgttggagggggccaatagtgttaatttttttcaaaatttgctaaagctacagtaaaaaatactgtgaaatttgaatgcatgggggaggccaagccactgctcgcctccccctgtttcctcccctgattgcaagttgcaacatgacttaggcaacatacttgacaaatgattgtggtcctaaaataatatgtggatcaatcctatccaccacttgtataagaattaggaaggataacatgaaatcaatgttctaatagaaagtgtgaaccaagtaaacatgtgcggaggaagcactgatacgtttttccataaagttcaacagtgtaatagttatcctaagataccaaaacaaaccagtgtaatacagcagtctgaatttgtgtgcttcccatgactctgatttaaatcatacggtcatacccctattccaaacaagttactatttggtgacaatataatgataggtttattttccagcattaagtacccatggaaggagattctgcaggtagaatgggccagatacaagacatttgttttagtcaaggttatcagcaggtaagcatgatgtcatctgcaattaccgcagtcgaacaagacatacttggtacatctatgagtctatgacgagtacaaaaataaacaaagtgaaatatgtacgcaaatttctgttttagttggaatagttacaccaacttttacgcactatttgcactgtaactctgttagtcttccactaccaggactgtgtgtcatacctcaggaaggtatggacctgaatatctcatctttttgccactgcgaggactgtcatcttgttgataacatgagccctttcgtttctctggtgaggcaatagactcatctgcaacaactaaaggttaagaatatagtacatgcgtcaacaggagaaacaagaaattaagcattatgatgcaaacaatacatgcttggtctagtgtttgagtggatgctgattcctactctcaaaacctttagtagataagcatcattatttggtcttcttaattacaatctcttttatgaacagatgcagactgggggtaaacgggagctcatgtgctcaaccggagaacttacctgctcaaacataaaaatgtattcgcaaaaagatcatatggtcgaaactaacaatctaaaggaatctcaaacataaagaggtacttgcaaaaagatcatacggattgaaactaacaattgaactaacaatctaaacgaatcagtttcacctactcgcaaaagagagaggaaactacaaaatcgaaatccgagtcttgctgcacaatgctgaagtacattctctgagcaagcaatagatgagaaaccccattgtttagcttattcatatgcttatccgaatcgcttattagcaaataaaaaatcatttgtgaataaaacttttatattcgtgtccttagcaactcaaaagcaaatgttgtcaaataaactaagatgaaaaaaaaatcaacattaaaattaagtcctaaattcaatttttggcttataagcataagcataacaatgaggccggcatgaataatttgcattgtcacatgaatggcagaactcattgcatcctcacatgaatagcagagcagacaagctgagacaggaaaaggcgacttaccgggaactagggcatgtcgactacgacgacgacgacgacgctctcgctgcaagcgcttcagcagcacataccccaatcccatgaccacgaacccacgattgctcgtccgtccacgaatcgaggaaaccggcgtcgacttccgttttagtctcctacttatttgctctcggaatctgtatcttgtgaaggaaaacgagggagagagaccacataggcgccgccgagcgagattatttctcagcaatgggcctcccaatttagggagaaatcggaattaggattcctgaattcgcggttgaatatctgagtctccagcgccaagctccatggagaccatggcgattcgcgagcacctgggcgggctccatggaaacccgcgtcgagcttgccgaccgtaggggagaaccggagaatgacgcgggcggacgccgcgaggttctgcggcctgcgaccgccgccgcgtgcacgcgggtagcgcgcgctcgctctcgcccctcgcggcgccgctctgcgccgggtgggtgagacgagcggagcgccccgcggcggtgtgtgtgtcgctggaggcgggtgctgcggcggcggcgggcggcggggcggggacgccagccaggttcctctccgaccggatgcatgcgtcgatggcggccgcgccctacgccgccgcagcagccatccagggtgcccgttgaggggtttcccactttccctcgatgcaggcggcggccgatgagatcgccgcgtcgtggaatggcgggggatgacgccgacgacccgcttctctgggctcgattactccatccatgcggccccgtgacccaccggagcggaggccgacggcggctcaaagtcgaggcgctaatgctaccagctcgtcggagtcgccggtggattggagaggatcacggcgaagtggggacctctcggattctggaaggagatgggtgggtccacctcgtctatctgaacttcctactgacaagtgggtccgcttatttctaaccgttggatcaacttaagcgataaggattgaattcgcgttcgcgggccaaaccgttacggcccaacaaaataatctctgctaccctcggtttcttcgcgttctgagcatctccaacagtctacccaaatcacactcttcaaatacctatatagccaactcttcaattgatttagcaagttaaacctgttgctcactccaacagcgtctccatccaccctctctattttaagtgtatgacactgggacccgtatgtcagtctctcactccttcctcctccactttcctcccaactacatcaccgatggcaggccacgaggagggaaaagccggcagggggcaccgccggcgaaggggcgacgccggcgaagtcgtggcggcgtcgtaggcgcgggcggcggcctcggcggagtcgcggtggcgtccctcgtaggcgcgggcggcggagtcatggcggcgacgtacgcgcgggcggcggcctccgcggagtcgtggcggcgtcgcaggtgcgggcggcggcctcggcgtagtcgcggcggcgtccctcgtaggcgcgggcggcagcctctcgtcggagtcgcggcggcgtcccttgtaggcgcggcagcggtctcatcggagtcgcggcggcgtccctcgtaggcgcgggcggcggctacctccccttcccccgaccccagcccaccgccatcacctcgaggtcggcggcgcggagtgcgcggatggcgacggcagggccggctcgtcgtcgtcgtcgccgttgccgtcgccgccccgctccagatcccgaatggtcgaggggaagacgaagtgcggcggagccggaaggacgacggcgggggtggtgccgggagaacgacggcaccgggaagacggcagcggcggcgccgggaggacgacggcggtggcactgggcggaataggcggcgggcaagaaggtagccgggatgggatagggaaagggggagagagagagagaggggtgggacctacaccagatggccagccgtcctggctggacaactttggctagtgaggtggggaatttagccactcgaatggcttggagagtcatttagctagtctattggagtagatttttttgttcaagttagccaaattttggcttggagagccatttagctagtctcttggagatgctcttataagggcatccacaatatgataaaatactaggtagtaagcattaaattttctcttgttacctaccataaacattgtgagtcagtggcgtagttagctaggtggcattgtggtccatggaccacataaaaatttgattgagattaaaactatagtatatgtgctagttaatataataaaaattgtatattggaccacctatttaattggcccattacatatagatggaccatattttctttaaatcctagctacgccactttgtgagagcgatgaataactactactcagtcatatggctactaccgggcaacaaggaataagttatgttatttgtacaacgctaatgagcatcaacgaattgttttcttgcgggaaggaggtacaacaactgaggattggtgagtttttagagtgagccccacgttataccctaccatcctgcacaaacaatgtggcgttagtatcctgctactaccgcctggcgtgcggacccacgttactaccgaactcagtcataaacattgggcatgccctaatgtcatgactcatgaccaacgcccgtcatctcaccccttccgagaggactattcgcgctagctttgtcaggatcgtacctttcaaagcgtcgcgaccctcagcagagggtatcatagtttcatcagctttttagtgaggtatggacgagaagccgcgttggggagatgcctcgtcccgagttgtcgcctcgcgccgtggtagaagacggtgaggtggtggaccgaatagaagggtctacccgcgaagctccaccggtgaccgacgacccaatatgccactccgagaatttgtgttgttagttgatgctgttgaggttgagttagttcatgaatcatgccgaactagcgtagtagtagtcgcatgatgttgaggtgaattagtgtccgagtcgtactgttcactggtccagtagctgatgctggcatagtctactcggatgcgtccattcaatgtaaatccatgtgattcactgctcaaaatcatatgatatacgagaaccataaaatgatttctggctaatttgtttcatttgtagctgttgatttgactgtaaacccctttttaagtaagattcactctaggccaacttctaacaaacattttcattttaaaatcggataaatttacagctgggacactttaacgctctcaactattttatccatacgcactagttatcgataggtaaaaaccaatgttatcaacaaccgtttgtatgtttgagaagagagttaagtggtctacagtgaaacaaaacaaaatgtaagatttcctgattcaaacatgaatcaatgggtagttcaaaagtgaaacaactagaatattcaacttacatgtgaaatttatttattgtaggcctcatgttctctctccccgccctcctcatcggcgcctgtgccttcgcggcggcggcggttgcggcgtccggcgacggttgccgcgccggctgctcgctggccatcgccgcctactacttctccgagggttcaaacctcaccttcatcgccaccatcttcgccatcggcggcggcggctaccaagcgctgctcccctacaacccggccatcaccaacccggactacgtcgtcaccggcgaccgcgtgctcgttcccttcccctgctcctgcctcgggctccccgccgcgcccgcctccaccttcctcgcaggcgccatcccctacccgctccccctcccccgcggcggcggcgacacctacgacgccgtcgccgccaactacgccgacctcaccaccgccgcgtggctggaggccaccaacgcgtacccgccggggaggatccccggcggcgatgggagggtcaacgtcaccatcaactgctcatgcggcgacgagagggtctcgccgcggtacgggctgttcctcacctacccgctctgggacggggagacgctcgaatcggtggccgcgcagtacgggttctcgtcgccggcggagatggagctgatcaggaggtacaaccccgggatgggaggggtctccgggaaggggattgtgttcatcccggtgaaaggtgagtgctactggtttctcagtttgattttgactgttttagcttgtaactgtgagttgcgagaggttttggatgataattgagcatgtgaaaaatgtgaaatgtgaagtgcggtttggattacagtggtttttgcaggtagtttgtgaaaggaagtttggttactgcttgaatgttcttagcatatttatcaatgattggaacttctgagctatgtgcttcttcttttttgctctgctgtccaattttgcttggttgtatttgtgattgatttaaagcaatgcagtaactgagttttggttatacaaagtttaacccctgtcgtatgctatttcacatacacagatcgactttgtgccatggtatgcagtagttttcatgtttcgggagtggtaatctatttgatcctgcatcatggttgtttgaggcatcatgaactcatgtctatgctacatagttggtacaatggtaccggagagagtatcatgcaagtcgaattgccacccttttttttactgatacttgataattagttagttagcataaccagataattaacacaactaactgcaatcattcttcagaaaagctcaccactgtcatttgcttaatctcttctcttaaaaaacagctgttgtcaacaattaatcttctaggtgtcaatctataattctatatatgctaacatcctttactctgttatttatttccagatccaaatggaagttaccaccctctgaaatcagggtaagcattcttcgactgtcaggtgaaattacaactgtgatttcctttattattttctgatatgtatttcttgtgcagtgtaggcattgttcttctcttctgtgagctcttgtgtatctatgctaaggttatcaagaactaaagtgggtattgtcatgaaacactgatgttcaactcacattcttctaggtggaatggggaatagcctttctggaggagcgatagcaggaattgtgatagcttgcattgctattttcattgtggccatatggttgattatcatgttctataggtggcaaaagttcaggaaggccacatcgcgtccatctccagaagaaaccagccaccttggtaatgataaacctcctttcttggctgtaacactcctctagatcaactatgccaaactgttgaacatattacatgctttgtaaagtgcttctgttgtgattttggtatatcagctgctattatttgtgtggtaagtagcttagctagtcttctttttatcattgtacaaactgtatgatttctctgcaaatgctacaactcaaaattaatatgccttgtcaattacagatgatgcttcccaagctgaaggcattaaggttgagagatccatagaattctcatatgaagagatttttaatgcaacacagggattttctatggaacataaaattgggcaaggtggttttggttcagtgtattatgctgagcttagaggcgaggttggttcaacatttttctcatcatggacaacctatcagagtgcattcacacataaatcaataaggaggacacaacattttgatgtgcattcttctatcaatttgaaatgacttctctgctgccttcagaaaactgccataaagaaaatgggcatgcaagcaactcaagaattccttgctgaactgaaggtcttgacacatgttcaccacttgaatctggtgggtggtcttatgattttctgtaataatataacagaaataatctcaactaccaactgaactttacattttgctatgcttacttacagaacgagaagataaactttgattagagtttagtaaagaccataatacctttcaatagggcacggcatcatatttttcatgttggaatagtactctcgagtctctgtactcgagtctctgggtgtactttgatatcgcctaattgttcgtcatgcaggtgcgcctgattggttattgtgttgagaattgcttatttcttgtctatgaatttattgacaatggaaacctaagtcagcatctccaaaggactggtaattgtttgtttgaatgcactctaagtacaatgagattatatcctaatgatttctgtgaattattcagcacgtgcatttgtctataggttatgcgcctctctcatgggctaccagagtgcaaattgccctagactcagcacgtggtcttgagtaccttcatgaacatgttgttccagtatatgttcatagggatatcaagtctgcaaatatcctattagacaaggacttccgggcaaaggttagaattgttcatgaaactctatgttggcctcttatcttcaatactcaatttcttgtttgaagaaagggtgaagggcatcacctctttcatttataggagatgcatgaaatacagaaacgcaagtttgttgttatcctgagaatatatgtaggaagaactacttatcttttatttaagaaaaactaaaacaagggtgtttctcctctatgattaaaagaatgatctcctctaagttaatttttttctccttggaaaattcttcagttctgagctttccatatcttccaactaggctggatcaccaacctgttgaaaccatgccagtctcccctttggacaaatctgggggctgtttaacacctcattggttcttgatgttgtatagctggcatgtttagggaatctctgagctttgaccacacctgcaatatatagggacacattttagcgatgtttgttgctgtttcctccacacccccataaagtttttaccatgcagattgctgattttggactagcaaaacttacagaagttggaagtatgtcgcagtcactgtcaacacgagttgctggtacatttggttacatgcctccagagtaagtgcttgtagtctctctttatttttttctgtgtactaactgacgcatataataggccatacatcatatatcatttataggcttatagcactatctgctatactgatacctatttgcaactagtacagtttagcaccaaagttgtatatggtttacttcccttttttttttttgaacgaactggctaaaaaaagtatagaaattaattatgagctccttgtgtttaagggtccacattgctgactcttccttgatttttgcaaatagagtgatcacttatagctccttgtgttggaaaattctgacaatatttttcagagctcgatatggtgaggtttctcctaaggtggatgtctatgcttttggtgtcgtcctttatgaacttctttcagccaaacaagctattgtgagatcaagtgaatctgttagcgaatcaaaaggactggttttcctggtaatatttttcctgctatcaaattgctgtttttcctgttgtcacttgtaaatgttaaccagaattcatgccatgtgctacaattaaatactcagatcaataaatttaccatccttcttccaatagaaaagtaatttcgttatcagtgtatgtaactacgccgatttgattcattaccaaatgttgtgaatnnnnnnnnnnnnnnnnnnnnnnnnnnnnnnnnnnnnnnnnnnnnnnnnn

SEQ ID NO: 32489 - DNA, 2299 bp, Oryza sativa
  unsure (1)..(2299): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttgttttgagagatggtacctgatgtgatcagttgccttctgaaattcatcaggagtcagtggcagatagtccgaaacaaagtccgtctccaacgagcggcgatagtacccagctcctttgatggccgttgccagatcaaattcagcttcctatccaatattttaaggagttaacatggacatgccaaagatgaaaatagtgtcaaagtaggcttaagcttaacatggacatggcaaggatggacatagttatctaagcaatttggactacggatggaatttgctcgatgtgtaggacaagaacagacttgaaaattgaattgacaaataaaaaacactttttctcttccttggaccagtgagatcttaacatcaatacattttctaagacgcctggaatatgtaatgcagagaaacatgagctttcataccagcaatattttgtgaccgttgtctttgaaattacggattctgcatttctctagagcgtcacgtagcctttcagcttcttctcggcttggtagcagttcatcattccaactggaaaagaaaaggagaatagaatcttcagatccagtccgaaggaggaccataagtttcagtattacttaatatcatataatccatggaaagacagcatcaagagcaatgtgcacattgctaattgcaaggacatgataaaagttatcaggagctaaacatacctagcaagcaccaaagtctgcgctttaactgcatgcaaacgggaattgacaaatgatgacgctgttctcagcattttcaacttccaaacaatagattcctttggcagaacatcaagcaaagactgcataaacaagggcataaaattagtattatgatgattcagacatgaactgacaaagaaattggagcaatggttagattcgagtctcaccataagagaaggcaatagactagtggtgatctctgatagtgcttgaccagcttcttgaaatgaaaaaccacgcccaacaatagtcgacggtatcttcatgaagttgcctaaaaacattttttggtcactaataagcattacatcttataatcagctataggcgaagcgatgggtgagcttggcttcaaatgagtctactcattaatttcataaaggctcaaagtgcagaaaagtgagctaaacatgcaattatacttcttccccagttgagtaaaataaaatcatttatccatcaaacaagtcataaatattctcatagagaagttaaccgaacctgtcaggaaattcagcaactgcggtgtggttaaatggaacggttcagggaccaaatccaagaagactgagagagactgcagctgagacttatggaaagatgttcctgcaagaaaaccatacaacagaagataagtcagtaatcacttgtcactgaaagaagataaacagagaaagaacagaaaactatggctaatggcagcaagacctgggttgactaggatcaataccaaatcgatatctggatttcgcgccgccacggcaagagcaatgcatgctccaacggattctccgactagatagactggtctgtctcttgctctctggccctctgatttcactgcactctccacatactcaactagtcctgtattcattactacagtttcagagtttttacaaactatataagtttagtccaaaaaatgagctaaaaacatggtttcttatgcatcatattcttacaggaaattacgataagttcaagatcattaaggtttatatacttatacttcttaaactacaagcacatgagcatttctgtccattctttgaattataattaggagcatatgggaagtagacactacttcatttatgagaagtagacatcaagaaagtgtaccttcaaaggacgtacaatcttcaacaggtatatgtaagcaccacatatcaaacatcctgcaaagcagaattaattaccagcggtagtgaagataaaacagccatacattatacataaaattgtcattactttgctaatctctcatgatgccggatcagtcctaagccaactccatcaa

SEQ ID NO: 32490 - DNA, 4674 bp, Oryza sativa
tggaacccaagtaatgaaaggtatgaacatatattctgacaatccaacccataatgcagtaggttgcatttccactgggataagactttcagtactataccttttttaaaacacaaattttcagtactatacttgaatactttaaaaaccaaatctctaacccaatgatcctaagcctgaatccagactttgcaagcatgtctgctgcatcaaacagtcagattaacagtgagtctctgattatctgtccatccatctaatccagccacttccaatggccatcaaccaccagtaaacaactgagctggtcaagaaagccagtccctttccccattctactaatattggcctactgggagttttcgtagtggcttgtcaaactgcttttattgtttatggtttcagcattgcagatcttcatgcgagcaattagaaaattttgtttggcatgatctgggtgagtcaccgaatcgccgacatgttgtctaaattagtgctgctgcactgatcttgatgagcttaaatattgccaattgccaaaggtggttggtcctgctttcaggcctaccctacaaccctctggtttcagactagaaaatcttgcatgattaaatggtgtcaaaattgaaataaaaattcagggaaaaaaaagggggtactgttcaaacaaattttcattttcaacacacccacttggtactattcaatatcatgctttgtcagagtttcacaagataaacagtattcaaacacatgttttacttatttatttgacaaaaaaaaaaggaatatgcagacacacatgattaaaaaaaggaaattatttttcttttttttttcagagagaggctcataccgggcaagtagagcatcgtgggcgcgccgggcagccgccctccgccgccgccgcactccagcggcgagaaccacctcgccgggccgccgtccggccgccgcaccatctcccgcgccgcctccacgtactccctcacccctctcctcgccgccttcgcggccacgccccgcgacgccgccgacgccgcggacgcgctccaccgcccccgcggcggcgccgtcccgcggcgtggcaggccgggcaggaggggccgcggcgctgccgccaccgtcgccggcatcggcatgggtggttgcgcggctggctcgacgtacggtgacggcggcgcctctggtcttctccttgatcactcgcgcgcgcgcgcactcgcttgcaacgtacgtgtcgtgtcgccgtgtggctggagaagaggaagaagattagagaaaagtaaaccggcctagtgcactgacagcactgtgctgtactagtactcccgccatactcgtaaatactcgtaatggaaatcatttagaacagcgacacggtattcaaaacacaactttgacttcttattcctataaaaatatttattaaaaagtaatatatgtatacttttatgaaagtatttttcaagacaaatctatacatataatttttacattttcaaacttaacaacttgagagttattcataatttatattcctaagatttaatttaaatattgtcctaaatgacttcctttattagtatggagggagtatatgccgtatatatataactaggtgaatatctcgtcacgttgctacgaaaaaattaagttacacggtatatacagataagacataatatgtttattgaaaccaaaaggatgcttcgtatgttttacataatttgtatatggttgcaaatatagtgcgagatgaatatattttatgtctaattaacacttatcaattttgatctaaaaataattaagaaagaagaaataagagacaatttaaagcataaatctattatcaaaaactataaataattgagatgatgtgaattaatgagagaagagataaatagtattatatatgaaactatatttagtgggataataactatatactaagtatatagaatatggacgcacgctagcaatgaagtcaaatgagagaacgatgaatcaatcaaacagttaagagtatatagaaatactgacttgaacatctcaactagaactagactgtattaggtgcaaaatgtctgcatatacagaaatgggggctgctaccccacggaataccgtggaaatagtgtactcacgggataattaaaaaagcaatgacagcataaaggagcaccccacagaacacgtgatttgtctcaatacctagccactgtctgctcggtatcgtcgccggagcagtggctaccttacctcgccggcgtcatcgccgaagtagcagctacctcaccgccaaatattctccttgttatcgcgcgctcgggtgatacctcgccggcgtcgtcgcccctgagcacccagagtagcagctacctcaccgccaaatcctcctggtaccttgagtaaggtaccgaggtggtacctggtacactggtattggctggtacctggtaccctgggtatcgagctggtacctagatatcagaccttggtacctgggtatcagcatgatacttaagagggaggaggaggaggagtcgtggggtcgggaggtcctggtaccctggtatcgactgatacctggtaccctgggtatcgagctggtacctaggtatcagaccttggtatctgggtatcagcgtgataccctaagagagaggaggaggaggaggagggggaggagtcgcggggtcgaggaggtcgagcagcggggcggggcggcggcggaggaagaggaggcgacagatctggtgcctaccttgtaccatgcctccccagcctcctcagccggctgtggacgacgatgtgctcggcgcacccctgccgccggccatggaggtcttcatcaccaacgatgtagcagatccgcttgctgccggccatggaggatgccgccgcaaccgcaccccgttccggctccaccgcaccccgctcccactctccctcttgctcaccgcgctcgctgctgagctcctcgccgttgcggcctccctcgcggcggcggccgccggctctggtgagcagtgggcgacggcgacagggagggttgcagtgccgtctaatttaggggagaagagtgaagtaagaggaggcgacggggaggcctgcaacgccgtgtgatttgggagaggagagtgaggtaggaggagaggagtgaggtaggaagaggggatcccgtctccacaggatgccgtgttgtaggttttctgtacagaaattcattgaaaatcaaagggaaaaaaatatcaaataattgctcccaaaaaaattgtgaaagtgagcaagtacgtgcatcactgtttgcaggatgcacgcaagccacataaaccgatctctctctttctttttttggattttggtggcagagtcaacgtagagagatgggtaatcaagcagttgccgattgagtgaagtaatgaagttgagttaacctgacagatgaattggcatcttcttctcccaaaattgttttttatttttattttcaaacagaacaatattactattgatcaacacacatagtcgttttacagcaaaagcgtataacccatgaactgatcacaatcaacaaagctggagacgtcagaaacactttgtgattgcgatgggagtctgaaccaaactctgaagaagatgtcaccctctctgcaatttctatccgttcgatgagttggccgaacgacctgagccggatatcttgttgggcctgaacagtaacattacgtgcgtgaggcccattacgattgggccggaacgagattgccacgtacgttctagttgggtcggaacgtcgcaatttcttatttgggctggtacttgcctacaagcatagtccagctacgctcgcatctcaatcctgggccgatcagttggatccaacggtcagcagcatcgctgaagggcgttaggagcctaggacccacctgtcagaactcaaaacgacgaggggggttcaagtgcattacccgcgaacctacttataggtaaaaataagtaagttcataggttagttttgcttataagtggattttcacgggtagccgcttgcacacttagggaggcccatactacgggctgcttcgctttgtcgccaattctaactgacataaacaatttgtgagagaaaagttccgtaactaccaaatattaatacaattgtatttataagataatgtttagtttgctaccctactaaagtttagtggggttgaaagtggcaacaaaattacaaacaggtcctacataacttgccacattttcaggggctgcaaaaacttctgagtggaataataaccatacaacaatccctcaaaaagtcattcaaaaaaaacttgtcattaaaaaaaaacaatccctcaaaaaaaaaaatacaacaatacaagatcatggatgtgatatcgtatgtattctactactccaggaaacaagtttcagttcaggctattcacaaaaagtgttggtgatgcagcatctccattcccccagcaataatccccactgaactgacgttgttgaggatgtcgctggatttcagacatcgcaagcacattttcagccgccgtcgccgccaccgacgttgaagatgtcagtggccctgacgaagcgccctttcacccgcgtcctcgtgtcggctctcatcttcctcgactcgtaccggatgtg

SEQ ID NO: 32491 - DNA, 2205 bp, Oryza sativa
ccaaacatggtcagaaaaaaaggctagtgaaaaccatgcctgcgagtctttctcttttctctataccgttgcatcgcgttgtccctgttcatggcgatcgttttgctgtcgatcttcagggaattcctctgatcagctccagttacagtttgatcagtgatacagttctccccggcaagaactgctgcaacttcttcaggagaagagttcagagttctatcgacgtcaacgatcctcgaagatgatggcccgtcatttgtcaatccgtgttgctcgttcttgtgtcgcctgttgccggatgtggcagtgctcagctgaaaataggtgcaagaatagtgacttgagtaactcaattgccactgtcaacaacaggatcaatcgatgggtttctcaacggtgtaaacttttcacagattaagttggctgtcagtgtcacattgaagagcatgaggtttacattgctaaacggaccaagagcaaaggatatgatgagtatgtgcatgatggcccatagtggtgacagcatccagataatatcttagatcagatcggagcacatggtctactctgtcaatatcaatcctttagacgataaggttgattgataaaaaagtctgaaacatttatggactgtgccttaacatcaatgagcagctatatataatcagaccgcaaaggtgtatatatattattatatatctaagatcaagagcacgaacctctaaacatatgaacaagagcactgcacatgaatgggacagtgatacatccctatgcgcacagtacttcacttatatttcagtataattttagagttcgtaaatatcacacaagcatgaaaatatacagaaatttcatctgtgaatagcaaaaagattgaaatgtggattacctgttttggagtcaactggtagatattggccgacacaatatcttccgtggcaaaagagtatgtcgagtcataaatatattgaagatctttccttgagctagaggaaacttcctcaatcatgtcattataacttttgatcataaagcctccatcttttgggccgaaatgaagttcaagtgcagagtgctcatcatggtcccttgattttcctagattaaaatcccatatctgtcatgccaataacaaactctgatttcaagttgtctaactcctcttttttcccatgaaaataagcacatagtgattgacacaagaagaatctgctttctctggctgtctggtaattagacccatgactataacataatagtcatataaaataaaatttccaggctagaagtgatcttaccaaaaaaaaaaagaatctctcttaggtaatactaatgcagctaatatcaacaggcaacaggcacatttgggcttgagaaaatggtcggagcacaaactgtggatcagcatgaacacattattttgcttccatgccaagttttcagttcatcctctgatcacatatcccatttttattttgtgggttacaagtttactactactaatgctaacttattacagagaaaaatcagaaaacacagctttttgacaccataccacagaacaatcagagaaaaaaatttgatgataatcaaggaggaacttggttatcaaataattagaagaaattgtaagcatgttgagaatttgacaatcagagtatgagaatgagaccatgctatcacttgtaataaactgttgaaataatggaagcaaaaaaacacagtctctttgtcactacctggcatggcggatcggagggcgcggtgcgctgccacacgagttcgttgtcgtcggtgaactgctcgccgttgccgacatcgccgcagcccgccgcctccgtcaccggcgtggacttgtacggcaatgtggccctttgcgccgccgccgctgccgcagcctcatggcggattgcagcggcagagccccggcgagctgatggggagatcgatcccgagttcgcctgcgccggcgcggattccatctcacgccgcgccagctcggcgagctggtggcagagcgagtcccctttgagccgccgtccgcgtccgccggcggcgacctccggcggcgggtcgcagggcacgtacatgtcccgcagcacgcgatccgccgccagcattgggtaaccggcctcggggaagaacggatcctcctcgaattcatctcttccgccgccgccgccgaggtcgagcccccacgac

SEQ ID NO: 32492 - DNA, 3573 bp, Oryza sativa
ctataaactagaaaagtgaaaaccaagataaataaacaacatttttacttcccattatttcaacatgtgcatatgaaacttagtctaatggctatcgtatacacttgcaagtacataatttatttttgttttacataaattgctatccattatctataaaaagaattcattgcacgcaattttttctcttatatatgtgaatgagggagtataattgtcatttatcaatagagttgttggttatgtgagtttaaggataagtttaaattaaaataaaaacttgaaggactaatatggacagattagaacatcaagaactaaaccgagcctcgcatgaaacttggaggaccactttgactattcaccctacttttttcaaaaatgtcgacacataatcaccacttccttgccacttgaaatttgaaaacacaactatccacatacgttgctcctgttatggaatattatctcccaatgagataatatcctttcttgtattataatctaaaccgaagtatagataagatctatttcctcctaagacctccctatatatacagggacagagtgagatatctaaggttgatttgtactccagataagatttataatgaaaagagagctccaccctacatatgtgttcattgtctatttctacaatgttttctgagggcaaagggaagggcacggatgttctatatcatctcacacgtctactgttatgggagctgagggacaggaaacggatccgtgatccgctaatgaacgcgttgatttacaacaactccaacatttcgaatcaaaggtgggggtagcttagcaatggtagcatgatgggccgcaggaaatggcgggaaagataacgaggaacatatcctgcgccctttccgataatggaaaaaaagagaccaaaatgggctcgcaggatcggatcggatagcagatcggtcggtggtcagctcatccaatccaatttctctttaattctgcaactgcgatcgctttcagtgtcaacttttgcagggtataaatcgggcaacggacggagatcttgccagcccaaatcaggaaagtttctcagcgagctagcagctatagcttagctggagatcgatcgagaggtagaagaagaagaagaagaagaagaagaagaagaagaagaagaagaagaagaagaagaagaagaagaagagaggcctcgcatggcgatgagagctcgcatctggtagccaaggatgacttgcctgtgtctctgctcatgtgcagtagaagaagatgcatttctagctgctttctgcatatgtgatctcacaggcagtctccttggctagcctgagcggctctcatccttcatgcctggctcatctcttcttaatgatctcttattagtcacagatcctgtagagattagttgatgtttgatgcttgtccacttcagtgccacacataaacatagcggccgtgatcaactgatcagtccagcctgacagagaattcagagagcatgacaagatcagcttctgacaaaccgcgcgagattaaccaacaaatgtattcagggagaatatctgaattgcattgcactttgcatgatcgggacattctcgttaatttcataattaaaattcagatgctctctctgtacgtaactacgtataatactaatatactttgctgaattgctttggttcttatttgatgtgtgcaggcaggcaagatcaagactacagcggtgcgtgcttcctgaactgcctgtggacgaagacgaacagacaaagctagtgatcgatcgatgctctgacgacagccactcctgcaggctgcagcttatgcactggtgcatctgctagatagagcctaggagagtaggaggatgcacttacagagagacagaatgtgttgttctctgcttaatttgttagttaccacactgtttaattcctctgttcaatgggaaacttcgtttagggtgtgtttagttaacgctaaaattaaaagtttgattgaaattggaacgatgtgatggaaaagttggaagtttaaagaaaaaagttgaggactaaaccaggccttagtttgttcctagtactgcatcaaattttgaaacttttagggcctgtttagttcccgagagtgtcacatcggaagtttgaccagatgtcggaagaggttttcgaacacgaatgaaaaaactaatttcataactcgcctggaaaccgcgagacgaatcttttgagcctaattaatccgtcattagcacatgtaggttattgtagcacttatgactaatcatggactaattaggctcaaaagattcatttcgtgatttccatgcaaactgtacaattagtttttgtttttatctttatttaatgctccatgcatacatgtgtctaaatgttcaatgtgatgtttctgggaaaaaattttgggaactaaatcgggccttagtcagttagtcctcctgtgtcatctcatagacactgaaacttgtgttacgccaaagcaaaactatcaaaagatttataaagaacaccttagtacgcctcgatcatggagaagtcaatttagggcagttggtgaaatgaaaattttatgatgtcacatcgaatgtttgaccagatgttggaaggggtttttggacacgaaggaaaaaactaatttcataactcgcctggaaactgcgagacgaatcttttgagcctaattaatccaccattagctcatatgggttactgtaacacttatggctaatcatggactaattagactcaaaagattcgtctcgcgattttcatcataaatgtacaattagtttttttcatctacatttaatgctccatacatatctctaaagattcgatgtgatgtttttggaaaaaaaaaattggaaactaaataggcccttacaatgtaaatgcatgtacgcctatacccctattgtcttgtttgctttgagatttgtgtatgtagcatagatttcaacaaatcacaatattatattcctccttttagtacatcacgaatttcaataattcatcaaatgcatccaaatatagggcacatacacacttgcgttgtaaaaggtatgttccctcgacaattaattccacgcacaagagaaatctctaaccatgaagtagtgagaatcaactatgggggctccctcgacaattaattcgaagcacaaaagaagatctctaaccatgaagtagtgagaatcaactatgggggctccctcgacaattaattcgaagcacaaaagaagatctctaaccatgaagtagtgagaatcaactatgggggcgtttagatccatggtgtaaagttttgacgtgtcacatcaggtattatatagggtatcgtatgtggtgtttgggcactaatgaaaaaactaattacagaatctgtcagtaaaccgcaatatgaatatattaaacctagttaatccatctttagcaaatatttactgtagcaccatattgtcaaaacatggagcaattaggctaaagattggtctcgcaaattagtcacaatatgtgcaactagttatttttttagtcaaaaactttt

SEQ ID NO: 32493 - DNA, 8289 bp, Oryza sativa
  unsure (1)..(8289): unsure at all n locations
cttgccaggatatgcacggaccgtgcatatattccccgctttccaaattgggcaagattgaaaaggcgccttcagggcttgaaccgaatccaatccttgtaatttgtaaaggagatcaggagagtggatcaaattattcgatgctgcatggacccttctctccctgtcgagatagatagatagatagctccgttagcttcttccattcatggctgtctctcctgcttcagattgctataaattggccatgaacttgcagtgtttttttcacacaaacagagcccaaacacacacaagaggagagagatgaaatatgataagagtctgtctagatagccaaggatgacttgcctgtggcctcttggagagagaggtgtagcttaattagcagcatggtttgagcattgcttgatcggttgatcgcttcgcttgctctgcatgagatcttacaggcagtctccttggctagtctgggcggctcttatccgttctagtacaacataggcattaggcagcattgcagccttgcaaagtgcgaacagcagtcacctttgcagtgttgaagcaatgccacatataaatttagaaattttctcatggtttatatggttaattatagtcgttaaattatttgggagacgaaactgtcacatatcacaagttatatttattagtagtagtgattttcttatggtccgaggttatattaccatattttcgcaaaaaagaaaatgttcctctcaaggaccgtaaaatttccttgcatttatgttttttgaacttctgttgatgatatgcaaacatataccaagcaattctagagatttatgtgttatataattgactcaaaacaagggtttgttcagcatttaggaaagaggttactcggcggtatggcacttgctgtgaaaaccaagaggttaaggttacctataaaatcgagagggttacacaaacacccgtgatatcacaaaccctagggttgtagggcaataattatgggggtatgggtattacgacgtcaatctgtgttatctgaactctaggtgaagatataatttagagcatccttagtggttcatccaaatctgatcctccatatacttatttggatggtcatctaaaaaagattctcactctgtatcccttttcactccaaccgatcatccatactacatccttcatatcacactctcttatattaacatctttcaactacccatacatttgtactatttttttcgtaatagctaaattttgaatgactaaaatttaacagtgttatttgtagtggattgttttaaataaatgactctatttgaatggatatatttttgataggtaattttttaattgctatatttccaacggattggtattttttcaaagactaagttgtaacggcatattgcatatagccgaggaggagaggcgagtggctaggcgttggcaggtgcagacggccgacgacgggagccacatggcgcattgggcaagggtgggagcaggcggtagatctcggagcaggcaggcgtaggtggctgacggcaggagttggcacgagcacggaatcagggccaacacataatctatccccacctctaacgtagtcttcataaaaaaaacgttggaaaggaaggtgggagcgggagcttgcaagatggtgcacatgctatttttggaccatcgggtggagtatttgctggagcctggttttcttctcaagtaagctattttcatgatggaggatgggatgaagtatcttctaggaatgatcttaagtgtagcacgtagtattttcctttacattttcatgctttatgtgcatataggcacacatttttactatcgcacaaacatgatagagtagagaagatagaggaaccatctataaataaagtagagaaactacactagtttaaattaacacgggtttttactatcgcacaaacatgatagagtagagaagacagaggaaccatctataaataaagtagagaaactacactagtttaaattaacacgggtaaaaacttacagatacaagaatctttgaatttttttcaagcattgcactacagataaaaaaagctttgaatttaaattctggcactgcagataaaaaacacatgctacatatacaagaatctttgaattttattcaagcattgcactgtagataaaaaaagctttgaatttaaatgcaatcactacagataaaaaaaactttgaatttaaattcaagcactgcagataaataaagaaataaatctttgcatttaaattcaagcactgcagttaaaaaaaactttgaattttattcaagcattgcactgcagataaaaaaaagctttgaatttaaatgcaatcactacagataaaaaaacctttgaatttaaattcaagcactgcagataaataaagaaataaatctttgaatttaaattcaagcactgcagttaaaaaaaactttgagtttaaattcaagcagtggatataaacttcagatacaagaatctttgaattttattcaagcattgcactacaagcactgcagttaaaaaaaaatttgagtttaaattcaagcagtggatataaactacagatacaagaatctttgaattttattcaagcattgcactacaagcactgcagttaaaaaaaaactttgagtttaaattcaagcagcggatataaacttcagatacaaggatctttgattttattcaagcattgcactacagatttttaaaaaaatctaatttaaattcaagcataaagcataaattaaaagcactgcagtttaaaaaaactttgagtttaaattcaagcagcggatataaacttcagatacaagaatctttgattttattcaagcattgcactaagattttttaaaaaagctaatttaaattcaagcataaagcataatttttttaaaaaactaatttaaattcaagcataaagcataattttttttaaaaaaaatctaatttacattcaagcatgaatttgattttattcaaacattgcactacagattttttttaaaaaaaaataatttaaattcaagcataaattaaaaaaaatataatatctgatttaaattcaagcataaatttgattttattcaagcattgcactacagatttttttaaaaaaaataatttaaagtcaagcataaattaaaaaataaatgcgttagaaggagggcttgaacctccgaccttgtggttaacagccacacnnnnnnnnnnnnnnnnnnnntccagcttttgtctcttaaaccacatccaccattttctcctttgatttcttcatattgggccagacatgggcgcacgcgtacgcatgggctcctttctcgctggaaataagttcgctttatatccctcatcttgacgtcgagtttgtattacttccttaaccataatgccagatataatgtatccgttaacttacaaaaccgtattaaccaaggtcttagggtaatattatatctagtttggctgacatggtgagctgaattagtgtgggaccacacgggtctaacatgccagcgaccggttctttcttcctcctctcttcctctctctctccccatctctagagcgacgaccaacggagagaagggcggtgcgtggtgagcatcggcataatccgacagtgcgatgtggccagcgacacacttgccgagcagcaacgcgtcctcccactcccgcgcaagcaatcactccagcccgacgtaggtggaggtgttaacctggttttccttggcggagtgtcgcttcctcaagtagaaggcgttctcggtgaagcaacggctacggatgtgaacgtaggacttggcctcgcgtcgcacgtcgctgttgccctcgatgcagccacccgacaccttattgtgtttcttctcgtagccaacacaagatttttgatgggttacatgtggtccctccgtttcacaatgtaagactttctagcattgcccacattcatatatattagacatatatatatttagattcattaatatctatatgaatatggataatgctagaaagtcttgcattgtgaaacggaggaagtattgtccacattcatatatattagacatatatatatatatatatatatagattcattaatatctatattaatatggataatgttagaaagtcttatattatgaaacggaagaagtattgtactattgtggttcaaggatggtttttaaactcgcactcaagtgattgagggatctttggtgaacttattcctttctcgctgccccgagcggagcagcccacttgttgggcctccaccaccgccggtccggcccaaccatcccggaatactcgttgacatcgcgatgcgtcgtcgtcgtataataccacagatacgaatccgctcgccggagtccacggggagatcggagcctgcaaggcaagcaaccaccgccgccgacgacgacgacgttgacggcgacgaggagacgatgagctaccagaaagtgccgcctcctcaggacggctaccctcctccaggcaattccccccttccctcctcccccggatccatccctcgccggaccgggataatcacactgcggcggcggcaggggctttcttgatctcagcctccccctgttcaggatccccattctgttctgggttgatttggatgcgtgtccgaaatctgaatctgtgacggcgcagcatcgggtgtcgccgaattcgtgcccgattatctgatcgatttttagggtcgttcttccgtgatttctctgatcgattcttgggctgtttgtttctgtggatgcagggtactcgcagccatacccgccgccaccgtccggcgggcagtacccacctacgcagtactacccgccgccgaaccagcctcctccggggtaccagggctacttcagcgaggggcagcagccgccatactactacccgcccccgcatgatccccaccaccaccatggtcaccaccaccaccacgaggaccatcaccaccacggccaccaccaccatggccaccacgacgatgactgctgccttggcttcctcagaggatggtaattcaaagctttactccttttcatttcttgccaatttcgtgtgaatactttatactttcggtgctcgtatgcgttgttaatcatggatgctctattgctctgtgaactacaagttcattgtgtgttgctgtctttggtaaatttgtttcacagaatgaaatttctaaaaaaaaaaatgtttcaaagaatgaagatctggaacaaatgtaaaacatagacttagctcagcaatctgattatgaatagacttatattaaaaaaaaacttaaatgaatgactgattttacgatatcggctggtacctccttgatgaccatgtaaaatctccaaacaacaacatctctaccatggtatatccattatagaattatatattgcttgtgcatctttggatagttaatactttaaacatcggaatcaattaaaatttctcctcaaagataacttttcgatgaaaactgtgcaatataaataaaatcatgctagctcagctgtactgtactttgatgaagtgttaattataggccaaaagaatattcagtatatggtgtcatgggcaggatcacaagattaataaattgctttcttgagtactgaggttctgcaccataaaaaatgtattgctgaatgctgagctgattggatcacatatgatctgaaatacttcttgtatgtccttcgaagttgtacatactccttcatgatgcagacaatagttgaccttggactgtgacaatttcatgaagctggtttatttttatcttccgtctctatctctatttttttaagagggatattcatccatctaaccctccaactagataaaaaccgccttccaaaacccacctcagaagaatcaccgtgacttcccactgaacaggataactcttctccatgtcctctcttgcattggtggagcttgcaggttgttgcaaagggctatctaataaacatgcttagataacttgagaagagaaggccaattagtatttacattgattccattgattaatctacatggtaaaactaatcacttatttagcaacttgccatggccaagcttggccctaaaaaggctctgccctgctctcccggtatggtgaatatttttgtatgattataggaataataatgtatacatgaaacatacaattagctaatactccctccgtcccaaaacgtagtgaattttagagttcaaacattgtcccaaatctagaaacatatgacatgtaaaaggtagcttttgccactaaactatatggactaccactactatcccttagccctattatagtctgggcctacacctcacccatcccaagaagacaaacaagtcatacatgttccgtcatatattctgcgacggtgggagtattcattttgtatcaatcacttccgcgcaccaaaagatgccatttgtaaggttccagaattcgtttttgatatacctgtgtagttttcttttaaccaaatgtacctgtttaagttgatacttttttatgtttgataaagggttttaacagaatgataattaatagatgaggcattttatattgagaagactgctgtgagtagggttcctagcttaaaattgcttaatctctgttttctttttattaggttggccattctttgctgctgctgcgtgctggaggaatgttgctgctgctgctgctgatggcctgaatgctttgaagctccttgttatcaactattcttgaatggaaaattttaagtgtgaatttgattttctgtgattgatggacagtacgtagtgtgcatcttgttattatttgtcaataagtggactctgttatctgtatatgccccgctcaaatatgaaaggtgttcagtttgtttcagagtcaataagctgattgtgctattctgtctgtccatgtcccgaactagaacgtaaccccccatcccaaaaggaaaaaaaaaaggctatcggaagttttctcagtagtagtggattgctgagatagtgtacagtttgtctaaagaatttggggatggttgtagttctaaacttttgtgctattcgagaatcaaaataaacccatgatcagattaaggatgttcattacaaattgacaaacactgattttaaaacgaaaaaatttagaaaaaaatatatttttgtaggaagttttttgacaaaactcagcatatgacaaaatttatgttgtttaattcacaatcagcaatggtttcgtggtgtagttggttatcacgtcagtctaacacactgaaggtctccggttcgagtccgggcgaagccatatttttattttttactctcatggaccgtccattttaagcccagtagcttttaaaaaaatcatgggccggccggccgtcctactgaaagcccagtatcgtatgttgcgtggttcaccggtgacctactcggcccacgggttgatataagccggcccaacccaaaaaactcttacttctgttgcctcccgaagcatctggagaattggaagactggaaggccgacctgccgctgccggaaaaccccgccccccgcgccgccgcttcgatctccggctcccctccgccacttcccttgcctcccccacctcgggtcggccagttcctcctcgcagttgacgagctacctccggatcgagggtgcgatcctctactctcttttttttgttctactttcgcgagctgatgaaactcgagatgaatccgcgtatacggcactcttttacgtttttggagaaaatttcacccgatttgattgggttagcgattctccgtggggttttgagcgcaactagggcttggggttgggaggacagttcagggatgatgcacagcccctagaattttaagttaggtgcaatggttaggtcatgttttctgaatttagattttcgtgacgtttttaatgtgagccgatgatagttgtatgtttgagagcttttctgattgtttgatggggaattagaggagagatgctaaatagaagaggggctgcgattatattgttttattcaaaatttggattgtttgatgcaatgaattgcctgcctgttaatttatgaaagatagaaaatgctaggggatgagcagaacgaaagtgctccactgtactgctgcgatttatagtgttcatgcatttggatgttcctagctgacacagacaaactttgaattgcagagaggtgttctcatttgtttgg

SEQ ID NO: 32494 - DNA, 1977 bp, Oryza sativa
agccagatctgcacatgggcaattcccttgactcaatatttggtttgtgacatatgcattgaatatgtgttgtataatctacagagccagcttaactgtttaactaaatctgagttgcttgcccccccccctcctcttttattgaaccttgttcagaaacgaaaatgtgtttccattatcacatttgggactactgttgaccctttctcaaaaccattcacgtgcatagcttaacttcacatggtctctgtgggaattttagtaggggtagttattgatacactgtttatttatccaagtaagggtggaaaacataaactaagtgtgcttcagctgtagtctatgccaccaaaattgattattaaaagctttactataatcttgtttgtcaaacatgctgatctggttatttacctttcagtgaagaattctattctatgtttacttgtttaacgccttgtctattatgcagttgtagatgggcacatcaaaaggcctcaggatgaggatatccagtctaatgtacttgaaattattggaacaaatgtgcaatcgacttacattacctgcccggctgatcctgctgctactcttggaattaaacttccatttcttgctttaatcgtgaagaatcttaagaagtacttcacatttgagatccaagttttggacgataagaatgtccgccgccgatttagagcatcaaattttcaagtatgtataatctggaattcatttttctctctgtaggcattgcgtatctacaagcactgaaagtctaaaactttcatcatgttgttctgcttcataacttgaaagtatgaaatgcttttgttcaaatttgttaattgtcctctcatggtatttaaaagggcttagtgagacgtaggttgactagaagtgatactttacctgcaacattctagttcagacttgaagttaatgttttatactctgtttattcatttgaacagtggaattcatattagaagagttgtttatttaaccactcggaaataagaaaaataatacattttctagatttgaatttgtcaggctcatactgagatagatatcagtttcttgcttcgcccagtcagcaatcagcacatgagtctcatgaacatgtgtcatgcttgcattgtttttcactagtcttatgatgtggttgtagtcttgtacgcaatttgccatgtttcagttcccatttttatatttttgtaccgcatcaggtgcaatagcatatgtaatgtttgacatggccttcttattaaaggtagttttatggcatcttttgtttctgctcttcttggaatttgaaaggtctaaagttgggtttctacttttttgtttctacatgtaatgcatattgacttgtaaccgttactattttccagtctgtcactagagtgaagccatatatatgcacaatgccattgaagctagaagacggctggaacaacattcagttgaatctctctgatctgacaaaaagagcctatggcacaaattatgttgagacactccgagtgcaagttcacgcgaattgcagacttcgtagaatttactttgctgaccgcctctactcagaggaggagctgccacctgagttcaagctctaccttcctattcaggtgagaacaccataccttctctactctgttatgaaacatttgcttgtttctgatccatctgttctaagttgtaaccttttatttgaacttcagaaggcatagaccttggagcaatcatggagacgggttcttgatcacgaaagtagccagccccaggagataccactgcgcgccctcgtgatgactcgtttaacgcgaagctattcacgcgcaagcctgcacgaaacctcagggatcttcctggttgtttgataattgtaggagagtagttagtcgtagcctgaatgagttgccggggtacccactgaccctcatctaatgcactgttactcggtgttgcatc

SEQ ID NO: 32495 - DNA, 10141 bp, Oryza sativa
cccccccccccccctttccttttttttcttcactgctatcaacagcatctcacctgggcaataagttttgttttgttctagtactaaggccatgtttggggaatttaaaattctaagaagtgaccggtgagaatctagagaagtttccaaacttttggattctagtttattttttggattctattactacagcttctgaattgcaagagaaagcttcgtagttagagattataagagaagctatagctgtcagaagctctagacctaacactgatgggcgttgctcccgttgttgcgtcgtcggcgtcgtggtagtaatcgttaggtgaggcgcgcggcggcggcggggaccaaggcgcgcgggcggcggtggtggatgccagggcgccgcgttgcgcggaccacgcggccgcggcgtacgggggcggcagcgcgggtgtgggcgtggggcggtttggatgatttggcgttgtgggcggtagttacgcgcgaggcgggtggggcgggagagggcgagttgtgtgggccgggggtccggatgaatagaataaattggtgtggtgggccatctcggctaggccggcccacatgcatgcagatggaccatgcggtgcgagatccttcttcgttcgtggctatcccgtgttcgtgtttgcttgccggtctcctctcaggcaccgtcttccgacaagctttcaggcgatcgtaggagaaatttccgcgacttcactggtggcatgtactggtacgcgttcatttacaacgtggtactgcatgaatgcgcctgatgcaaaacgtctcctaatttatttgtatagctctatacatgtttgagacgggaaagaaggagagtaagaagatatggggaacgaaatgagagcatataattagttgagtattaatttttataaattttaaaatatagattaataaactttttaaagaaaatttcttattattttttataaaagaattataccatttaataattttgtacgtgcagaacaaattaaataaatgcttatatagttacacttgaaatattttcaataaaaaagcaattcctttggggacacaagtttcatcaccgacttgctccgcctactatggtgacgacacgtactcactagctagaataagcaccccttgacatacaaaaccaaaacaaacatttatattcttgtttctgtttagttcacgaaaagaaattttttgaatgtcacatcgaacgtttgatcggatgtcggaagggatttttggatacgaataaaaaaactaattttataactcgcttgaaaactgcgagacaaatcttttaagcctaattaatctgtcatcagcacatgtgggttactgtagcacttatggttaattatggactaattaggcttaaaatattcgtctcgcgatttctcccctaactgtgcaattagttttagaattaatctatgttttatgcttccatgtatgtgcctaaagattcggtgtgatgtttttgagaaaaaaaaattaggaagtaaaccgggcctaaccccatctaggcatctacagaactctccaccaaaacccccagccgtgtcaacgtgtcgcggcaccaattaatcttggctcccaaccccacatgtgcatccctgctccaaattaaatcccccagaatttttccaaaagcaattgcccttttatcgcgtcattcctgatcattgccacgtacagtgcaatgcaatcgatcgatcgagatcgaattcgatcggaatgtcacatctcacgtacgtacgctagctcacgctgccaaccaaccgcgatcgatcgccatttagcaaacagctcgccgcccccggggtccgggcatctatggggccattgctggttaattggtgtgtgcatctggcaccacgcgcatgcaccggcggttatatccggccatgcgtgcatccatgcatggcactactactcaccggccgcggcgtccctacgtgccatacgtgtaaggaatgggagtaataatatccgaccgatcgggttgctaaacgtcgttccatggagatttttctctattttacagtactttctccgttttatattataaaatattttaatattgcccatatttatatagatgttagatatatatatatatataggtatctagatttattaaatatttatataaatgtgagcaacgctagaataatagtaaaggtactttaaacatgaacatgacttatatttttctacagttatttaataagacaaagatcaaatgtacgcacgtccattaaaaatcagaggaagtggccggcatgcggatccagtggctgccaccgtactcgcatgagtaatactgtaaaggattcatattcattagactagagtaaatcaacaaatactggtgtgagttagtcacatctctgtgtttgatccacttttattttttttaagaaagtcgggacatcttatatctgacttatattatatttaactattgtacgtaggtcaattaggagcggaggcaaacctatgatagcttgggcttaagccttagggtttcctccataatcaagcttaattcatcttaaatcaccatgcatttcctaaaaaaaatattctttgtgtcctacttaaacctttaaggctttgataatttatgtatggttccacaaactggaccaacggttactgccaactttaggatagagatctgccacgttcaatctctatattttttttattttctagagaatgcgtactttttatccagcctatacatccaaatggatatacacattattttaaattgaaaacttatcgattaactcaatctaaaattcgatcgtatgaagatttaaatttagaataattttagagtgctactcaaatcactgcaaccaataaactacgtgctcaagcgcacgtccaatctctacatacacgagtgacacgcacccatcgccggctgctagtaccgtatgcccatacacagtacgcatacccacaccccacgatggaacgcggaatgtgtatctttcgccaggttcagagtacacaagaatttttagtagcatgacgcatcatatcctcataatcatccctgtgtgcgactgattgatcaatcgatcgatctctcgatcgcttttgacgacgcaactgttgccgccatcgatcgaatcggatcggagatctgatcgatcaacgcatttgcgactagtgagagtagctggctggctggctgtggctgtatgaccatgtttagttcccaaaaaccttttcctaaaaacatcacatcgaatctttaatatatgcatagagtattaatatagataaattaaaaaactaattgcacaattagaggggaaatcacgagacgaatcttttgagtctaattaatccatgattagccataagtgctatagtaacccacatgtgctaatgacggattaattaggctcaaaagattcgtctcgtggtttccaggcgagttataaaattagtttttttattcgtgtccgaaaactctttccgacatccggtcaaacgtcctatgtgacacctaattttttttcgtgaactaaacagggcccatatatatgctgctgctgggtgggggcattagctagctgcagttcacgctgcactgaactgaaagcagatagagatggagacgcagtgcgtgtagttggaaggtagctagctctagctagatcagcagctcagctttggcgttgatcgatgatatatcgagagaccgatcgttgcaggtttgaccggcggcagaatggaatggagcatctgacatctctagctaaaagctactcatgcatcatttcttgatcttcagagaaatagagatatatatcagagggatataattaacaactttatggatgtttaggatgcaccaaatagtccattattgatcactttacacatggttattaagacatgcatgtacaatggtgtgacatagcattattcatgatgtatagcaagtgagataaaagagagaaagatgtgtaatcggcagtttaatataatttatattttgcatatatatactaaactaaatcattagctatattatagagggcctggtatatatatatgacttgtttatatatggtcgacatgaaaaagattatatgaacatcaaccatgtgaaaccgttgtccatgccctagttaattagtagtataataatcatgttatctaagcttcggtccaacaaaaaagtactttttgagataccgacatctcacggtaccaaatcattttttatcgttggatttaacaatgtccatcctgtccggttagattcaacgatcgaaaataatttggtgccatgaagtaccggtaacttaagctattttttgctggatttgagcaaatctctcttacttgtttcctatagatttctctcttttctttctctaattaattacattggtgtaggcgcgctaatttcgcattgaattggcagagaggggggggggggggggttgaacctagctatcagacacatgcatgtcgatgagtcgatcgatcgagcgagtgtgtggcctttaacgacagccttttgcataaatgcctctgaatttattcagctagcgctactgtactgcatgctgcgttcgagcaaattaagctagctgcagctagcttcgtctgctgcttagcttccacctaccgccacctgctttgccgccggcggccggccggcctcgccgcagcgggtaatgcggctttcgccggccggccggccgccgtggaatgctgcgttgatccggcgagatcgatcgatcgatgagaggcaggcagcgaggcatggggtgttcgtcgtcgtcgtcgtctgaatatgtgcatagtgcgtatcgctgcttctgaattctgatcagctcggtggcgtacgttattttgtcactgcatatatgtgcagataaatgcaatgcattgcatgtgtctatatggacatgagatactctgactgtacacgagatatacgcaaaaaagttagtgggtacagtgacggtggagctgatctcaggacagtggagtcagaaatgtattttgacccaggaaatgtgtgtgaaagcccagaagctgtcaaaaggaattaaaaaggaaaatccataccatgacacatcctgtttttgacgttctagtcttgtagtaggagtactaattaagttaattatttctatgtttgattattagttttaaaaggatttatgatttttagattcatcgtgagaaattacatttctggctatgtgaatataccggatgaaatagtaattcacaggctaggtccaaattaatcctagtaattatagaggcccacaattaatgttaagattttattatcacattggaaaccaataagaaaggacttcaactcaaataggctgctaactgagagcacctgttgagcgattgaggtggtggccatatgtcaccgtggtgggaatgtcaaacatgcgcgcgcgcgaaggcgaggcgtggcatggtgtgcgtggcgccacggagacagggtagggctagctgctcatttttccgaccgtttgtgtttctatgagcaaaagcgtaaccgacggtatcaatggtgatgttacaccggtaaaggatgagaccataatgcgtcatcaactctgtaacgttcctcttgcgtgcgacactattttccaccttcgggtagacagagagttgtctctttctcggttcaatccctctggttcttcctctcggcacaattctctactttctgttcctacgcagtttcagtttgatctccccggttttgagtaccttggcgcacaggtactcagagcgagcagatctccgaaactccgtccacctgagtacctgcacgggtaggtgagtgatcaagtttttgggagcgcattcgtgactgctctaggcactgccctctacatcacgctctgcttcctctatattgacaatccctcggatcatgtcgatcagtactggcaacggaaggaaacaacggcaatggaggagagaacggtaacggcggcgacaataccaacaacatcgccactggatccagagcgttctccaagtatgtatttgtcatctcagtgttaaacatgtttgatgctattattcttgatagcatatttatgtttatcactatgttagaatcactcatcttttcacatgtcatgtttattatgctatatttttggattaaaacatgtcgaattattattactaaatttccaacagatcaaagataaaaagtataatactctagaaaaaggataaaaatgacatgtaatttacaacggagagagtagaaccgtgacaatgctacacgattaacacttccataggcttattagcatgtgaatgctacgctatcgattaattgcggcatattaggggctcagcctccaccttctctctttacaggagagcagcgtttcaacagtagtttttccttttactttagcagttctttgtttttccttttttttcttgcctcaaggaaatggccgtccgatcgattgcattttgtaacttaaaattttagatctgctttcttctaatatactccctcctttcctaaatgtttgacgccgttgacttttttaaatatgtttgaccgttcgtcttattcaaaaacttttgtgaaatatgtaaaattatatgtatacataaaagtatatttaacaatgaatcaaatggtaggaaaaaaattaataattgcttaaattttttaataagatgaacggtcaaacatgtttaaaaaaatcaacgacgtcaaccatttagggacggagggagtattattatgcaatcgtttgcgcgttagtgaaagaaataattgcggcctatcaccctatagtttggtggacgctagaaactcatttctagcggacatgttgtaatcaaaagacacagctagcgatgaaccgagatgacagtagacagcgtcattatcgcgcggcagtgcatgttcctggccattgatcagtccgagcccaccgctgatcacccgctaattaaactcttttcagacatcgccccccgtcggcccatgcagccttgccggccggccggccggccgccgccccccggccccggcgcccatgtcgccgccacggctgtcgtcatcgcgtcgccgtcgccgtcaccgtcgctgcctcagataattcattcattcatttggtcatgaatacttaattgttccttccgtttcatattataaaccacttaatttttttcatttatttggttatgaataattatttcctccatttcatattacgagtcattttattttttttcaaagtttgtttaagtttatagaaaaatataacagagttttcaacacaaaacaaatatattgtcaatatacatttagtgctatatttaataaaactaatttgatgttgtagttgttgttaaatatttttataaacttgatcaaatataaataaaggttggtttggaaaaacgtcaaaacgaaacgggggaagtatctacgatgaaagacaattaatcatttggttattatgatggggttttgtttgatcgattgatacacgttggttggatgggatgattagttgatttggctctgtgccttgctggagatcgacaggtcaggccgggaaataattttgattcttggagatgattttgatcgatcgatgtgacgcggggtttgtgtttggtttgcagctgattgtgattgagaaggttgattagatagccgtggggcttacgcgttttaatcaggctgtacctcgagatgggttgatcaatggatccatgaaaaccgctaaatcgcagccgactgattatgcacccggtttctaaacctagctaggatgtaaatagtcatatagtacgagattaattagtagctcgcataatgtatctctgttttttgttgtttcttttacatttgttcgtatgattttttttaagaagggcaaaagtattgtcactttttgtatcgataaatagagaagtgttcgtatgatcgattttgttgtagcgttattttgttgtcgttgttagtgtgccagatcgtgataaaggctctatttttttaataaaaagatagtggaatttattctcatctttagttaataactaattattatagaggttacaaatcttttttttgcggggtacagaggttacaaatctaacgactgtgaattacaaatcttcatatagataattatgtttagagtataagtgaattacccgattttccttatcagtcttaacttttgtgttaaattggttggtgcatataactcaataataatgtatttttttttgaaggaaggcaaaagctttggtaaaacttctacctatagttggcgagaaactacatagccattgtctctctagagatttgaaaattgtatgtaatccttgtctttcccaaccaaaaaataatatcttcgaaaacagcttccaattattatgcatatcgaattttgtctgcatcaccgttggagaccaacgttgaaccaaagcaatcctctaatatactccttccgtcccaaaaaaatcattctagtattcgttattataggaacggcccatccaatgctaaattggttttatgtgggatggagggagtattatatacgctaacttcagtttttcttgttatcaagcacgatcactttgctaatttgcattatattgcatcccaaaattgtcccttggccaatggctaaccgagcagcatctagctagcaatccaaccaagcagacttgacatgtatcaagtattcaacgtactacaaggctccagcatccaacctgaaaccggcatggtgcgtcgctgatctgattctgacctttccttagctgtctatgtatggctctgcaggcagcaaaccaaggaggctaccatccgtgccacccgtgcttggatgcatgcatgaacgtcatgtccagcgccagcctctgaaactctgatccctgcattgtcaatcgatgagcttcagattcgattctttgcttgtactacgtataatctctttcatcatctcaagctgtcaaaacaaccagtactctactaatgcactagtctctccatctcaaatcatactaatctagtactcaattagagacaacctattactataaatttagacaattctattcgacacaacctaatactaagagtattaggttactatattttaaaacagatggaatagtagtaagtactactcgtttcattttcgtcgtcatcagtaatttaggagtagatagtataataaccgtccgtcatgatagttgcaaaggcgaagccagtggcaccgtcaagcttgaattacaaagagtgtttgttagtgatcgagaactttttacatttgatgccgaggaaagtacagtgaaaccgttgacggtggagcctaggcaatcgcccgacctgtctgagaggtggcttctttcctatatagttgtggctaacttcttctctacgaagagagtaattatatctacggttctatatttatacatttcttttgggtcccgaattcctgaaaaagaatttggaaactttggtccggaaaaaagtattaaaatttaaataaaatttgctaaattcaaaaaatatcgtgagaagtagcttcctgtgcttgggatccaaaatttcgttccgaaatattgaacctgacttatatcctgaattagaggccggcaacaatgggtggtcagaataaacggtgtgtgtgatgttgcatttagcgtcagacaatcagttgggctaggcacagcgcccaatctgaagaagaatctgatccaaggctagctgataaatgttcatgcagggaccagtacctaactacacagcaacatttactcctcctccttaagattaattttcatctttagtaacatgtaaggtaggtggtatgtgtggttaatttactgcgtaaagatccagagacttttctgacgaaaaagttgcaaagattcagagattgttgcatcgcccttgagacagcagcaaattcagtgaccctttcatatgaacaaatggtcgcttgtttttgtctaagtagagtacaatggcaatgacaaagaagagactactacttctaattaaattgatcctagctctagtacaactctttaattactg

SEQ ID NO: 32496 - DNA, 2177 bp, Oryza sativa
ttaatagtactccagaacatttgtttgagttgtttctgacctgagagtggtcactgaaagcatcactgtctatgccaaacccatacagcacagggctcagagatgcaatcctcatggaaaggaactgtgtcacaatcagaggtagaatatgttatagctaagcaaaaactcttgtacctttaattttttttttgtattctagtcatgttaattacctcaacttggttctgtaaggactgcacatagttgatgatctcatccaaaatgagagcctttccagtgacctacacagataaatgattttttttcactttcaaagatagtatcaaacatattaacatatacaaaaaaaaattgtcactgcaaataccactagtttagttagtagttaactagtgatctaaccttgtcacaaccagggaccagagcctgcagcatcctcatcctctcactgatcctttctctcctcacctgaagaaaatgccagagcagatagcaaaaaatgagtcccaaacaaccaaagctaatagctgcacaaaccacaagcaaaagatcaaagttgaggaagaaatttaccctctctgcaaggctgtggctatctgttgcttgccctctccttgccctgacatggatgaacccctgaggtgcctcctcctccatctgatccctgctgtgtttcttccctcccctcttcctgccattctcctttgcctcctgattgttcaacacaacatcatatgatgaaacaaagaaacatgagccaagaaattcatcttggaaagttatctgaagctgtattcttgaaaggaaaaaaaaagagattcagaaactgttttttcactgtcatgctcatgtgcttttctaccttggagtgagcagagttgaggctggcagtgtcttcttccctgggcttcctcttcttgtcctgtggagaggtgtcaagaaccacagatgaggtctccattgaggcatcttcagggatggctggagctgtggtggttgctgctcctccatggctgccatggcagaagaggaagccattgttggtgatgaggccatgctccatctgctgtgggaggtgtgagaagcctgccattgccaatgcccttggtgtcctagatgctactacctagctagagctagagatacctatatggtggtggagttgcttcttgttcttggtgtctgaactgaaagatgaagctctctagattgcaacaagttggctccttggtgaccctgctattggtttatataaaagttggggagaggggggattgataagaccaaatcattataaatcaattaattgatggataggttggcaatgggcagtgttaggaaagggcccctgtgtccctttgctgtaggatgaaattgtaactgaagaaaatgcccatcattttattttgtatatactgataggtaggttggctcctctttcttttcttctctttactaggagtatttgctagtcaattagttgtctcattgtgtgtgtaagcaccttttttaaaaaaaaatggcagcagctaattatgtaataagaacacacattcaatttcgtgtgttgaccatatataaattataaaatggtacattgaattattatttgctccacgtctctaaaaatacattttctcaagaaactttattttactgtgttgcttagatcacttattctaagttatttgttaagtttatttttaaatatatttaatttatctctataatcaagtagatatataatctggtaaataatctatttaagcagttgcaattgcttgagttaattgaaaatatcatacttcctggtgtttgcaggagaaaaatagctcaagatatccaacaagacttctttacttaagttcatagctttcaacagaattttgtatacattttctgctaggatataatatgcagagatccttcatttcctgtacatgttgcaaatcttcagtctgtgaaggagaaagctttcagatgtgcagacctaacaaaaacataaagcctgtgaatcattaactgcaaattgaatcctcctagcagtaaacattaactatgctggagtgttggagtaaccgatttcctgatagcagtcaaaggaggctgctttcttctgggtggtgaactgcaaaaacgcagtcctacgatacagtgccagttcgggccccgtt

SEQ ID NO: 32497 - DNA, 2063 bp, Oryza sativa
aagctcttaatctcaaattctcagttgggctacaaatacatgacagcacacctaagacagctcatatattattctatatttttctgttgatcaaaattgtctgctctgagattatctcatttagctaatccgtgtctccctgaacgcatgtatttgcaggtgtttgaccagaagggagtgggggagcttgttaaggttgccgtagagcggggccggaaggcaaggcctgatttagaggtataatcagctcctaaggcataagttatcgtgaaataattatgcattaccgtgtacctttcgaacatatatattgaagggcaaaacttgtttgattataatcaatcaaattgatgcttgtcattgaaaatatatattttttgtaataggtgggcatttgtggggaacatggtggtgagccttcttcagttgcatttttcgcgaaggttgggctgaactacgtttcttgctccccattcaggtcagctgccgctttcaaatttgattagttaacaaaatcaacatatactgataaatattgatcccaatattttcaaacaactgtgaaactactgctgattgatctggacttgacatacttaacgatttggattcagggttccaattgcaaggctagcagcagcgcaggtgatgctgtgatcggcgagtactaatgaagcaaaccgttggtgcatcttgtaaatatacgaagagtaaataatgcttaaataatttatgttacgatggacactcgcaacatgctttgcttgacgaaatgtatgatgacctgcaaatggaggtttgcatgtgtataaataatattttttgtttgtgtgcccacggtaattgctgccataaacatcaaacagctatcagaggttgcatgttaaggcacctgaaataattgtaatttatttcgagaattactcaaatgaaatgtcatgtttttttgtacctatttattgaggaaatgttttgcacattgtttgatccttgagatcgtcctagtaattctcgcttgacacaatattttatttaatttggttgtggtgcttttgctagtcatttccacagctgcttgtgttatgcaaatgttctagagcatgtgtggccgccgtgccaacgttatggtaggatgcccgacaagccgacagttttcgtaagcctttttaagatccaatttcaaaaagattgcttctctcttagacaataaattagtctttgttcttttccctttttgtgaaacgaagactaaaaagtcttgtactcttgtacatattgtttgcatgcaaccttattgattgcagcagacaccttatgatacccgagatcaattatttcttggcttcagccgagtcaatgggtaacaaagataactgaaccaatgccccgtagcccgtaggccatatggctaaagctccagcccaaccatttcgagcctccgatgtactccttatgtttcaaaatatcaaaatataataatttatagcatttaaatcttgtttcaaaatataaaaaattttagcatgatttagagtactccctccttccaaaaatctaagaaatatttcattatttggtttttccaaaaatcaagtttgtagttactatgtgttaaattaaattgttgatcggaaaccaagaagtcattctaatacttattggttatatgttcattagttttgtcatatggtgagtgagttaattactttttggttttgatgcaaaagaaataggtcttagatttttggaaagagggagtactatttatctctttaatcaccttctattgtaattcctttttatcttttcctttagcctacctcatccatctcatatctttttacaggataactccatctgatcccatattattttaaagggatatctctatctgatggagtgaaaaataagaggtcaaagagatagaaatctactaagggcttgtttagttaatgaaaagaaaatttttgggtgtcacatcggatgtttaatcggatgtcggaagggcttttcagacataaataaaaaaaataatttcataactcgcttggaaaacgcgagac

SEQ ID NO: 32498 - DNA, 7719 bp, Oryza sativa
gttttttcatttatctatatttaatgcttcatgcatgtgtctaaagattcgatgtgatgtttttggaaaaaaaaatttagggaactaaacggggcctaagtagataaggcaagtcatacacgatgacctaccgaaaacgttattaactgctctgttctcaacagggccggccctgggcctaggccggttgtgcaaccgcctagggcctaggccggagggggcccatcatttacccccccagcagcccactagatcaggtcatcaggtgatcagttaggaggcaaggagcacgtcgattcatctgccggcccacaccgcgagtcccgagaagaaacaaagcgccagagcatcacccgcgccgcgtcgcttcgttgtctcatcaccgcgccgatgccctagtccgcgaccagcgaccgcgagtccatcagtccgcctgtaggctccagcgcctgccgcggtgccgccgtgcatttcaaatgttataatgttacctaaaaaacatttatcgggtgctaaaaaagaaactgtcccaggaaagattgaatggattggctatgtgtagcattgagaaaaatatcttggacaacattgatcttcaaactgtcattgatgatttcgcttcaagaaatgctcgaagaagctcttttttataagggacacgggatatttgtattaaggtatttatactactttgtttctatggcattttttagttgttaattatattatagttattatttatcgagaataaattattatattgcagcttgcaaattgcttcatttattatttaccatgttaggaatgtttatttgtgttactatatggtatatggtatatgtgcttatagagtataaatattagaagtaaaaaaatagcattaattttttaagggtccatacactgtgtttagttcacactgaagtttagaagtttggttgaaattggtacgatgtgatagaaaagttgtgtgtgtatgaaagatttgatgtgatggaaagttagatgtttggaaaaaaaaaactttggaactaaacaaggccatagtgccccccaaatgtcaggaccagccctggttctcaaatggaagaatcaatttcagatgagttatatgtacacatgcttatgttattagtacttttgaagtattatatctattactccgtccgttttatattataagatattcttttggttttaactaaatttataaaagaacataacaaaatttttaatacaaaataaacttaatatcaacatatgttcagtgttagatgttgctaaacttttatagaaactttaatttcgaaaaaaaatatataaaactttgtgaaacggagtacaaaaccgaacgtcctcaacagagcagcccttctagaatctagactttcagtttcacggcatgttgtagtaatctcttttcacatgcatattctccgtctactggcgattttatgggctgtcgtttgctgcggttgtcaaattgtcaaaaagtccctttcacgaagaccttgcgttaaccggcagatacatgcttccatccaacccattaagttggtgtttaatgacctgccggtactgtgctgctgcgtcttctgatcggtggaatgcacggaaagcctgggcgccgcccgcgcaagaatggccgcgtacgccaatcctgacgacggtttggaattcttcttttccccgacgtactgtcaatttattagtatcgggttactatgatatttttctatttttaagtgtaatttaatattcatattaattatatatatagccatttcataaaaaatagaataataataatatacagcattaaaaagagagaacacaaatgtattaagatagttttgatttttgaatattgtctagtttgaaatagttagctaatatcccgatagtaacacgattttaacgatcctatgctcccgtattccgatactagggcgataccataaaaaacaatcttaggatcgatacagacaactttgcgtaggtccaagcaaattaggttggttagtattgagcatctagaacaattaacaaactggcagttcccatcaatattttttttcctagggccgcagtcatagaatttggcaattaagtaccgattaatcattgctgcttattctaaatgaagtgtagcgtatactttttacatccctaaaaaagcaaactgatcttttctttttacaagtggaagtataacttgctacagttacaaaatgatgagcagtagcttctagtatgatttaatgtactaacaggttagaatcatacaatcgacatatggattaaatattaaggtgactatacgcctttaattgaaggtatttggatgcaagctaatattatctacgtacctatatatccaatacaacttttttttaattttttagaggaatacaactctttccttataacaagtattatgcaccaaaacccttcctttcctcactctctccataagctatccataagctagaaggggcggagccacgtgtaaggtagcttggtgttcaacctcatcacacgtggtagaaaatcacgtgtaaggtggattacagccagggttggattgtccaggctcattcgtgaatggataatgcgattttagtacgtatagagattgaaaatagtgttccatagttagattagttacggctcaaaaaaattgctttagctgaggttcaacctgagattaaacattgttttagacctcaaggagagttggaggtgtagattatttatattataaaatgagtattagatgtgtacacctttgttggtatagattccgggttttaatccattatagaaaaaaaaacttacatatagatcggcaaccgatcacagtaattaagcaacaaccattaattgtactgcacacttcttcgattggttctcttcagggtagccacacatcgaaaggggctgatctgaccaatgcacattacaaaccaagttcaaaaagacaaaaaaaaaaaaacatcacattaacaaagctgaaaaagaaacaaaaggtgacctgaaacaaaaaattgaagatcccctttcttccagctaccccagtaattactactactccaattaattaagattccacataaacacacattactggcttactgcaactcacttcaggtgcccttctttgtgtggcctctcggcgagctcccaacctcgcgcgtgccgcggcggccggccaacttcttgccgctcgccggcggcggcgacttcctcggggagcccagagggcggcgcgccgcgtcctcgccgccggcgcctccgttgctcagcagggtgggcgcgaggtaccaccagatggaggtgcagcagatggcgaacaccctcccgaacacggcgaggcacaccagcatcagcaccatcaccgccggccagtagcacgccggccgccgcatccgcccccacgagaacgacgacaccctgctcgccgccggcgcaggtggtggagccctggtcgcgcgcgcggcggaggcgccctgctgctgggcggcggcggtcgacggagacgacggcctgggtttcttggcggcggcgtcgtccttggggcgccgctgctcgtcggggagcttgacgatgatgggctccaacgcgccgttggactggacgaagcggaccatgacgaggccgccgccggagccgacgcggcggaggatcttgtcccggcgggcctcgagctcggagagcacggtggagaacttgtccagcccgcgctcggcgtaggggttgatcttaccgccgccgcctccgccgtgcttccgcctcggctgcctgggcgacccgccgccggtgccgcgcgccgccgggtcgtcgtcgtcgacgacgtgcttgaagctggccgtgccgcataacattttctaacgaaacgagctggtcctggtcgcgtacgtctctcgattttatcgatctggagtgtctgtccatgtgatccattaaaccagacgcttttaagtgctcgagccagtggtcaaagttttttttttctgtaagaaaaaaactttttaatacacgccgggtcaaatagaatcttctgttcatggtgacgtacttcgaatgtgcaatgatgagggtataattttctcagcatcagtgcatctcgtaaaagtaagtttaaccgaataagatataattaaataagttaatctagtatggaattggttatgtagatatcctctcgttgattacgtgtcatctgaatagttataaaaaaaataaaaaaaatcgacaacatagattaatataaaatatatcactccacaaatatacaagaccaaattcaacttttacaagttgcaacaaaagaataaaataaattgaaaatagttatcgtacattcgcagctatacttgttatttttgttacaacttgtaaagttgaattttaacttgtgtatttgtggagtgatatatttcatattaatccatcttaccaatttttttcaaaatttttatgactatttaggtggcatgcatgaaacgagagatatctccttgagagatgaaatcactttccctatggaatgtaatatatcttacattttatttgagaagtttaagattcttacaatctgttggttggtagccattttctgcgaatcttaagaagttggattttctagcttttgggttttagagcctgtttggggagcttctagctgctatagcgttttccacagaatcttcagctcctccaaacaattcagattgacaccttgattttgagaattcgcagttatagaatctagaaaatcaagaaagcaaaagctggaaaacccaacttctctagattcttagaaactggctaccaactagcatattcttataatcttaagcttccccaacatggcctagttcattttttgggttctaggtgataatctagattgtttgggggctaagtagactgtagttgatagaggctccctaagcagactctaaaatatgccacatctcgtgtcgtattagattaacttattctgagacagatggagtagtagactaatgtggattctgagacaggggagtagactaatgtggaaataggaagagtattatgtaacagcccttcctccaaaaccccgcagcccagcccaaccaacaagcgggcccacttacacataccactccacttacactttcgtcttcacttcgtgtaaaagggttaacccggttgtaatatggttagagggaagatgtcttataagttggttccacccttgctaaactagcaaggtgatactaaatatgtgcacacagtttacatgggctacacatgtctcatcctaattgggccaagatgtcacatacacccccctcaaagaattcaatgtccccatcggcttaacttacccatgtagccacacatgcatataggtaaatgtccataaacatgccccctctcagcgcacgtcccatgtgcctcacacagagcccacatgcgctatgcgtcatatgtccgtacactgactcgtacgtgcaaccgcgagggtcggctgggataccatttgtagcagccctccctccaaaaccgtgtagccagcccattcgatgagcgggcccacttatacatgctacttcacttacactttcgtcctcgcttcgtgtaaaagggttaacccaggagtgatatggttataagaaagagaccttataagttggttccgcccttgctaaactagcaatgatactaaaatatgcacacagctcacatgggccacacaggcctcatcctaactggaccaggatgtcacatattaagcatctacttatagactttgcaagtaattatataaggacactatgattgaggcaaccttatacatgaggcctcgccatatgcaataaaaatatcacttttctctcactgctactttgtctctctacaatacaggtacttgccaccatacaggaggggagagcctgccatgggaaaggagaagaagccaggggagtgccaggatagtcgttgaagatccgcccacgacagcctactaccatcgtcaccaaatccgcatgtgacagtcgccgccgccgttggatccgctcacgactgtgtaccacgccgacgcacccgccatcgccgaagccgcccgagtttatcatcgctgaagatggtgtgggggaaaaatagggtaaaaacgacatgaagtgacatcctggtctatactaaaatatgcacacagctcatatggaccacataggtctcatcctaatttattataatgtgggatacatcttaataccctcgcttttcatatatgaaggtaacaatatacctcagtggaacctgtttgggatccaccataagactaacttaggaatatatattgctgatgccctacgcgaacatatattagctctcacgcaaaagctgtttctagacatgctataatataatgcattaattatataaattagagaaagagaaagaagaaaaaagatagagataattttatagttaatccatattatatattagctctaatataaatttatagctagtagttacctctacaattaaacttgctctagtcatggttatgaggaaatacaggcttactagtgtttacatcctctattataatggcactaccattacatgcattgacgtatggggcaataggagggtgggaccaggggcagagctagagtattgtaggagggtgggaccaggggcagagctagagtattgagggaggtacctaggaatccggtaaagaaaaatttgtagatatacctgacctattttcaccatgtgtgcaccccctcgatataaatttagatacccatattagtttaaattgatataaagcagagtaaattaaacaagtggcactcccctccatctcgctctatctccgcctctgggtgggacccacatcggccatatttggtcttgaggtatccacttcaaaagaaacttctctcaaactaccgataggtggaagagggcgcgttatcgatgtgaaatggatccagagggatctcctcggcataatggttcgtgtatatattttacaaaaacacgaaatcaaagttggggactttttagtccattttttccaagagtctccgctagttgaaccgcgtccagtagacgacctcttccgctcatctccttcgtcaactctttgatagggatactataacctaggtccctaaacttggaatggatggcggagcgtattattgtaatggtactgacattatgatagaggattctcaccccacttaattactacacttactaccctgaccctgttaattttggtcataaggtttattcattcatcttaaaagaatattacaaacacgagaaaatatacgtacgataaaacaagttgcagcagaatgaaagtacttcgacgatggttttcttcaataagacaaatgatcaaaatatcacgtcaaaaattaattacatcatctttgatttatgccaaaacgtgccttatagctttagctttcggggcaaaactattgtttgggctaacaagtagtaactcttctagaagcaccttccgttctagtcacacatgaccatacagagctgcacataaaacctctttcagagttcatattaagtttttgttgatgtgaatccggatttaattcggtgtcaaactttaacttcaacaaaaccaattacgtgtcaatcaaaaccactatcataaacatggtacaagatgtt

SEQ ID NO: 32499 - DNA, 2158 bp, Oryza sativa
caaaattacatctattagattcatattataaaatattggctggtgattaaactttttaatcacattaaaaataaataatattcaatagaacaattgttggttaaactctttatcttaaaaagtatatcttatattttgaatcagagagactgaaaaaggacggggcgatggatgatggatccatatgagtttgacaattatgcataaataaatgcgttaaatattagaatactgagaagtctagaaaatactgatgaatgatttttttaaaaaaaaatcataccgcttagaaccttgaatttttttttgttttctgaaaggaccataattaaaaaaaaatccagtgctaaacggttggctcacgaggcccttcacaagataataaataaagggtgtagctatatttatggcgccatatttttcaccaaaaaatagtcggcatgtatttacattgtaacttcctaaattacatatgtaattttaatgtatttataatgtataaatctcgaaattacatatgtaaattccaaaattacatatgtaaatattaaaattacatatataaatagagtgtaattttacatgtagatagcaaaggtcgatcggataaatcacagcaagcagcacaggtgcatgtgtatgtagtacgaactagtgcttgcacgcacgatggcaaattaaacagtcctgcacgaatctaaacgaaactttgagggctaacaaactgactgtaattagaaactttgagggctaacaaactgactgtaattagagggatgcaacattacatggactcatggagaggtagcgcacgataatccgtatttcatcaactttagtagttctattattacaggacagctgtgattactccaatcaattgacgtatatacaccaaacgttaatccctttcaggactaaattattgattgcactacaacactctttgcaaatttagttcctacgagttcggacatttgtttccaaatttagttcctacgagttcggacatttggaaacaatttaatggacatgctttttctgtattctaattctacagtatccacatgaaaaagtatgactgtaaactcactccgtgccgcttccagatactcagcttgccatcaatgggcgtgcagtacatctttctcacctaacaaatacacaaactatatagttctcccttttggcatcaaattatatccttagaatctaaacaaaatgtagcgaagtaaacggtgttcacacctatttgttattcaatataaagctatccttgaggatatcagcagctaatattagtagctccaccatttccatgcccgcagagctgagggggtcttgtttctctgacttcgatgatttaggtgattcagatggatcatagagagcatcactagtaatagcatctgatgaatcccctaaccagcttacggggagagctacaccaagagctgtcttcataaggtttgcttcggttatgagactgttcaacgcttcatacgtactctctaaagagtgagccgatttgacatcctcaaaggcctgaaaaaaaaaagattattacagtctgcaggtaaagtttttgcaccacattattgcttaagctagcagtctagcacggcagcagaaatagtgtctcataagccgaatgaaatgcaagttcagaaataatatctactaactaatgtttatttgttgatcataggaaatcttgcaactgcaaaaatcctcaacattcaagaattaaaaggattgcatttcagaatttcagatcgaatggaaccttgctttcccatcaagcttttttgattctttttgtcccattgaatatgcaaatattgtttggaacaaattacccaaagttcatccaagtatcatgcattgcccacatatctttccaacattttgcatctttctagtaagctgcatctatcagggaaaagagtttaccttcataagcacaatatgcagtcatgcactgacgaagtgaggtgttccatagtggcaacactttccaaaagagcagcattttcagctttaaccctgtaagcagcaccaaacaaagcagacagcacaagtcaacggctgaagagtggcatacaaaaaataaacatttctgtcaatgtttctcttgagtgatttccttactttgagt

SEQ ID NO: 32500 - DNA, 1666 bp, Oryza sativa
gtgaacgaagctgacaaatgtgtgtactatcgctatggtgggggagaaggagtgatcttgtgcttatatgtcgatgacatattgatctttgggaccgcctcaatgtgattgaggaggtcaaggactttctgtccaagagttttgaaatgaaggatttgggagtggctgatgttattattaacattaagctactaagaggagatgagggtgggattacacttgtgcaatcccactatgtggacaaggttttgagtcgctttggatatagtgactgcatgccagctcctactccttatgatcccagcgtgctattaaggaaaaaccgaagaatagcaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagttatgcgctatctaaagggcactatgagctatggaattcactataccaggtatccaaaattactagaagggtatagtgactcaaactggatatctgatgctgatgagataaaagccgcaagtgaatatgtgttcacacttggaggtggcgttgtttcctggaagtcttgcaagcagaccatcttaacgaggtcaacaatggaagcagaacttacagcactagatactgcgacagttgaggccgagtgccttcgtgaactcctgatggatttgccgatggttgaaaaaccagtgccagctatcctaatgaactatgataatcaaacaatgattattaaagtgaacagttcaaaggacaacatgaagtcatctaggcatatcaagagaagactgaaatctgttagaaagcataaaaactccggagtgatagcattcgactatgtccaaacagctagaaatctggcagatcagtttaccaaggggctaccacgtaatgtgatagacagtgcatcgagggaaatgggcttgatacccacctaaggttgcacaatagtggaaacctgtctattgtgatcggagatcccgtgaatttggatggcgaaacaaactattgtgtgactgagagaagagacccttgaaaagggctcattttcatgatgtacttctcttcttttctgcatggtaggatggctcatgccttaatgtgatccgagtggcttttctaagcagagatgttgacctgcagaacatctcagaaggaacacacctatatgagtttgactgctagtcaaagtctatgagatttgggtgatctctagatactcatgaaaaggcctggagtttgacttatatgctccaaacataggggatgcgaacgggagcccagtaccagtcaagggtttgagtgaaacctgatcacacaagactgacaattcaaggcatagtccattgttcagttgtggtctgatgtagctcatttcctatgtggaagttcaacttaacagtctccaccaaaacactggtatatcaaacaggcacaaccttgagaatatttcttatgagccttgaaatttggtggggattgttagaataattggactaggcccgatttattctattaaatctcaaaggcccataataaatgttaaggataataataccacctcaggaattaaacgagggagtat

SEQ ID NO: 32501 - DNA, 33574 bp, Oryza sativa
ggcgtgtgcggcaactggcggaatcactcgtgctatataaggaggccgctaatccgatcagaactctctcgcttgctttctcttgctggtgttcttcctcctccgcgcgcttgtgctgcctctgttctgcctccccgcttctgatcgcttgcgtgcacgagagatcggaacgagcagggcctccggaaccataccttcgcctgagatctgtaccaggtaggcgggtgatcaagtttttggggagtgcttccgcacgactgctctcgacttctgctctgttcgtcgtcgtctccaccatgtctgcacctggagccggcgcagctaccgccgtccctggagatggcgcgccgggagccggagccgctgcgaacgtcaacgtcaacggaggcagttctgcctcacaatccagcggagagacattctcggggtatatctttctgctactgttaactcattctttgatacctctgttagaattgcgttcttggtatgttcatgatgcttattatactttaagcatgctctggttatgttacattttatcattagatcaccccacattgttcatgccatgattattgtcataatattttgaattaaaatatgccgatatatgaccatatttctaacaggaactatgctaaactactcaatttgagaaaatcataaaatatattcatactaactgaagaaggccctcatagaagcacttccacggaaatttcaggaggccaaaggccaggaattcacatattaatcgggaaagctaaaatttctcacattaataataaaacaaattctcaaatcaataaagagccaaaatgctaataaactaaacagttttggtaaaattatggcaccaccttttcggttgatttcaatcaattttttcatcatgtgatgcaaactaaagttttgtcgttgtccttttgcttatatgatttaagcagataataacagtatcctgaatataagaaaaaattacagcaaattttactgtgtaagaaaactacgctatacatatataaaatttacaatgtaatatatggaatttatagtgtaaatactgttgaaagatttgaactttttttatataatatgacgtcataagtatagccaggtcataaggtactccctccatactcataaaggaagtggtctaggacaatgtttaagtcaaatcttaggaatataaatcataaataactctcaagttgttgagtttgaaaatgtaaaaattatatgaatcgatttgtcttgaaaaatactttcacaaaagtatacatatatcacttttcaataaatatttttataaaaacaagaaatcaaagttgtgttttggagaccgtgtcgctgtcctaaataactttctttatgagtatggagggagtatatgcatcaagttgggcatttaatacagagacttatgtcttaatggcaaagattttctgacatataactttcatatctttaacaatacataccctttgttttggtttgattttcaaatctacatttataccaaattgtatactgatatagatatgcatccctccctgcatattaaatatttttttgtcttggaaaggtggagggagaaaattaatccaagcctttaatacataaaccatcctatgctcaattgattatttgatcacacgaaaataaatgcaagccccatctacaacgattcagagaaacgagaatgcaattaatcctgctgagatatgtagtgtgcttcattttgccttcatgattgatatctatatgtatatataaagatgaagcttggcttgctagcttaattgcattcccatcaatgtcatcctttacaaatctcatgatcaatcttcttgtgttactggctctagcctccttgctctctcctgcacctgcactctgctatatccatgcaggtgaagcaggcagcgtcgtccgtactccgaatggcacgccgccgccgccagccgacgcctaccggacttacatcgtgctcgtcgacccgccgccgcacggcgcggccacggacgacgacgggcaccgccggtggcacgagtctttcttgccgggaggccggcgcatggacgacggcgccgatcaggcacggatcatccgctcctacaccgaggtgttcgagggcttcgccgcgaggctcaccgccgccgagctcgccggcgtggtgtccaagaagcccgggttcgtgcgcgcgttcccggggcgccggacgctgcgcctcatgacgacgcacacgccggagttcctcgggctgacgagaggcgccgggttctggagggacgtcgccggctacgggaagggcgtcgtcgtcgggctgctcgacaccggcgtccacgccgcgcacccttccttcgacgaccgcggcgtcccgccgccgccggcgaggtggaggggctcctgcgccgtcgccgccacgcggcggtgcaacaacaagctcgtcggcgtcaagtccttcgttgacggcggcggcggcggcgacgacgacgtcggccacgggacacacaccgcgtccacggccgccgggaacttcgtcgccggcggcgcgtcggaccgcggcctgggcgcgggaacggcggccgggatcgcgcccggcgcgcacgtcgccatgtacaaggtgtgcaacggctcaggctgcgatgacgacgccgtgctagccgggttcgacgaggccatgaaggacggagtcgacgtcctctcggtgtcgctcgggaggtggtcgagtccccccttcgatgaggaccccatcgccatcgccgccttcagcgcagtggcgcgaggcatcaccgtggtgtgcgcggccggcaatggcggccccgagccgtcgacggtctcgaacgacgcgccgtggctgctcacggtcgccgcaggctcggtcggccggagcttctccaccaccgtgctgctcggcaacggcgagctcgtcgacggccaggcgctcgcccagcagcccaactcctcgacctcgtactacccactccacttctcggagaagcaaccgaaatgtaacgagctcgccggaatcgtcggagatggcgtcgccggccacctcgtggtctgccagtccgatccggtcgaggacgagtccgtcgtgagcgccatgatggccaccggcgccggcggcgtggtgctgatcaacaccgagagcgaaggctacacgaccgtcctcgaggactacggcccgggcatggtgcaggtgaccgtcgccggtggccacaacatcacggagtacgctaggtcgtcgtcatcatcagccggcggctgcaaacccaacgccaccgtggtgttcgacaacacgttgctcagcgtccacccggcgcccaccgtcgcctccttctcgtcccggggaccgagcaaggtcgccccgggcgtgctcaagccggacgtcctggcgccggggctcaacatcctcgccgcatggccgccgcacctccagcacggcggcggcggcggaggcggcgggctcttcaaggtcatatccgggacgtccatggcgaccccgcacgcgagcggcgtggcggcgctcgtcaagagccgccacccggactggttgccggccgccatcaagtcagccatcctgacgacgtccgacgccgtcgacggcgccggcaacccgatcctggacgaacaccacgagagggcgaccgcgttcctcaccggcgccggccacatcaacccggcgagggccgccgacccaggcctagtgtacgacatcgccgtcgctgactacgccggctacatctgcgcgctgctcggagacgccgggctggggacgatcgtgcgcaacgagagcttgagctgcgggaagctggacaagaacaagataccggaggcgcagctcaactacccgaccatcacggtgccgctgccgcggtcgtcgtcgtcggcggcgccgccgccgttcacggtgaaccggacggtgacgaacgtcgggccggccaggtcgacctacacgatgaagctggagatacccaggtcgctgacgatgcgtgtgtcgccggagaagctggtgttctccggtgtcggcgagaagaagggcttcagcgtgacggtgagtggcggcggcggcggcggcgaggtggtggagggaagcttgagttgggtgtctgggaaacatgtcatgcgcagtccgattgtcgccgttccccaaccgtacctgaagttaggaagctagcggtcgttaatgacatgattctcttgttttaagtcacctccaggtgttttaaccattaataatgttcagtatctgccatacaatacaattaatttggacaaaaccctccaattaatggtacagaaaaaaagttcttgactatggaaggaaatctaacatataagatcctaaaaatcgtggtcgataaaacaggaaaaggaattcgagccgtagaaaatcttttatcaaattgcaaggtattgctaaatttaagacacctgagaaaacttcgagacaactaaaaaactgagtgaaactttattgtacggttataatatactacctctactataattattatataactatctatctattatattattaaaggaatagaaaaatgagcctccacgttcgctctcatggcctagaaattctcacattaatcggagaaaaagaaaaaacagagtccatatagaaatacaatttagaaatagctgaaattctaaattaaaaataaggaatattagaagaggagactagagtccatatagaaatacaattaggaaatagctgaaatttagaattaaaaaataaggaatattagaagaggagactagagtccatatagaaatacaattaggaaataactgaaattcggaattaaaaataaggaatattagaagaggagactagagtccatatagaaatacaattaggaaataactgaaattcagaattaaaaaataaggaatattagaagaggagactagagtccatatagaaatacaattaggaaataacttaaattcggaattaaaaataaggaataatagaagtagagtatagagtccatatagaaatacaattaggaaataactgaaattcggaattaaaaataaggaatattagaagtagagtatagagtccatatagaaatacaattaggaaataatagaaatttggaattaaaaagggtgaatagctaatatggtccctaaagtttcgcttcaggctcagtttagtcaggtttcaaatcgtctagacatgtcctccaaattaattatttaggttaatatagtccttataccaaaaaaaatggtacatgagtatgccaagtcatcctcgcatgcagcgatatgaatgaaatgactattctacccctatatactatatagaaaagaaataaaagacaaaaaaaacaagctaacctaggcccaacattgttgcggagggtggccgacaaaggaatttatacgattaggctgcagcaatcgtaagtgacaattctaaaatgtccatacatgtgtgaaatatttgttttcttttttatatggtatataagggtagaatgttcatttcattcataccgctacatgcgaggatgacttgacatgctcacgtggcactttttgtgggtccaaggactatattaacccaaataattaatttgtggcacttttttgggtccaaggactatattaacccaaatgattaatttagaggacttgtttggacgatttaaaacatcaaggactaaactgagcccgaagtgaaacttcagggagcatattagctattcacccaatttaaaataaggaatattagaagtagagtatagaatccatatagaaatacaattaagaaaaaagtagaaattcagaattaaaaaaataaggaatattagaagtagagtatagagtccatataggaattcaaaactaactaaaatttggaataaatataataaaattaaaagtagagtttagagtatgtataaaaatacaatttacaaataactaaaattcgaaattcgagattaagaataacatgggaagaagagtttaaggtcaatataggaatacaaatatagaaatacaatttagaagtaactgaaattcgaaattaaaattaaagaatattgaaagataagtttagagtccacatataaatgcaattagtaataataacaattcagaaataaaaataaataatattgaaagaagagcaaacagtctatatagaaatacaatttacagaaaattcagaattaaaaaaaagaagtattaaaagacgagtctagagtacatataggaatatatataatttacaaataactaaaatttgacattaaaaataattaataactaacacgtatataaaatataatatgaaaattcagaaataaaaataaataatattagaagaagagcatagagtctatatagaaatacaatttacagaaaattcggaattaaaaaaaattaaaagacaagtctagagtacatataggaatatatataatttacaaataactaaaatttgatattaaaaataattaataactaacacgtatataaaatataatatgaatattacacattagtagttttgtaaagttattgcaaaatttaaaattatgttttcattttaatatatttgaataatataatgagaaaacatatatgctattatatgagagaaaatataatgatgctagccacgcaatctgcgcgggccaccatgctagttatattaacttgtatgtatgtaaagaaatatgtattatacctaagttatatagatattacaatgtaaatgtaactataatgtaactttagtgtaactctacaactattatatttgaaagttctttaaaaaaaatttaagatatttttttagtgattcctaaaattttagccacctaaaattatatataacaaagcctagcatttagatggtatgattgtaatattatagttaacatatttttaattgcaattttattgttatatatggttttaatttatttttatctaagtatataaatattttttgcatgtaatttttgtaattttttatgaatattatgtttatttcttgtaattttgtatgttcaaatatattgttgaacctttaatactagtaacttgtccgtgctaacgctacggtaaaattaaaccaaagactgtcatatgttagcacaataaaaaatataattagataaatttaaaattcacgtaaagattgaacgatagaattgttatattttaaagacaaccatgtgcgcaaaattgcatcgtaacttttatatcttcactcaaaaccatctgattgttgatgcactaagaaattcttttatgtacataaatactatttgctcatgatgcgcaaaataactacaagcaactctaattgaaattttttccatgataatttactgacatgttagtcatggatccacatgccaatgagagaatggaggtcaactttaggagtcaaataaggattttatcccacaatttttggataactaaattatcaaaattacattatcattcataaataaaatgagttgggtaaaaggaaacgagaataccaaacacccatccatccaggtgtgacttcaagagttcaagaccaaccgaaaaatacattctcaagctcaaaccagaaagataaagagaaacatagaatgcaatctaatgatccatcgcctgctaggctataagttatctattcacctcttgagggggcgtatagcggaccttttcctctcgtgtcgtctcctctcgggcggcacgggaggcgcccaggccgccgtcgcccgccctccctccctcctcctccgcctcgccgccgcccgagtggccgccggcaaagccgcgtggcggcaaggacggcggcggctgggcttcgcttcgtctcgccgcacaagggcagggggaggtctgccggcgtcgggaggcagaaaccgcccagatccacgccggccagccagagttctcgttgagttaagccggcggcggggcagtgtgctcgggagcggcctttggcggggatggcggcggaggtttggaggcgctggcggcggtggaagaggccgccagatctgacgcgaatctggcggggaggtttccgacggtgcccggtgggggtctggcgccggcggaggaggtcggcgtcctcagggcgacggcgacggcggtgccgatgccacagcggccggaactggcggcggtggagccagacgacgactgctgaggaggcggccggatccggcgtcgacgggcgtgacggcgcggagacgctggagacggaggtgcggtggctacgacggcggtcgaggggtggccgggtttggtggtcggctggcgacaacagcagcggcggcatcggctggtgacgacggcggagggcatggcggcggcgtcggggcgttgctggctccttggtggcggagagcgacggtgcagcagcggtctgcggaggtggtgactggcgctggtggcagcggcgacggcggccgtgactgtggaggcggtggtgacgtcggcggcggggaaggagtcgggtgtgagtggctgggcgttcgacagcagcggctgtggtggtggtgaccgcgactgcggtcaccggaggcatgacggcctcggacggctagccgagggcgtgggagacggctgcttctagccggcgcggcatcgttcggtggaggggtcggagaccggcttggcgcagagaggcgcagccgatggcagcggaggccggttcggcgtgagaggcgcgggcggcggagatggaggccggcttggcacgagaggcgcggccgatggagggaggccggattggcgcgagaggcgcgtccggtggaggaagccggcttgacgcgagaggcgcggccggcagtggaggaggcgacctaggtgtgaggaggagttgccggtggatgtggcgtggtcttcggcgcacgaaggctggccggcgggggacgccggtgcaggggtcccacatgttggcagagtttgtgtggtggtggagcatcggtgcgtcagccgtggattcgcagccggtgagcggcgggtgaaaacccagtccggccttggccggaccgacaacgatcctcctatgggcgttgtcgtgctgtctcacccctcaagggtgattgctgggtgaaagcccagtcttggctgagtcccgacggacggcggcggcagtttttccgttgcttctcttcttggagacgtcgttttggcatcccctagggggcgatcttgtttgtgtccctttgttggtgtagtggcggtcggtcacgcttagcggcagccgctctggtgctagccttctcctgggcttgttcgttggcaatgtcggtgtgtgggtggtggtatccttttttctttttcctggttacgatcctccagggttgtaatcttgtaattttttcctgctctatcaatagaacttcgcaccgtctcgtgcgagtcattaaaaaaattcatctcttcacttctctttcagcaatcatacttatatggtgaagaaatgagacggcggagttatagattcagcaggaaaaaaaggattcaagagacaacattgctcataatttccataataggagggtcttgttttagccacgacgtgcatcatactctgcttcgtcttcactccactttcactatcctcaccaggctatttgttcatccaccacagcagaacatacctttgatctttcagttttgaaaataatgttattcatgcatataaagtaagtggatgagtatttttttagataatggaaatggattacatctcggcttctgtcataagacacacagccataagtttaatactaataaaaaggtaagataaaaataaatcaaaatgagaaataaggtgatgggacaaatccccaactcccctttattattgactagcgttaaaccacataaaattttttagctagcaattcttatggaactacgccacccatagtggaataagagacgcttggctaccgatttcaagagtgtagcaccattacgcatagtatcctgctcctcctgtggtagcattgtagaccaaaagtggagccagtaggaagacataaagataacctgcatagggttagataattgtttaccattaaaaactttatcattgcgacaacaccaaattgaccaacatacaacactagctccaattagaatcatcttattgatggacctagatacccctctaagccatttaccgaaaatgtttttggcgttacagggtgggagatattaaaagcaaaaaacacacatctccaaacaaactgagcgacaggacactcaaagaaaagatgttggattgtctcttgtgtatagcagaaagaacaatgtttgtctccccccccattttcatttagccaggttatctttcattagaattactttcttgtgaagaaaccaaataaagaccttgatctttagtggaattttcaagtcccacagaattctctttttatccgaacattacagttcatgatcgtggcatacatagatttgacggaaaattgaccattcttatggagcgaccatacaaagaagtccttttcatttaacagagctatattagttagcctgaggatcaaatcgttccacttgattagcttttggccaacaatagctcttctaaaagagatatttagcggcgttgtgctcatgacctttgccacagtggactgcttctttcgagccagattatataatgtagggtattgatctttgaaagcacgcgatcccaaccacgtgtcttcccaaaatcttatgtttggatgagtatggatgcttacactggaaatttgaaggactgcatgcttgtcgtggtattatctgactggatgtagatgttgccaatatgacccgaggtccacacttgattgcccatgatgtaggcctaagagagcacggcggactgatgaaatgatcattacctgaaatgaaagaaactatctgcacttaagaggaggcacaattcacactgactgagtaaagttgttaatcagatgagttttgttccaaattagaatgattctggtactcacagacattacaaaattttgcaactatctctgatatcatgttaggactctgtctcaggtcaaaaaacaattatactacttacagattttgtacaaaatttagccctgacttagagttaatactccaattgtgccaaattaaactctaaatcaaatgatcattacctaaaaaaaagaaattatttgcataaagaggagacataattcaaacctgactgatcaaagtttccaaccagaggagtgtgcttgaatttaaaacaatatctatcggtgatatgggcctggggtctcaagactagagggaggaggctgccccccaatgtcacgtggccctcccccgaggggagtcaggcccgaggtggggcggcggccactccttcccagcgaccagacggaggaggctgccccccaatgccacgtggccctcctccgaggggagtcaggcccgaggtgggacggcggccactccgtcccagcgaccagacggaggaggctgccccccaatgccacgtggccctcccccgaggggagtcaggcctgaggtggggcggtggtcactccgtcccagcgactagacggaggaggctgccctccaatgccacgtggccctcccccgaggggagtcaggcccgaggtggggcggcggccactccttcccagcgactagacggaggaggctgccccccaatatcacgtagccctcccccgaggggggccgggccggaggcaaggcggcagccactccctcatgtgactaggggtcgggctccccagaccgcctccgcgggtcgccacgtgcggtgggttaggtggccaccttcgagcgctcacctacccgtattaatggtgacctgagcaggcgcgccacgccgtatttaatgtggcatgcagcgcgcctaaattggcctgtgaccggtcgaatgaccgacgggacccggggtgttaggtgcactatcgcatgtgtcagggggcgtacatcagggtgttaggtgcactatcgcatgtgtcagggggcgtacatcccgtcctgtcccatcggtcatgatgagcctctcatcctggccagagtcggtccatccgccctggtcaattggggttcccatttgctggtgcaaacaggagcccagaagttttcacccattaatagcagctgacatgggcgccccccgtgtcaggcagcaggatttgacaggccccatcatcaagatgacgtgcgcttgcttcccaaatcaagagacatgacaggcatttaatgcaaaatacttctccaccggagctagatttttttgcccatgtggtaaccccttgaggtataaaaggagaaccaagcctagtaaaagggaggggagcttctgcccctgaggatcaactcgatctactccaacaaggagatcttgtaatttctcataagatcagctaagcacaggagtagggtattacgcttcttattggcccgaacctatataaactccttttgtctcatcgtctttgagggggctgaccccttaatgtcacacaactttgctcaccaagccctcaaatctcacccgctgcccccggccgaaccaaaaaagagggcctcatggttccccgatggaggagttcaccctccgacaataccggtactaacttagtgatcatgctctaaaccaaaggtctctgtttcaaatcagaacaattccattactcacagattttgtacaaaaatttagccctaatcaggaagtcccatagcaaacaggagaggttcgctgctttccttgaaagtccgatagcaaatttggaagtgccatagcaaacctgttacatttatatattctgaatttctcaaaggaattttgaaagcaagctgccagcatgctccatattaacaaattcaggttactttaaatgcttaccattatacaattcaaatttttataaaacatagaaaactcccagtttccattgtacaattcaaaaactattaactatttagtaataaattcacttaatcactcatataagaagcaaagtcaagggacaataacaatgtatatttcagtgttctgaatttcagacagcccaatgtatattaaaaacaacaatgccatttttctatttccatttcagcacagaaatatatacttgaatataggaatacatagatatacataattagacatggcaggtaaaacatgtagaaatgcactcctaactgcattggggatgctgctggggaagtcaaccaagcatcaactatggaccttgctaagttcttccgaacaaaagatgcttcgtctgtacgaccataaccgtcaaacacctgtaaaatacccccaaaaatttgaaacaattaaccatctgcaatgaaaactcgtactgaacaaaaaaaaatgatgaacttaacatctcacatatgaatgttacttcagaaatttactgctggtgatgttgggtcccggtttgagcaaagtaatttattcccaaatgttttattgcctagtttcaagtgctctaaactcacagattgtttacatgcatcaacataatttgagttggaaattgtcagtgtgaaccaaaaaaaaactaaccttttgattgactggaaatgtaactcttgtgagtctctatttccctcaatttattgcttctgattaactggaaacagaactctagtgagtgttttattcccttaattcattgtaccactcaggaagactatctgcctacatgcagtttgattcccaaatctgattgtagacagcactatgttcagaaccatacaaagacctaacccatcaatcctgccaagtttttccaatttcccacaagccctgtattgcatctgcacgccatctcatctaatctcacaccctctcacaaaataacagcaaaatagtccgggcaatagctgctgctgcggctgcttttgttgtgggcactaaaaccaaagatagtctttgagccgctttctcgcccccgctgccggcgccgcctgtgtcagccgccacaacgccagcccagaccgtcgaagaaccactgccgccgtcgtcgtcttcacgagctgtcgcacctgattgaatcaaacacatttagccacaccacacacatgacgttcgtttcagctggcgggcagagccagtcagtgacggccgcggaggagatcgtcgctggctcgggggtctttttttttttttgactgaaaaaggtagagaggctctaccttataaccattttattaatggtagccaaggtgttatagcagaagtacaaagatcggaaagaaactgaaaagaaacaacagtagacagaggaaggaagaagaaagaagggagagagaaagagaaaaaagaaaaaagaaaacagaaaacaacatgaagaacataaaaagagtagggagatatagctgctatgctagcaaggcagcccaactgcgcaagcccaactgcgcattagagtccggcattgtcgcttgacgcggttctaccacaagtgcagacattctctgatttaattgcgtgctttccataaactgtgtgaacaagcagcgaagcaaatagaccatccaggttttagatgcaccggtgtaaccaacagtccctcctcaacgaactggagtatatctgtgtcgaaacaagatttcggcaatactaaaagggggtggctatcaagctggaaaagtgaatgggttgagagacaaggaattttatacaggttcaggccttcttaatcaagaagtaataccctactcctgtccggagattgattcgctgagtgtattattgatcatatgatctgggagaaaatcgtgcccccaaaggcacccggacccctccttatataggggaaggagtccgtattacaaattatagtccatatccctaacggaataggtagttacagataatatacaatcataaccgactaggatcccgggtatttcctttacatataagtttggaatttaacccaagtccctttaaagatatcttatctatacatggcaccccatacctagtcggactatacataccatgtaggtatggggtattcataatctccatagtagcccctgagacctttacagtcgacaaaatagttttctctcgtaacccaaaacgataatccgagtgctccaacttcttctgccttggcctcctgagtagtaagatcaaagactgtgaagggctcaaaatagaaaaaaaatcaggtgcatcgattagatgcacctaattaggtgtagcccccgactatgtgattagttaaaaactaaacatatagtcaaggcgcaaaaatccaaccgagtggttttacaaccggatcatccatggtatcacacagctaagcatatgctacgtttaataaaacatccagccgactgctttagctttgagataccagaaaagaagatataaaaaactccgagggagaaacacactgaaggtctataaaccaacacatatgataagaatccgagtaaaaactctcaaaaaagatccatcaaatgtggtataaatcatgacaataagtgagtctaaattgcctaagctatgactcacaccatatcaaaataagcatataacatgccgagagaatgactattcaaaaaccagtcatctcaacaaaacccgaacagctagcctaaaaaggcctacaaaattagtataacacttttctattgggcaccattttatttgcgtcgtagtaattccaaagaattatctaactgcgtcaaaaaggattttaacagcattggactatactgttgtgagcaagtgtcaccgaagcaaaatgcctaagtccctaagaatcacaacttagccacgctgatagcaaaattgggctgaagtactgtttaggcccaggcccattagtactcccgataccctaataaaataacactagaagcaaagcgtcggttcgtcttccccgccgaaactctcgccactttccccattctctgctatagtgcaaaaccacaccggcgaagctagggttcacagattcacacaaatccagcctccaaagccccacgaaaatctcccacgcaaccaccacatcaatctcccatccattcccagccacacttcgaaccaaatcacatcatccagttcgcatccatggcggaagagagagaaagctttgagggtcagtgggcgccctccgatgtaacggaggaaaacctgaaggagatggtggcgcacggcgttcttctggcaaaggagatcatcgggtggcgtctagcgtgcggtgaaacatttccgacccccgacacacacgaggtggtggtgttttcccatttcttttatggcggattttctcttccaacctcaagtttcttccgggggattttggatttctatgggatcagtttgcatcacctaaaccccaattccatagtccacatcaccaattttatccacgcttgcgaggctttcctgggtgtaagaccgcattttgccctgttctgtcgcatcttcttcctcaagccccagccaaacaagagcaaaccatgtgttgttgggggagccggtttccaactaaggggaaccttgagccaaaagtacttttccatgcccttcaaaacctcaaacaagggttggcatgcgaattggttttatgtgcaaaatcctgaatcagctcttcccgagtactcctgccttcctccagtgtatcaagatacttggaactcgcttccaatgggagatgaggctgctcaagcactcgccctggttgaccgtatgttgaagctaaaggaacagggtctgcaaggggaacagatcacccggcattttatcaagagccggctggccccaatcaaggaaagatctcgtacggcctttgaatttgatggcaagcatgaccctaaccgtgaagatccataatctcttgaattcaaaattatgaaggagagaatgtataaaatcttctcaaatgcaatcgtagtcagctattcgcacttgctgccagtggtgccgtacaatgctttcaaccctcctccactagcatgtattaaacatctcagcctctctcaaaagcatgcttttatcatctgcaaggttgattgaaaacttggaacatcatgcacaggagtttgccttgatgacatcagatcctccgattgcccaacgccgctcaccccgtcggcagactggccaggctagtggagggccaaaaatccggtccgacgctcaacctcacacctcacagccgactaaccagcctgactctcgtaagaggaaattggttctgagccacgacgaagatgataatgctgaaaagactggcagcaaagggatgactgggaaacagccaaaacaagccaacccgaagaataaaacagccagtcgtcccataccaaaaatcaggaagtcctccaggtacaaatcatttggtcattttccatgtttcactggtcacttactatcgaagtagcactaatagcatatcttaaatttgtaggaagccatctgacatagatctttctgataaagaccctgagccgactggcacggagactggtccttcaaaagaaaccgggccgactgccgaagatcgcccgagtgatgaccaaccagcaaccgacaatgtagcgaccagcaataagcccccgactggaaaccagtcggccgacactggagtcagtgctgatcaggagcccccgactggaaaccagtcgggtacagagcaaaataaagatatcccagaagtggaggctcaaaccaatagccctcccaagacggacgctggcgctgactctggaactaactctcctgttagggtgcaaggacctgctcgtcctcgaccggaaatcataacaggtaatcaaaacctccaaatcagttttgatccgacagactttcttcaattgtttcaccattattcatgaatgtataaggcccaatgatcggcgacgaagaagaggtcctccggatacaatcggctgaagattctcgcccacccatataagtcaagtggtgggatgatgaaatgcaaccacagggaatcatgataaataaacagaagaaagacgaggaagtgtgtctgctgaaaaagacacttagtcaagccactcgtcttgtaaatgtaagtctccctacacacagcttcaatcatcctgtcgaccactttgcttaaacaaagacaaatttgtggtgcagagaatccatcttaggaatgaagcgaagaccgcaaccctcgaaaaattagttccccaccttggaacccttgaagcaaccagagaccaactgcgtgaagccaaagaacttgccaggaagaccgagcatgacctcagagatcgaatcgccgagtttcaagactccaactttgagctgagcggttcatcaaaaggtaactctcatccctgtctgacttgtttcgtgctgctatccatatgcaactaaccaatgagaggcaatacagtgcaagctaccaagatatccgagctggaaaagcgaatcaaagctctagaaaaacataagggcgaactgacgaagcagagggactcggctttgaaagatgtcgaaggtacttgtagcgggaacttcaaaaaaccactcttatcttcgtgcccactcctatgaagattgcaaaatcaaatcctaggcacaattcgacgtcttggttaacaaaatcaagaggcttgaggaagctagagatgaagtcaccaatgctgctacaccacttgtccaagccatgttttttaataacaatggtccgagttcatttgacgcttccgaaatcttcgacaagttgagaattgctccggatacatattttaagaacatcaaggaagctggaagtatgggagcaagtttggcgttggcgatgaccaagtccttgtacccgaagatcgacattgatgctgttgatggctttgcagacgggacaagtgaagaagctgcccttgacctcatcaatgatgcgcaaaaagctgctgacaagatagccgttgatgtagttgagaggttccaggacaactaccttaggccgaccgggtttggtaactctgatgatgaaaaaactgaaactgattgaatttgtattttgataatgatgatggaggcacaatttgtacaatactgatgaatttatgctgtgcctgatgatttaaacttaggtcctgatttcttaaaagtttttgtcaaaccttattgagcctagaacccgcaaaagttgttaaaaaactttcagtcctcattgactaagccaaaaaatcaaacaaggcaatgataaatcaagtaagcaaattgaattgataaaaatcacactccattgttattatagtagctcccgactgataactcaaggaggaacttgatgttaacagtcaaagaggaagatacaaaatgtaatgcctaagcataaaaacgacgaagatgttcgatattccaagagttgtcgacttgagtaccgtcttcacgtttgagtcggtaagagcctagccgagtaacttcagaaattatgaacggtccttcccataagggagataacttgtgccgatcttgtgtagtttgaattttcctcagaaccaggtctccgacaaagaaagctcgtgatcgaacattgcgattgtgacaatggcgcatcccttgcaaataccgagccgactgaattagggttgcttcacgggcttcctctagtcggttgagatcatctactcggtcttacccatagtgctcctcgctgaagttacaaaatcgcaaagattcgaattctacctcgctcggcaacattgcttccgcaccatagactaggaaaaatgatgactggcccgtggcccgactaggtgtggtgcgcagggaccaaagtacggacggtagctgttctacccatttggcagcatagggatgcagtcggtcaaaaactcgtgcttttattccttgaagtaccataccattggcgcgttcaacttgtccattactcataggatgggctacggaggcataacaaattttgatgccgaagtcttcacaaaaatctttaaatactccgccagtgaattgagtaccgttattagtgatgatccgattgggtaccccaaaccaaagcacaatgttgatgaaaaaatctctagccttgtctgccgtgattgtggcgaccggtttggcttcgatccacttggagaatttgtcaatagctacaaagagatgagtataaccactgatagcctttttaaacgggccgatcatgtcgagcccccataccgcaaacggccaagatagcgggatggtttgcaactcctgagccggtagatgagtctgtcgggccaagaactgacaaccctcacatgttcgcatgattttgtcagcatcggacacagctgtgggccagaaaaaaccctgccgataggccttgccaacaacagttcgtgcggcagcatgattgccacagatgcctgaatgtatatctcttagcaattgtcatccttcctccaaagacacagcattgcagaatccctgattgacttttcttgtacagctcagtctcatgtatgacaaagtttgctgcgcctagagatccgctcggcttcgtctttatcttgagggagttcttgcttggttaaaaatttgatgaggggctctctctagtcggcttcgatcatgcttacttcttgagtgtccgtagcctcgactatttctttcctcggtacagttggttcgtagagatgttcgacaaacacatcggaaggagctgcttctcgttttgaaccaaaattggccagtctgtcggctgcctcattgttatgtcgaagaacatgggttagctcaaggccgtcaaatttatcttctaacttgcgtacctcatgccgataagcagtcatattatcatcaagacaggaccactctttcatgacttgattaaccaccaactgagaatctccacgaacaatcagacgccgaattcccaaagaaatcgcaatctttaatccacgaagaagcgcctcatattccgccacgttatgggacgcagaaaaatgtatccacaatacgtagctcagcctctctccagtcggggaaattagaacaacccctgctccggtgcctgaaagcctctttgacccgtcaaaatgcatagtccaatactccatcttctcagcaggcgtgtcctcttggaactcggtccactcggcgacgaagtcagctaaagcttgggacttgatagaagttcgcggcttgaaggatatatccaaagacatcaactctaaggcccactttgcgatccgcccatttgcttcgtgattatgaagtatatccccgggtggaaacaatgtgaccaccgtgaccgagtgaccttgaaagtagtgggataatttcctaacggtaattaaaacaccatataacagcttctgaacctgaggatatcttgtcttggagtcggccaaaacctcgctaacgaagtagattggtcgttggactttttgaacatggccttcttcttcacgctcaacaaccaggactgtgcttacaacctggaaagttgccgacacgtataacaatagcggctcttgcagatgtggcgaagctaagactggtggagtagtaagaagtttcttgaagtcttcaaaggctttttgtgcttcgggaccccactggaaattatcagttttctttagcagcttgaaaaaaggcatcccccgctcgctgagtcgtgaaacgaaccggctgagtgccgccatgcagccagttaacttttgaacatctttctgggagctcggtggtttcatgttgaggatggcgttgattttctccgggttggcttgtatgcctctatgggacaccataaaaccaagcagcttccctgacggtactccgaagatgcactttttagggtttaatttcatcctaaaagtgcggatgcttgcaaaggtctcttctagatccgtaatcaaatcatccttctgcttggttttgacaactatgtcatccacataagcttcaacgttgcggccaatctgagtcgaaaaacatctctggatcatgcgttgataagttgctcctgcgttctttaatccaaaaggcatggtgatgtagcagtaggccccgaagggcgtgatgaatgaagtcttcaagcagtcggactcctttagtcggatctgatgatatcttgagtagcagtccaaaaaactgagtagctcgcagccggccgtcgagtaaactacctggtcaatgcgaggtaaaccgaaggggtctttgggacgagacttgttgaggccggtgtaatcgacacatatgcgccattgccccgtcttcttccaaaccagtactgggttagccagccagtcgggatgtagggcttccttgatgaagcctgctgctaacagcttagttaattcctccttgattgcatccttcctatcctgtgcgaaacggcggagtcgttgcttaataggtttagcatcttccttgacatgtcaaacttgattgttgtctctgaccaccgaagatattgaggcgtgtcgggctgaacagcattgatctcctgttcggtcagcttttgctttcgcttggattcataagccaagggtccgccaaagatatggttgagttccttgcgatggtcttgaaaaccagtcggggcagcatcttcatcgtccttcttctttgacgtgctttgatctccgttagtcgtcttgcgtgcgttcttggcgtatcgctctgcgaactatttgtagacgaagcaatctttggccgcgtgattggaatttggatgatgcggacattgggagttcatgatcttgtcgaagctgttgatgcgcgaacgttgtcgggaggatggtgtagtggttgccacaagttcctcgggcttacgcttgcgatccttgtgattggtacttccactgcctcctgtagtcggcgtatctttcttcggcttccaagtggtgcccgactgcttggatgcggtgacggcattttagacctttgcatactcattggcttttttgaacatctgcttgacagtcctgggaggcttgcgtccaaacttgccgactaagagatcgtggcgaatgcccttggtgaaggcggcgatgatgacatcgtcggtgatgtcggaaatcttgttgcgttgctcggaaaaacatcagatgaaatctcgaagggattctccggacttctggacaacgttgtaaagatcgaactgagtgccagggcgttcaaaggtacccttgaaattggcaatgaagtggtcgcgaagttccgcccaagatccgattgtgccgcggggtaacccgtgaagccaggaccgggcagaatccgctagggctacgggcagatagtttgccatagctttgttgtctcctcctgctgcatgaattgcgagactgtagacggtgagccaagactcagggttagtggtgctgtcatacttctcgattccagtcggcttgaagccggccggccaatccactcgacgcaggtcgcttgtgaaggcagcaactccatccacgtcgttgtcttaacgatctggtgaatggtggggatgtagcctcttgccgcacggcgctggttgatagtttcacgaagatcgatgggacgcccatgatgtggggagcggggacgttcagctcgacactccctgcgccggtcaggaggcgactgaacgaaccgctcgccatgatccctgctcctgcgactggatcccgcgccgacgacgctgaagcttggttggtgatagtcttgagatcgaagaggcggaactcggctgccagtcggcgtgcggacgcttgcggagttgactgggaccgaagcagcgatcatggtcttggtctggttcaagatgttgatgacgtgattggcctgattgagtgcgtcttccttgaggagggtgtcgacgagggtgatcgttgcaaccgcgttctgcttgggggtgcgaaaaaccgccctcccctcgacgtcttgctgccctatgagttctcgtgctcgtcgctcggcctccaaggcacgctgtcgccggtcctcagcctcctttgcagctcgctcgcgctcctgttgctcacgctgcagccgttctcgctcttgtgcttggcgctcctcctccagtcggcgacgttcggcttcctgtcgcacgcgctgctcttctgcttctcgggcttgacgctgttcttccgtctcgttgtcggccatgaaaatgccaaagtagaggcgcgtgtagttatcttcaaagccttcatcgaagtcatcgaggttgtggtagtcgtagcggtagccgaagtcgtcgtactctacgatctcggttggtcgtgagtcgacaccaggggagctgaggtagccgtccaattgttccgtcgaaaccgtgccgagaggctggattatgacgccgacttccctggagctagactggatcggggccggggccggatcccgcctaggcctacggggagaggacgcccttgtggtgaacacggcagccaagtcatcggggagtttcatcaggattggcggataggctccatcgtcttgatcgggtcgtgttggagtatattggatctcgttcgagtggtttgtggccaactcggttgagatgatcttggggtagatctcggccgagttcgggataccgaacggggcggtgacctgacctcttcccgactggttcgaatccgagtcgaggagagaaatcttgccgaagttgttggtgatgaagtcgaggctgccgaaccggaacgcctgcccgggagggaagacgaagtcgtcgatgccggagacgaaacccatcgcactagtcggcgaagaacttgacgctacccttacctggcgcgccaattgtcgaaacaagatttcggcaatactgaaagggggtggctatcaagctggaaaattggatgggttgagagacaaggaattttatacaggttcaggccttcttaatcaagaagtaataccctactcctgtccggggattgatccgccgagtgtattattgatcgtatgatctaggagaaaatcgtgcccccaaaggcacccggacccctccttatataggggaaggagtccgtattacaaagtacagtccatatccctaacggaataggtagttacagataatatacaatcataaccgattgggatcccgggtatttccttgacatacaagtttggaatttaacccaagtccctttaaagatatcttatctatacatggcaccccatacccagtcggactatacatgccgtgtaggtatggggtatccataatctccacaatctgcactctgggtggcctgatcaaataggttgattttcttccaaacctcagatgccaacttgcagcatggaacaatgtgatctgctgattcaatagctgggcaaacagctcaatgcggatcagatgccgagcatttcctgaccctgttatcattcgtatttagtctgccatgaaaggccagccagaggaaaattttgcaagtgtttggtattgccttaatccagatgaatgttgctgggtgccataggatgccatgacattttatcaacctgtagtatgctgcagttgttaaacccattgagcttgaagtgcaatacctttcatctggttcggtgtgttgtatgtgctgggacattagtgttgctcggcagtcttcgacttcagcgattggagtgaggaacgagacagcatcacgggtgccgcggcggggagtggggcggtgcttgcggtggcaagggatggaggaggtggcggtggcaaggggagggggatcgatctgggcgggaggagaggatgggggaaaggagagcgcgtgagggagcggcgagcagcgtgatttttgcgcgaggggagtggtggggtgatatgcgtgtggtggagtacgcacggttttcaggatatgccacctaattcgcactactttcagaatacgccattgggacgtgaattttctgcagcaagattcgtcatgggcttcttctcctctgactccggcaagctccccctcttctctagcgccgttgatacccccaactccagcaggagacaagcgaattagggttttgggttggggttggtggtagcctggtagggaggggggttccccggggtttagagggatgaccatgggcaatggaggaccggaagtgggtggtggacacgggcgggcaacgaggtgcttgcggcggcaccgaagtcacgaggatggcaatgggcaatgggctagcattggcggcaggcaaaatggcgagattggttaggaagcggcgaccggtggtggcagatctagtggtgggtggtggacacaggtgagtgacgaggtgcctttggcggcgccagagttgcggggtttgcaacgggtgcaacaaggtgactctggtcaggaggcgatgggtggcggtggctgatccggtggtggggagatgccggagataggaaagtcagcagggcaggggcactcggtgttgttaccttgaggaagagaaggtcggtgaggaaaagggaaggaggttggccaagatggcctcgccggcgacgttgaccccttccagccagccgatgaggtcgggtggcagcgatgatgcaggaggcgtaggcgcgtgaaagcggcggcgggtggaccgaggagggaaggcgaaaagatagggttaaggtatgttgcatgaaatccaatggtccacaatttgctagatttggagttttttttatcaaaaatcaccacatagaaagtctcagaatatattatttaggatatattatatggttattatccatctaaatctgatccttttttcttgcaacaaaaaaattttctaaccaaatttggacgacaataaaggtgtttgacagtctccattggaggaaaaaagtgaattctaaccaaatttgttgtccaaattttgtgggacatttaaatttttgccacttttaagatatgacaattaaaaatttgccacgcattgtctatcatatctaggccctcatgtatctgtgacacgtgggtttagtagtaaatcctttgtcgccacttgtagaaaaaaatttgaaaatatacttttttttcataagttgcgtttatatacatgcatggcggagatttgtgaaaatatacctaatccgcgtgttggggatgcgggagcgacgcgtaaccgcggatcagaagagcgggatcgctagacgtcccggtcgcgcagaatgaatatgcgggatcgaagcggtcccgcatattgagcaggcggcatcggcacgatcccgcaggtccataaagctgcagcgcggtggattgtgggaccggccggcgccggctcggtcacgcagaacgggcgagcggcaccggcccggtcccgcagagtggctgtgcgggacggtccttctaatctgcgtgatcgctctccacacaaatccaatcactagtcaacttttgcgaatagtagtaaattttatgtccaatcactcctaaattttaggcacacttaaaacaaatgaagcactgagattcgcgtggtttgggcgggaccctgcatggtgcgcggtcgcgcggaacggttgagcgggaccgtggcgctgccgcacactgggcgcgcgggaccgtgcctgcacctctgacctttctgtcctcaatgatgcacctttgtcctctctgctagtacgagtaatctctgtcctctctctgtccactatgagtgcactctctccacgataactgttgcttctctctgtccactatggtctttgctccatgtttccaacccctctccctagtattccacgcgcacactttttaaactgctaaacgttacgttttttggaaaaaaaaattgatatacaaaagttgcttaaaaaacaaattaatctatttttttaaaaaaaattgttaatattaattaatcacgttctaatggaccgctccattttttgtgtggagaagatgggttcgaaagcagggcatgcgaagatagccatatgagtgccctctctccacaataaatgttgctttaaagctagacaagataaagaatccgcgccgtcaatacagtaaaacgttagttcgtgtcgtttcttttcgtttagagctcccaccataagagtagatggagagtgagagaccagatgcgtctgcagaagatagaagatctgcgcaaacgagaggagagatgctgctcgtacagaagtcaggagattgcacagaagaggaaacattttgatgatcttgcagcaagagaagaaatacagctaaaatagtaatgtatatattattaagaacaggtttagcgaatgcttatgtactagacataattattagtgtattagataagtaatagtttagatagtgttcatatattacatgtaaatagttcagttatgtttagaaattttaggtaccgcttaagctagaagttgataaatatgtagtttgaaattagtttgaatatagaatgggtttagtattatatttgttgtacataagacgtgcatgaattttttttttagtgtgttagaccgtggggagaaatgtatatatttcgaaagtttttttagttgtgtgtatgatatctgaaagttttttttagtttttttagtcgtacgtaatgcaattgtttatttgtttaggaatggcaaactttagagtatattatggcaacggggaaattatgtcgaacgaaatgggtgttgacttgagcaactttagttagtgcacactgtatcacccaaatccggacaatcttagaatgcccgaagtgtggtactggttgacatgctcattctcattggacccacaagtctatagtgttaatgtcagtctgttatggagtcgttcggccacggacatccaatggcaactgaaagaagtaacccgaagtcaatcatggaaggattggttgcaaggttgcagacgtcgaggatacgagatggccatgttggtgcaagcttgtccaaggagggctcgaccaaacagttcattcggtcagtccgatatgcagggagaggcatgtgctcaaccgattgcatttcatgtggaagtctcccagcataatgaagacaatattggcattgacatgcagagccttcatattgaacaagctgaacaaacggtggttgcgatgccgagcacggtgcaacaagatggttcgagtgaagccgatgaaggggaagagataaatggtatagtggacgagattgagagggttgataggaatgctcgtgaggatgaagctaacttggctcaggaggaggatgaggaggcagatgatgaagagtacgaagtccaacctgttatagcatcatggaaccgtgaagatcttggatatatcggaaagaacgagttgcatgactcggtatggttctatggtgatggcccaataaacaagggcacaatgttttcgacgaagtctgcatttcaggatgcagttaagtcgtggtcgtttaagatgcagaggcagttcaaagttctcaaatcaagcctgaccgtctacactgcggtgtgtgagacggaagggtgcaattttagggttcatgggcatgtgccaaagtacgagtcgtactggctcgtgtcgagagtggaggagcacaacaactgtatgctaaggaacacaaggtcgtcccaccgcaacctcaccgcggcgtatgttgctaacaagtactacagcaacattattgaagcggacgacctgctcgtgaggcatataataaaggcagtagagactagtgaacggtacactattagctaccacaaagcgtggagggcgaagcaaaaggcgatggagaaaaggtatggatcattcgaggtggcatatgacacactaccgcagatcctagatatcctgaaacagagaaatcctggtacctatgttgttgttcaagacagaaatcctggtacctatgttgttgtccaagacagggattccgtgtgacctccgaatttccgtgtaatggaaagggcattctattcattcggagcatgtattcacgcatttcaatggtctagacccgttctatatgtggacggtacttttcttaccggaaagtatagttggtctattctgacggttgttggtgccgatgcgaacaaccagataataccggttgcattcgcttttgttgagagcgagaactacgacagttgattgtggttcttgcagcatgtcaaatggggtgtggtgcaaagcatatcgaatgtatgcattattcatgacagaaatgctgggttgcttaaggcaatcaaggagctcaaagaggatcaaaacggagcatactactggtcggatttgcatagccgatggtgcatgcgtcacatgggtgcaaactttttcaaacagttccatagcaaaaggctaatgcaaatgttcaagcggctgtgtatgcaaaaccagcaacagaagttagaagatctttggaggcagctggatgatgcaacagcaacacatgttaagtcaaaaaaggattgcaagaaagatgaccaaccagccctggaggccttagaaccaatggacagtcttattacttccaacagtaaacgacggaggttggcaagaaacatcaagtgtttcacacattggattgaagcacagccagaggagcaatgggcattgctgcacgacaccgatggggccagacatgggatcatgacaactaatcttgcagaagcttacaacgctgttctacgaaaactaaggcctctacctttgacagctattgtagagggcattatgcataggacaacggtcgtacggtctggattcgttaacaatgtcgagtgttgccctcgaccattgttcgacccaaggtgtcatcttagcaaaaatatttcgccgcacgctagcatctgccttcctattttgcctgcaaaaactcatcattaagtgttgaggtaagtaatataattcggacacacgcaaattaatgggaatgcatttaaatataacttacaagtgtatcttgggggggaccgtttcaccaagtgggactggcacttcttggtaaaggccaaattgcctcattacatgctgcggactgtacgcctcaactgctatatcgtacagaagcatctttttcgtcagccagtaagacgagtcacacaggcagagtgtattgaggccagtaggggcacggcgttgtgtctcctcgttggtgtacggacaccactgaacgttatcctccttaagtagatcgaacacttcagtgaagtattcgtacgcacttcgaacctgaacattcgcccactgtggctgtatgttatgaaataaatattaagattatatatgtacgaaataaatgcaaatgttaaaaaaaatatacgtaccggtccctagcaccaatgcatgccataagtaggcctatcatctgtagtgttaccaaataaggtcgaatcagccataggttcaggcatgtacggtcatcccaatggaaagcgttcatacgaccatagcatgaccaacaatggacaaccagtaaacacaggctgcttaaagcttgtctttgtgcatgcttcacaaagacctcggtaagttgcagccaaaactgttgatccccaactccactggggaaagctttgtatgttgccctgcgcaataaaccttgctaagttaatcattcttgcatccactgtgtttctgtgtccacttgtgaacataacccatccaaaatgccatagaaggtacgcctccaaatgcaattccacatggtaattttccgtgtcgtctttcatgtaaccaacctacaaaggtacattgaaaagttcagtaacaaaacataatatcatcaatgcgaagttgtatggtcgaattagttttacctcgaactggctgagccagtgtaacgtagggccgcgcgcctcatcttcagagaaaaaacattttatgtcgctatcatcctctggaacaatgcaagcatatcttccaatgatatcatccctccaatccactagtgggtcagggaggacaattgcctgtcctgcaagtggcatccttataagcatggatacatcttgcagtgtaattgccatctctccacacgggagatggaaagtgtgagtctccggccgccatatgtcaaccaatgcagttagaagtcccttgtctataatctggtgccgtgtgtctcttcccaccacatcttcttcttcctcgtcatcgccttcccctggatttgctctccgtcggcgtgcactttgttgtcttgctaccatgtaatcctaatgccctcgagcctgcaactaacaaaaggaagaaggcctgcggtggacaaccttgcaaaacgacaatcgttgggtcagacaaaactaacactaattgaagtaaaaaaaatattaccaatattacatgtaagcctgtataaaaattagttaccttggtacccaacgttcgtcgaccccccacattggcaagtccgcgttatgaagaccgacagaccccttggacagctggaagacatctgtcgtgcacggtgccgtgcatcgatgtctctactgagtaacgggtagggccaatcgtccgccatacctgaaattttccaaattaatcagtacatataagcattacaaaaaatgaacatctgtgaaatatggattatgtcacaaatgaagatatggattatgtcattttcattttgtatgtgaagcgttttgatggccgttattaaacttttttattttgctgaaattattatgacacttttaaaattaccaatatagcttcgaaaatttcacgataattccatatagtattttagttcatcgagatttccagaaaattaactcgcaccatgatttcttaagaaaattttattcccttcttcatttcattagtttacatgatttgcacatttaatgaatacctaaacacatataaaatgtatatatgcttacctgtatgtctcctatttatttcttgtccttctccgaacttataatttctaaattaaatgcaccacgttcacacttataaccttcaaaataatgaatatatgtcaataataaatcttgcaaaatccatactatttatatcaatcccaaccgtcatgcaagttacctctaaattttgttcttccatttgtcttattcactctcaaatggtacactcaactaaaaaactttcttaccacattcaattattcgtgcagcacggctctaaatactagttaaaactttccccttattatgtacccgaaaacataatactacaaccattctacgtacatagtaaattaatatattttttacccatttgtctatcttgttcagatatcgtacacacaactaaagaaatttcaaaatatatacatttctcccacggcctcacacactaataaaaatttatgcacgtcttatatacaacaaatataatactaaacccattctatatttaaactacattcatactatatatttatcaacttctaacgtaagtggtacctacaatttctaaaatgccatataaccgaacaatttatatgtaatatataaacattatctaaattattacttatccaatacactaataattatatctaatacataagccatcactaaacttctactttataatatttacattactaatttacctctatttcttcaattgctgctggaagctcaccaagatcttttctctagctctcctctctcacaatgctactct

SEQ ID NO: 32502 - DNA, 29605 bp, Oryza sativa
aactgttcccagaattttagcactaccacctacaagttccaatcattttttttgttttaactgttccctgaattttaggagtgattggacctaaagttgaggagtggtttgcttgtttaaatgtacacaaaattttagaagtgactgcaactaaattttaggattaatttaaggaactttcgggggaggggaggggtggcccgggaccgttgcccgtctcgcaggttggatatgcgggaccgtatcggtgccgcatgcccaatatgcgggaccgaatttggcccgattggtcccgcagaccaccgcggttccgcacggccaatgtgcgggaccgttgcggttccgcttctccagcgtgcgccaccgctctgggcaccggtcctgcgtccccaatccgcggttgcgcttcgctcccgcagcgtggggctgcggattaggtatattttcgcaaatagttgccatgcatgtatataaacgcgaattatagaaaaaagggggtatattttcaaatttaatttgccacttgtaagagtggcaaatagttaattagtctaaattttgcacttgtgcaggtcgtccaaatgaccaaacggctatatatccatccatccatccacctgcatgtgcagcagcatgagtgcatgacccacccggtttgttggtttttttccaattcaacagcctcctctccgatactccaatctcccttgtccaggccaagtggccaactgcctacctgggtgcctatataaccgccaatcctctcactgacgaacgccaagagaaggggaaaagtaatcctccagctaaactagaaagagatgagctactacggtcagcagccgccggtgggcgcgccgccgccgcaaggtttcctatccagatccgtcccttccactcctcctccccatcttcttgtaactgtagtggttggttgatcgatctgaattttgcagggtacccggggaaggacgcgtacccgccgccggggtacccgccggccggctacccaccgccggcgcaggggtaccctccccagggataccctccgcagcaggggtacccgccgcagcagggctacccgccgccgtacgcgcagccaccgccgccgcagcagcagcagcaccacagcagcgggccttccttcatggagggatggtacgtcctcctcctcctcctctctcacctactactagctattatcccagacagttcgggcttcgggtttctggtggagatttcctcctcgtcggcgatgctcgccggcggtggagtgttgggtgggtggtggggggctcgacgacgacgggttaggcaggcgagttgggtgtggtggatgtggctcgtgacctgactgtgtctggctcactggcacgcgggccccacgcctcttctgtgccaacttctacctttctttttcgtctcttttcttatccgtccttgcgcccactcgctcccaatgtgaccttctaaccgacgactaaaatttcgaggtccacacaaatacgaaccgtaaaatttcgagggatcatcgtctgacagcgacacacagattgtgtttttttttctttctttttttttttgatattttaccatattcaccaagttgtagtgaataagttctctttttgtctttttatttcaacttgcgatatgttttcactggttaattttaattccacggttggttcacacgacgattgagcagttcgagtggaccaacaacaaatcacacgatttgggaacgttgacagcaatgcgccaccaccactagctagctaaccggcaactctcgctctgtaaagcgcagctggaagggatatgatcggtagtggttggtgatactgccaagagtagcgaacacacaacttgttggtccctctgggttttgttaattagtatgggatttgcacgggtaatagctgtattttgtcctttttcgccttttcggcgccctaaccgaatctgctttttttttctctgattttgcacagcttggctgcactttgctgctgctgcctgttggaggcttgcttctgatcaagtctgtccgtgtgaccaagcagtctcgatcggacacaaaccctgggattgatgtggaattattgttcctttgaaaagaaatatatggaattgttgggattggcatgtcgtgttggttactttctttgataagattagtagaatttttctaccatcacagcgtacaattatgtgtgtattgcctgttcaccagataagtgtatacccccttaacgaaatcattgtatttgatggattagtttatctagtttactgtaatatctcactctccccgtgttagtgactacaaatcgagcctcacgtcgagacatcttttttttcagactttaaactctatgatttcatctcaaagtatattccctccattttaaattacttatcgatcgttttatgtttgtcctacacatggcatttcaacatgactgctcaagaacccagatgccgcgaagctgccatgttgctcgcactgcacccattgatgcggcttctactaaagaaacaaaaccacattggtgatcgattactcacatatataccatacacaatttatacaatgtacaatcgcttttgaggttatcatagaaagttagaaacctcatgagcaacaccgggattgcgtgcagtatctcatctgacagcaaaattgttaacagccatctgcccaatctctgctgcccggagccgcttgatgtaatattttgatccacgtgaaagatcgattcgttttctcctctgcgcaggcagggactcaatcgaacactccttgaagccacgccgaacaaacctgtggaaatgtagttataaatgagcgacattctgcgtcatccaaagtctaaacaatgactggaagtacatccagaactttgttaagaaaaagaaaaattgcaccacaaaattgttaacaaatacagcaggtactaggttgactaagtttaattcatgtcgaaacagcactgggaagcaccttaatggcaatgcatattaccatgtgacaggattcgttaaaaggaccttgaacataaatagaatttgcgccgtgctacagcataagtacataccagtctgctgttcgtgtggtgagcaagaatattttctcaagaccaagcgataatgccttcttctcgacgtaatctaaaggacagatcaccagggtaagtataatgcatagtgattgactgtagagcaaacaaaaatatttcgggaaacattaactttaatactgagacttgttgaaaaactgacaccatgttcattagaaaatccaaaaggatatatgccaaccacaacagatgttaattgctcatggatgctatatgatctatgtaaaatgaagaaaaagttgtcaatactcaaggtagcagacatgccaaggtgttctttttctcattttattatgaaagtattcaagttgtactaatgtacgtagggtctccttttttttttttgtactgtggcaaaccctgaaacctgcttggttctggccttctaagaaagcagcggttttggaatttcaacatatttctttttaaaaaaagtggattaaacaacacaaaacagagggcgaatgatgcaggacagatagggaaatcatgttgcaaccagtccagtatcactggttttccaaaccgcatgttgtacaaacacttgatagccaaactggtatctactaaagaaatgaaaatgcagaaatcgtacaagtaacttatccccttgaccctgtcctcgacattcttcagatacagcaatagcggcaacttccccagatttatcctcaagaaatggaaagagagcacacatgcaatgattgaaccatctctttccacgacgataaatgacttcaatgcttctagaagctaataacaaaacataaaatatgttcagttgcataaagggaatgtctggactgaacagtaatgtatttatatccattgctaaatgtttacaaaacgagatagtaaatgtacctctttatctgttcgccgcactaggacaccagattcttctaagggtcggatgatctttctaataccagaaagatcttcttctctagccatccttgttccttcatacatgtctctgtgagaagaagcacacaaacatcatttccttgcatgttgcttgtgaaatatacaaaatgaaattactagtcacaagaaaatattcaatggacaaaagatcctgttttcctaatcaaaatatcaaataagaaccaaaacattttgtctccaagaaacatgaactataaaatggagaaagcggcaagaagataaacttattatataatcgaatattgtacattgccatgtacaaaatggatagaaggccgtctttcttttagcaaaaaccagggaaacaaatgttttgtgaaaatatattaaatcacttgttcaggaaatatattaggtataatgcagttataaagtttgccggtttgtacattaaaactggcatctaggatagagaaagttccaaacttctgacctagctatcatcgttccaacaccatctcttgtgaataattccaacaacaatgatccgccaacagtgccatctataatgtgaaccctttgaacgcctccctgacatttagaaaataggatgtcagagtaacaaaagaaaatgaacacattactgatgcaactaaggcacacatatacatcacatagtgttgcctcatggaaacataataacccaaggatcacggcaaatatcacttccaacacgttaatgggcatccaagtaatattagacaaggaaatggcacatcactctgtaatagaagataatccagcagaatggtggtctaatattctaatatatgaatagaaacataatggcacataccactgagtaaaaaagtccactagaaacatattcataagcagtttagaaaatatgagcatcagaatgtggcgaagtgcagggtttaacttttccctaattgctgaaagaacctcacactttttcaatcaatagcaaagaattgcaaattttaaggaatgggattctgtaagaagctcaaaacttacattgcatacatatgctgctgctgctaactctgaaaggtaaccatttgacctactcaaccgctcttccccaccaattgcaaacccttgctcaccagacagaccatttccgttattgaaacccacaccattccggaaagatgcagtatacccatcaacgaagtcccttccaatcaatcctaattctttctcctctttgataggaagattgcgagcataactaatatcctcctcacctacaacttcgacataatttgcagcaatctcactctgcttagcacgtgttctgatcaacatgtccgcttcttcaatagacatgaaacgattgactcgaccatgttcatcaaatatttgaccatcaacaatgcagataagcttgtctgcctcgatagctaaagcacaagctgtagcgacttcatatgtgctgaaagtaacaaaagaatagttatgtcagtacttactataggaaaatggtgcaattatcttctatttcttatgaaattctccataaggtatatgacatggatgatactgatttttagatatcttaagaattatgaacacagattcacattaatcacagcaaaatttcaaataatacagtaaacatacttgcaattcaacacctcgccagagctggaatatcccatattgctcacaacaactatgctatctctatcaagtctttcttttatccgtgaaacatctattttcttaacttcaccagtgaatccataatcaatgccaccaacaaccccccgtctctgccaaaagagtagagaggtaaatcaattcaccatttcatgactaaaaattatcttttgaaacaattgaaacaaagggatttatatgacttgctagctagagaggcttactaattgccaattttgagtctcactttctcacttaagtatgttcacattacacagttgggaatggaagtgcaaacattaattccacttttggattcaatagctattaatttgtataagacctcatgtattattgaactatgcgtctattatctgacagtcatcattgtcctcattgcacacggctgagaaaataaatcaactcaattcgttctactatcctagaagtgatggaaggttcagtatgtatattcaccttagcgccaagaaagtttccacttgcaacattatcacatatttcatgccaacgaccattaacaccatgccgacgaagattcaacattgggggaccaggggatagttttgcttctatagttaagcgtattctgcctgctgcctccattgcagcctctaatgaatcagaatcagtaatacggtaacgaccagcatacttggccttcttccctgagaaaacaaaagaggggcattcagtaatcactagcatgtgaatggcagaatatcagactgggaaaatcatacattatcctaaaatttaacttcaattaacagtcgcatgtttatgtgaggttgcagatgcaggcatcaactgcaaatctaatacaagcagaagctgttggagtcctggattttatgtatattgacacaaaatgacaaaaactactataaaattaagaatcagtgctatagtaataacgagtggaattccctactggtacttttattattccaaattactgtattcaaatatctagttgcctacttggtaaatgcttttgattcgtacatgcatatgcaacataatctaatgaatgtataaaataattaagtcagactcgctatatgtttttgctttgcacatgcaaaaaaccataatctagccataccatgttttccttcaacatgcaaaaataacatctatatctatattccttgaaaagaatgtagtggtggtggtagtgaatctgccaccccacctactcccattgcaaacacccccttgaacttcttaatattaaaaaacaatcaaacctaaatgggtaacaacatataaattcaaattaaggtgaatattccctatagagagaaaaataatcatggaaaatatatattttgtatttaaaacaatatggtaatatattttcttttatccatagcaaagcacgagcattcagctagtattcaaaaaatgaatgtagaaagcaaaaaagaaaactagggtatgctaaaaaagttttagtgctagtgagttgtaaaacacaacaatgtcagttgtttgatccatttaagcatacatgtgtaaacagccaaagcctcagctaacctctctcagataggagcttatcaatctgaacatgtgttccaggaacaagaacaaatttgatcccaagaccatgaagaagtgaaatatcctgtaaattaaaacaactgtaatttagcaggtagtaggggaaaaaataacagttcagatctccataactcataaaataaagtagcaaactcttctacctagcgaaacgaccttacatataaccctggtataacaatcttaacaggacaatattgactgggaagtggaaacgaagggcaaacaactgaacatgggaatttgccatcataatggccacaaagacgggacaaaacaaattatttgtccaatgcaagcaacaattagatgtaccatacttattagcactgtctttatctaaacctgtagccggtagaaataggcatttaacaactgcacactagaaagtttgacctgaaaaatggaactcagtacttacctaccacgcacatagagcatgtataaggttgatcacaccaacttgcaaaatagtaggaccagacaagttaaacgaaatgtcaccagttggtacccaaaaaaaaaaacaagaagaagaatgcatggaacttgctttgagttgaattaacaaaacaacaagactgaaaaactcaagaacgataaattctacttacaaggaaaaaaaatgataaaatccaaaaaaaggcaggtgatatcaacaagatgaaaaatttcagtaagttagttatatatagcccagaaatgtcttcttttattttaatctttatgaaaacaacatgactttttttaataagctcttctcagtgagcaaagcaagtggagctggtcaacctatccaagattttgccacaagttcaacggaggcgttcacatgaaaaggactgaaataggtggtgaaaaaaacaagggaaagtaacacacgtgcaactaataatcttatctatcttcctagttcaatagagagggcggaacttgttaactttaattacctcaacctttccctaacagatcgaataagcgcctaagatcctccaacgatgttgatctcatggaagcacaaaaacagtacaatgatggaagtgatacccggtgaagcaacgcgacaatgaaaacccataatgggacacgccacccaaatggtctaaaatttatctgtgatgtaatgaaatcaggcagcgacacagcctgctacagagtatgaaatggatcgattcattccatccacttaaatggaacaaataaaacttcacaagaaaaagttactaaaagtcggtagacacaaatcatctgctaataatctggtttcctaatcaatttcacgaatcgccccttctccaagacggtttttccattgccccctgaatcggattcgaccaaagaacaaatccacacaaattcaaatcgttggttttaatagcacaagagagagcagggcgaggcgatacctggagaatgccgtcgaggtggggcccggcgacgacctcaccggagacgacgacgacgaaggtgctcccccggtggccacggacgtagggccaggcctcccgaaaccaccccacgaacctagtcccctcctcctcctgatcctccgccccgcccccgcccccgcccccgcccccgcaggaggccccaccgaacgaccgccccgcccccgcccatgcgcaccgcacgacgacgcccctggcgcactgccgccgcatcggcatcgccaccaccctcccggcgcaccgcgcccgccacgtccccgtccccgcccccgccgcagctggcgccggggacgcctcgccggcgaatcgcgcggcggcgagcgacgccgccgccgccatcaaaaggggtcgacgagccttctgtagtagtactgtagcagtagtagtagtaatctgtacgcggcgagaagagaatggaatggaatggagcggagcggggaaagcgagggggagagagacagagagagagagagagggagggagagcgagcggtggaacgagtgatttggcgcgcagcgcagcgacgacggggttgtggcgtgggtcgcggcggggaagggaggagggagggcgttttaaatacgcccgggattttggtcggggggtgccggatttggtgttggactttttctcgctagctctcggtttcttctctgtcctccttcttccggtgatcgctattgatgactcaatattgccgtagtttatcaacatttatctgggaagatcaggaggagaaggcgccggtgcagtgcagtgacggggaggcaaggggttgggcacgcgagtacgcgacgcgcgcggtaggtggtgtctgatcactggttgtggtgggtgtgcgagtggtcgccggctggcggcctctgcgcacgtggaagggcgccgccgctacaaggcgcacgccacggcacctggagcctccagtggctaccgtaatatatactcctttcatcccataaaaaaaccctaaaattaaatataacatattttagtactgaacatatgtatatattctaacttctaaggtagtacacagacacaagtgagaggatcaatggagattattgggtcccggggaatatctcatagtgtgatgttttcctttttttcctaaggtgatctctcatattatggtgacctcttgatgaatgcctttcccatcgtcgaaccaacatttagcctaattgcttaaagattcgtacgagctctcatctctccctatttacccaaaatcaacactgctcagcataccatcatgaccctaaccccaccttcttcctatgccaacacctgcgccggcttcgatgacttcgatgagcccttcagccaagatctccccaccatcttccttgctcctccttatgatcttccaacaccaccacgtcacctttcttcctcatctctgatatcttttcccctcccgctaactatgtctacatcctcactgctctagcacctcaccgtcgacccagccctctatagccatcctcatcatccctctcccattcccaccacctccatttcaaaaaccatctttaaaattattttgttgcattggattgaacggattatctctatttatttttgaaactcatcagattaccccgtgttgaagttgcgtagagtccgaatagattacacactatttatcccgttaagttacaacaatcattttctataaattgttttggtagtacatgaactaataaggtggatacaatttagtatataaacttgtaaaacgctcatcttaatacataaatttgttcggtgagtgcgaaccaaggctaaaagaatacgatatggctaatttctcttatttaagtgttgatgaggatacgacataaacgcgtatgcgagaagatgccacataaacataggtatgttcaataaatgtaaaataagacataaatattgtataaagaaagacatagaagaactaagatgcaaggatggataaaaaagaaggataatatagaaaccaagtttaacatgtctcatgcccacctcacacgtgcatatcatgtcctaataattagcatccaactgggcaaaattagcctagtcatgctattttgatcttggtttgcacctaccaaacaagttcgtgtataaaaataagatttttataagttaatatactaaattgcaccaaaatgacaagttcgtatatttactcttttttttcatttagtatccataataaccattaaaaataaaaagaataaaaccgcaaatttcgttcgacttctcctggttcgacaccctcattaggattcccttcatctccatccacgcaaaatgggagaaaaatcgtgctgatgtaaatctatcgacctgcccccatcatagagaacaagaagataaaagaaaacatcaaatcccagttcccttccgacattgatctctctaccaacattatcgccattgtcgtcgtctccagcagagacaagactgcaatgaagagcacacacttgagctcaaattggccatgatacccggcaaagacctctccgtagaacagtgagagaacagtgagcctgatgctcacgggatcgtgtcactgctctctgctttattagattccaagccagatcttccttgtcttcgatcaatcgagcctcgtgcgtgggtgggtaccatctttgattcttgtccatttcttttttgccaaaataaataattttataaaagaaaaaaaatcgtccacgtcagactgattggaggcatgatgacaagagctagctagctagcgaatcttaaattttgcaaattggtcattggaaaaaaagactgcgatttctatatcttggaattaatgtagctgaacagtgtgcagagattatggacgacctaggtctacaagttgcagaacaagaaaaacctctctcgcgtgaaaggtaccagcatgattggattggaggagcaagcgtgataacgagatgttgagtagtggatcaagatcatctacacataaaaaattgctcatactcctctgttcataaatataaacttttctagcatataaaatatgtcaacaaatactgtttttctcaatccaactacttcatatggttctctgtaatttttgttgcatggctagatatgatctttcttcagtcaagtaggatcttagaggcattaaaatattttaccttaatatcaatccccgctaaaactgctaaaagcgatgcatagatacatatgctcatatgctacctggaatgcaaatctatcgtatatatgtggcctttgtttacactaacagatttgagcacgcacgaccccgattaaaatggtgttttgtggtacttatttttgctgacatggaagataagagataagcggagagaaaggaacagcgaggagacaagttgacatatataccccttcgtctcctaggtaaaacccggcgtgtttctgcaggaatttagtataataacaataatttaaaataatacgtaaaatagttaaacgatataagcttatataagttgacggtttatgataatttaaatgtaacaatagtatatagaatgataattcaaacagtatatggaatattgattcaaatgcaaaaataaggtgacatggaattatgagagaagaaaaggaggaacataatttggaccgtagattaattatctaaaggctaaaacaattgaggtgatatattttaatgagaaaatgaggaagataatttagaccacacattaatcatctaataagggttaagcacaattgatgtgatatggcttaataagaaaagagtgaaataacattaattaataagattaactatataggtatatatgatattataaaaacgatggagagatatattaagatattatgtgaattatttgggtagtgatttaacatacttacattaaaagccctaaaatttaataaattatagaattataaataatatagcttgtttgcatgatattttatatttaacaattgttaaaggataatgatgtgacatctttgtgtgttcaattttaggatttagtgggttgttgctttatagcatatcggtgatatggggccgggggtatcatgtttagagggagaaggtcgccccccgaatccccgtggcatcccctgagggggtggcttccggggtggagcggcggctgccccctcccagcttggggtaccgagtttggagggaggaggttgcccccagacccacgtggcacttccccgaggagggtcgggcccggggtggagtggcggctgccccctcctcgctcgagggtcggacccgtcccaaccccctcagcgcatcagcctacacgtgcgagttgggtgggtgcgcacagtgcccacttaaccacatttaaagcggaccgaacgggcgcgccagcgtgcaacacgcctgacaggtatgtgaccggtcgaatgattgacgggactagggtagtgcgcctacgcactgccgcgcgtcaggcggcgtgcaattgccttgccccgtcacgtcgtcatgatgagaggcttttagcctctcctcccagccggagctggttcatccgttttggtcaagcagggttctcgtttcccggtgtgaagagaacccaaaagtcttcacccattaaatggcgaatgacacgggcgtccctcgtgtcaggcggcatgatttgacagtccccacgctgcagcgggcatgcaagagacttccaagataggctccatgggcccatgtggtaaccccttgagatataaaaggaggtccaagcttacttagggaggggatgagcgctttttcacgagagcagtctcctgcctcttatcatcaacaccttctactccaacaaagagatcttgtaatctctcttcctcaatcagcatagcacaggagtagggtattacgtttctcagcggccggaacctgtataaacccctattgtctcatctcccccgaggggcccgaccctctcttgttcacactccaccacagagtcctcgaatctcagtcaccgcccccggccgaacaaaaaaggggacctcacggttccctggcagaggagttcaccctccgacataacaagataggatttagtggatttgttttagttttatatggtgattataagtaattaggtgaaattaaatgggcactgttacgatggaatgaaatgaaaattatgtagaaaaattaaatgagagatgataatgcttgattgagattattgaataagtggagaaaatatgtgataaattttgaaaagcaaaagttaccatatttttaagacgaagggagtaacacagaacgatatagatgcgaataataaatgctaaatgtcatacgcctcttgtacatctgcgtgtatatatgttaccagattttaattgatgttaattaggattaattgatcaaacatgtctgtgcgcatcgtctcagattaatggtgtgtttagttcgcgaaaagaaaaattttaggtgtgatatcggatgtttgaccggatgccggaaggggttttcggacatgaatgaaaaaactaattttataactcatctggaaaccgtaagacgaatctttttagcctaattaagccatcaatagcacacatgggttactatagcacttatggctaatcattgactaattaggctcaaaagattcgtctcgcgatttccatgcaaactatgtaattagtttttgtttttatctatatttaatgctccatgtatatgtcaaagatttgatgtgatgtttttgagaaaaaatatttggggaactaaaccaaccctaaacacaagtgtctgtcttggtcagccaactgctgaacttgttctcagtgctggactttccaggaaactagccacaccaattacaatagtagtatttggtccacgcaagcacatggatcatgcggtcaatgaggatacgaagaacgaagaaagcacctccatgtccatttgcctacccaacaatgtgttatatatgtccttcaaacaacttcttaaactaataagataaagtaatccatgataacatatttgacgccgctatggccaccctacctagcagagtaaaacaaactaagaatttggcgtctttacgtaaccagataatcctcatgtttttagccagcgcccgtgtcacctcgctccatcgcctcctctgcctcgccaccgcccgagcagccgccgacaaagccgggcggcggcaaggacagcggcggcggggccttcttctccctcgcacctcttcccggcggatggagctccgacggggaacggaaagagagacggagacggtggtcttcggtgccgccggcggccggaggcgacggatccgacgccgatggaggcaaatctagccccctcgtggccaagtcgggagggagcggcgccggccgcgccacttcaaaggccggcggaggagatcgagttgccgttggaggaggccgtggcgcaggcggaagaggcggacgaggtgatggcggcggggctgaggagcggcggcggcggtgagtggtggtggaggcggcggagtccaggccagcggcggcggggatggagatggcggcggggatggaaggtggtggaggatggcgacggcaggcaggactcagtcacgccggaggcggatccgtcccccctacccccagggcggatctagtgcggggcgagcttgcggcggtgacggcactacaaagctcacgtcgacggcgtcgacggcaacggcgcgggagcacagggcgatggcgacagcggcagcagcagcttgacggcggcgtcatcacggtggctggtcgacggtagtggcggctgccggctgctgtggcaacggggcgcactcacggcggaggcagcggcacggagcttgtggcgacggtcgctgtagcggctggacggcggcaaggtggccgtcggcagcaacggctgcggtggtggtgtgggaggaggcatggcgacctcggacggctagctgagggcgtggcagatggctgcatctggccggcacggcagcgtatggaggaggggtcggagaccggcttggtgcagagaggcgcggccgatggcagcggaggccggctaggcaagaggcacgggcggcggagatggaggccggcttggcgcgagaggcgctgccgatggagggaggccggattggcgcgagaggcacgtccggtggaggaggccggttggtgcgagaggcgcggccggcggtggaggaggcgaccttggtgcgaggaggagctgccggtgggtgtggcgcggtcttcggtgcacgaaggcttgccagcggggggcgccggtgcaggggtcccacatatcagcaaaggttgagtggtggtggagcattggtgcgtcaaccgtggattcgcaggtggtgagcagcgggtgaaaaccaagctcggcctttgccggagcgcaacaatggttaattccccctcctgagggcgttgtcatgctgtctcacccctcaagggtggttgccgggcgaaagcccagtcttggctcctttaagccccaacggacagcggcggcagttttccgtcgcttctcttcttgaagacgtcgttttggcaccccctcgtctgtgttcctttgttggtctagcggcggtcggtccggcgctagccttctcctagacttgtgtgttgatgctgtcggtatgtggtggtggtatatttttttcctttttcctggttacgaccctccagggttgtaatgttgtaatttttttctgctctatgaatagaacttctcaccatctcgtgcgagtcgttaaaaaaatcctcatgtttatgcgcgtgatttggtcagaagagtcgtacaatgatattattatgcaacccctcctgctaccgaggtagtccaagagggattgcataacaaaagttggagacacaaagatatgagggtgtggccatcttctcattcattcattcattcacctgtacaatcctcctctctactcctctatttatagccattctctcttctaccttccatgtttagtgatgggcccaattactgggtaaccgggctgggccttcatgggccagcggtttcctaacacttccccttgggctctcactgcgtgatgcctatgcctcatcaaaactcaacaaaaacccagtgggaaaaatttagggaaagagtacatagcatacgcttgcaatattgcatgaattgcctcattaaaaaccttgataagaaattgctgggaaaacttatccaagagaaaaggagtacaatccacccaattcttcgttcaatctttctagattgatttttgggtacttgattttctatatcaagattcttgaatgagtcagcaaaattctccccctgaattttgcatttatctaagtctcattattccgatttctcggaaacacctattcaagagagaagatgtcaataatgagcggatgaatctgcaagacttccacataacttagttcgttgcttctatgcaattcatgtacatagaatagcttgggggttcatatgcttagtgagtttgcttctcacgtaactcatttgcatatgtgcgacatatgctgctttaatatcataaatggtgggggttgagatagttttcaaatcgcaattgctgtcgcgggtaaccatctctcaaaaccatgccgaggcactgaacagttcaacgatttagttcaattagccaaatattcatgtgctgctataactcttgtgtttgggaattccgtcccattttggcgataattgactattccgaagccatgcaccatgaacatttcaaagtgcagttggactgatgtactagactttcatatgttgcatgcctttagctgcaagcgtaagcatgatttgggttcagccaaatattccaaatgaagccaaattctaattcaaaatgaacgattttgtttcttcaatccttttcaaattactctatttgttctatgttgcttcaggacttagtacttcttcatgtactattatgcaagtgtccgatccaagcttctaaagtgcatttattgattctatattcaatgcttatcaacatttgggttgagttcttcttttcaacttctagtttattaattccattcaactcctggttgactgccaatgagttttgttgtcttaaaaaaagacattgcccatgataggtctcattgccaactcctattggttgcatgaggctctatgcgagtatccatggatatacgaggagttgcattttcatatgcttcttcttcctataattgcttaatacttcttaatgtgggcatgtaccagcgttagtgtgcactcgaatagctagttttcttccttgatgggaaggtgcagcacgcctattctgaggttccgtaccacttgccagatctcaactggctccccttctatttggtggggtacttttcgtgactttgagtatgatagtccctcttgccctattttcaccagatgtctccggttactttagggtcatgaggagctgaagtttcttgtccaattgtttttattcgaggcctctagacaagatgagggatacatttactttcttcggtatttaaccctcctccggtgcattcatgcaacttagtcaaactcttcgaaatcacaaaagtatttacaaagtggtttggcagttttaattctttatgcaaactgtatttactagtgcggtgtaacatgcattagtccctttctactatcatatttcctgacatttcctatctaggggttcattctctccccctaaatgactggaaataattcttatttgttaaggaatttaggcttcataactatcttcgtaaaaggtttccgactttcggagagagccttttgcaacgcattatggtagtgggatatgcacataaaccaaaacagatacaatagcactagttgcagaatgaaagttcatgacgatggtctgaattttctatcagagtctgctgttttcaggactacatgtccttttctactgcgtgtattacaacaatgatatagcaaatattgcaattcatagcttatacttagtccgcttatgcggatatttggtacttcgtgctgccaattcaccaatcatcaaatacaatgctagcgttgtcctcgcggacttctaaagatgatttagtgagttatattggagttcacgtgatattgctggatcagtcttggcaaagacacggtgtctaagagacactggatgtttgctgcttcggaagcgcatttatccatatagtaccaaataggaccgcaaatattcctcctaatccagttcagggatgcaggaactatacctttgtattatgcggtttatgcattaatctcctgttggtgcatactagcacacaagtcttcatgatttaggaaaattatgcatgtaagtgctatgaccatacgagttgtaatatttattcttataattctaagacccaaatggctgaaaattcgttactaaaaggtgtagcccaaatcatcacacttttagaaagttcaacggggttgacggacaatggatgcttctataaagtgcatcatttgttccataggtaatatgaccgtggcactttctaggccgacaaatttagttgttgctactagtaacgatcataattttttctagttctatgggtatggaaatacctctttctcttaaagtgttatttgtggttatgcggaccacaattcatttttcttttatgtttgggtgctacacaaaattcaaagcattataactatgtgctagaaaagagcaacaagatagtaaatgccttaaatatactattttatactggaaataattctctattgcagggaaaatatgtgctctacttgggcaaacaccatttcttcaatgcaatgttctattcaagaattgcaacatgtgatgacgaagtttattgattcaacgaagtattccgctacatcggattcaattaacttcatagcgagcttcttactcaacagctatcgcaatgatttactatcccgacataaattttagggccgatccaatctagcataggagattctacgtccatagccatgcaaatagctaaggagttctccccctcaattcatgatgattgtgctattaggatctgtccttttcttttcatgttcataattctagattgttcatcttgacttgtgttctactcccccttttccccttctttcgttgaggtaagtacaccaagctagctactcctgttgaactcgctatcaactatgctagttggttttggaagacaatgtttttctagtgaacactatcccgaacgttacgtaattccattatcaactagttaggcatacttcttatacgtgtactagtgatacttgcgtgcgactttcatcgcgttcgggtagaacattaagagtttcagcggcattcaatgccaatgcaatgcatcgtattaccatactctctatgggtcatctgcttggtgaatcatagtcgaaaaatacccgttcttgcttatagttcttgctctacgggaggtagggtatgtaccataatcctctaaatgctagcgcgctcattcgtctagcgtactcattcatgagagcagcttggaggcactagcgagagtttgaaatactagatcaaactcatcgagtcaatgcctatagcacgattggattagcggtaacatagagcttcttgctctattgtaatttcgacatcgaataaatatgtcaaagatattcaagattcggcaaattttctaattcgcgatgcacgtcattttttcatatatgcgtaaaattagattcaggtaaaaatgcacaattgttgcaatataatggtacacaaaaattcctgcaaataattccaatatattctatgcaattctatacattttaccacaacgatattaattaaaagtaataaaacatcacaaataattaataattgtaaatgcgataaataaatttcataatcatatatatcagcaataaaggtacctgaaatggaaagtcggggtcgaaatccaatgtcccgtggtccctttttatgcgagaatatgattttggtgatatttgcaaattccgaatgccgttcgaacgaatatcccaagtacagagggctatttatgagtttcctgaaaagttaagggttcaaaaggcaagatttcctatccaaaggaaaatgcacttagtttcgcaaaacttcaggggtctttttgcaaaatcacgggaatctttccatttttcttttttctttcctttctttttttctttcttttctttcctttttcttgcctttcctccttctcttcttcccccggatggggctcctgccatatgtggcagcggccggccatgcgacggcgaggtggccgggcagcggcgcgggcgcgcggcggccagggcgcgacgcgcagcggggcggcgcggcgggacggcgaggcgcgcggcggccatgcgaaggcggcgcggcgcggtgacgcctactgacggatggcgtgggacgcggtgagcggcggcggcgcacccgtgcggcgaggcgcggccgagacggcaccaaggacggcgcagcggcgcacagccgcgcggcacggcgcggcggcgagaggtggccatgcggcggcggggcgcgcggcggcggtgcttggccttgcggcggaggagcttggccagttggccttgcggtggcgtggctcagccgggcagcggtaccaggcgcaggcgggctacggcgatgccatgcggcggcggcgcgcccgtgcggtggtgaggtgctgccgcgcgaagacggtgtgcagcgttgcgcggcgaaagccgacggccggcggggggacggccgtgcggcggctgcgccttcccctttttctttttcgttcttcttcctttcttctctcccctgatggcaccggttgccatgagtacggtcggtgcggcgtggcagccgatggcggtgcggcgcgacagaccgggcgccgacgtggtcggtggcagcgcgcggctgcacatgctgcggccaggccagcggccgtgcggcggcgtagacactggtgtgtgtgtcaatactacgctaatgctttctgcttgtttcttttcttcttcttcctctctgtcctatccggccagtgccttcatggcaaggagcacagtgcgagtgcgtctcagtgcaacgcacggcggcacgagcattggctgcgacttaggcgccgtgctagtgcgtagcacttcgtcctgatgcagtctcgtcgcggccgtggcgcgggttgctgcccggtgcacgccggcacggagcgcttccagtgtgcgtcgccggtgtgatcttgcggccgtggtgtcgcgacgctcgggttcgcggccatggcgcgtcgccggcacgctaatgccgtgtttgccgaccgcggtttccaccgatcggcatatgccggcgactccaagtctgctgcggtggatttcgtcgggaacagcaaaaatggaacgggaatagggagaggaagtcgttttcgcgattgaatcagcgagatgcaaaacggatctacgagttattacccttcttcttcctcggtcatctacgagttcttacctccggtagactgtcgtgctgataacgtattatgcaacccctcatgctaccaaggtagtccaagagggattacacaaagatatgagggtgtggccatcttctcattcacctgtacaatcctcctctctacttctctatttatagtcattccctcttccaccttccatgtttagtgaggggtccaattagtgagtaaccgggtcgggcctttatgggccggcggttttctaacagatatatgctgacaaacccttcgatgtctcgtgtcgtgctacaggtttcacaacactctacgaagccaaactgaaaataaaatgctaaaatggttttataccatccaaatatcaactaaatttaataaagaataaataacacattgcactgggtaaagcgtacctgtttcactttgcactgggggttgtatcatatattaaagaaaaaccttgtaaaatatgtttacaaattataaaacctttttgaatttagaccatgtttgatgaggatttattcaaaattgatgaaatgtcatgaaaatcttgtatatttaatgacgtatcttggtgttaagtgaaatttaaattattgaatcctggtgtaaaatgaaagtatctgctaaacctggtgcaaaagaaacaaattttctctttaagaaattcttattggccacacatgtcagtccctaattaaccttcttgttgtactaacttcccctctttctctcttgtgcatggagacagcgctatgccggtggatttatttttattttttgaacttttaaatttttaattttaaaataaacccttttaaaacttatttccaatatctgaatcttttagccacattagccgtggcaaaataacattatcacactgatctggctggtgtgacagcattatttggtcacaccactctcactcgcgtggtagtgatagtataaaactaccacacccactatgtgtggtgtgtcggtattattttattataccaggcatgctagtgtcaccaaagattcagattatggaaataagttttgaaagtgtctatattttaaactaaaaaataaaaaagttcaaaaataaaaaaaaattgtgccggtgctgccctccttggctcccgcgaggcacacattctaagaggagtcgtctagcctacagccagattcgtagtgagaagttggttttttttatggataaagggagtatattttaaagaactctctgaactatgtgtttgcaatgatgcggatttaaatgtgaatttgcatgttgtgaaaaaacttttttttggcacaagatacttttcgccggcggtcttcttaatgggcccacctactaaaattgatttttgcaagtagacctatgaccgcttgcgaaagtcaattttcgcaggcctttagatactagcggagtatttggtagcctaaaaaaaaactgttatggcccttgtaaaaattattttgtaagtactgcatgcatgccgtactcctttccgcaatttcacaccaacgcgactcacgctaggccaagcccgaaagccgagacatagctcgacgaagagaaacgcgaaatcaccctaagatcgatatgcgaccacggtgacatatcttatataaccattaatcaaaaagcaagctttgattcaactcttaaggacagaactacatatagtgcaagtgttctaattagtgctaactacctaacatgtcgacaaatgttaaaataacatgaatctgtttcctgtgcaggactacacatctacccatccttcactagtaaatgtgcacgtggaatccacgttgctaataaaataaataaaacacataatataattgttaaagtgctaaataattttcagatttcattttttgtttcaagatcgattaacaatctgtgaggcggtcaggccctggcttcatataatcacacagatgaaccaaaataacgttttcaaagagtagtacaccaaggaaactatttaacttgttgacatagtgcctaccttgcaaggcacgtcgatatatactgatagagtaaattaaagaaaaatacatccatcgctgatgcacatcaacatagatcaatacatttggtactatattagtttgtatatttcaaacagaaaaataaaatatgtgcatgcaccttgaagaggagtatatttagccgtaataacaataagctaatgcctactcttggccatatgggtgggcctaccaaagagatatttaaccatttgccacatttaaatgtagcaattaattttttatcactggacccacatgtcagacacatgtggaaccacgtgtcattgagataggagtgacaaatagttatttaccaaatctaaaagtggcaaatagttaaaagcccccaggatgagtgactgggtcgatatggatcttgagccggcacgcctagctgttgaggttattggagaagaattacgctatgtgagagagcgccatcacaacacatgtcatgctgttgggagctattgggaggggagtctatctgggtatcaatctggctgagacttggagctgttgggaggggagtctatctgggtatcaatctggctgagacttggattgaggaagaagtgttggagtcgaggccggttgcgtcaaatgaaacttatcgctctcctttctacatgaataaatttatagaagtcagattgggcactcccacatccggcgctggaacactgccgtttttccccagcgccgtttttcccgtgttcaaaaatgttcgatgaaattcctagcaaattatgtgtgattctatccatgaaaaccaagggaacacactcttcattgtccattcattccatttttcagtctttgatcacaagttgaggttatggaaactgcgccaatgtcatgtttgtgtccttcatgtgctctaaaatatgcataccagtcaaccgcagccaccagcctacgcctcctccccaggctcctcttcggatgggcggacgtggagtccctgacatcaaacacatacataaccagagaacatcttgctcctgacagctcacttatctagtctaatatgatatcaaagtttttttttatgacatgcaagtctgaattgtagtgacaaataaacaggaatatggtcctgaggtaagaaatatagctaaatgacagtattcatgagaactaactgaccaacatcttgctagtctgattgaatgataaatcacacatggtccctccaatcatatgtacatttgacaaagaatctacccaagagttgatcatgttgattcagatgaaaaggaaatgaatctttacattacaggctaacacaagtacacaaccatggttgccagcatagctaaatgttgacatgattgctaagaaactcaatgataagtacttgcacaacgacatgaacgcatggatggagcgccatccggagatagttaactatgatgccattcaatttattcagtttatgtagcctcctatggtcctatcattggactcgttgaacacatgacataaaatttatgcttcagaataacagaattctgctgtcaccaaaatatgtgagctcaaccataaagcagaatgtttcagcatagagagaaatttggaagactacttgaaccggtttgagtgaaatatgattagctcaacagctacatatgcatataccacaagcttgtcccgcattctttgctgttacattgataatgccatgtggtcaaatcttgatatcacttgcaggaaaacaaattttgcataaaaagacacacatgagctaagtcaatacctgcatttgcacctgatatatgtagcatctcgttgtcttgtggtgtgggctgattcaagcagttactgtgctttacaataacatggctaacttgtagagccatcgagaggcactaaacgaacataagatcaaagcatccaagaagtgcccctgcgtaaaaagttggtaaaagattagcattgacaccggtcaacaatttaaaccaagaacgccaacttagatcagatgcaacgcaatggtgacacggctcagcaggtcttgcacgcttgaattctagacattgatcactccaatccttcaattatatgcaatcttgtaatcttgtatacttgaatttcaatcctataaccctgaacaaaaattatgctgaaataaacatcttcaattcaatccagtacatggtcaaggcaaagaatagcaaaagaattaaagcagattaccagattgagtgaaaataacaggatttctgcactcccctgtgttatatgcctgacatatattgtggcattcgatcgtagactagatcaatctgtcccacaggataaaaagaatatcagaatgcaaataaacaagagatgctagccagtatagtactgtttcggtgctgcaaaatttccttggagcaaaccgtatcctgctgcctgttcatgtccattgctactaccctacaaaatcaattggaagcaagatctactgcaaaaaggaaaatgtaattgcaggagaacagaggttggccaactcacagcatggtttcttggtccttgattgggcacatcatattatcctccatcctctgattgaacaaaaacaaaaattcccactcaaatctaagaaacataaccgtatatcaaccccaaatcaaatgaagtcccaaatccagctcttttatttctatgctttctaaaatggaactgatatactggcaaattctcaaaataatcaattgtcactcagtttcagcaaaatatgaaattaatggttgcaaggcttcccatcatagattaaactaaaacatctctatataaaatgtttttagtgctttttcttcttgcattttttttttttgcggggagctttctcttcttgcatgaaaagccaaatcaatccccatgccacaaattgcacagatctgcccaaaccctaggtaaacaattttctgaacccaaaataataaaagcacaaaatctttattgtttgaggatttataggaagagaggacatcaacttaacctggagtatgtgctgcgtagggccgtaacccatcacggctccccggcgggcgcacgcgaggaggaggaaccggccgacggcaaccccagctctccagaggacgtgcccgaggaggcggcagcggcggtggagaaggcgccggccgatggcgaacccggcggggtagggcgagcgtcgggcgcgcgcgaggaggcggcggggtagggggcgcggctccggcgggcacgcgctcggagctggcggcggcgcctggctgtccggcgggcgcgtgcgaggaggcggtgagcggctccgggaggcggcggtaggctagcgcagtacgggagttatgggatgggagcgaaggttttttttttttctttttcgcttctttctcgcaatcgatcgcctcctataaccgctgtgtggatcgctaattgcagggattgatccaattttgataaaagccgttggaaatagatataagggtaaaaaataaataaatatatatatatataggtgtttgatgaactggtgctttttatattagtatagatatagatacttcattcattaaatccaacggataaaaatcatccaacgtttcacatccaacgacaggggctcatgcgaggtcacgcggtgggagatcgatagcgcaatcaatcatctccccttactccgcttcattcctctgcaatggcaaccgcgcctccgcctctcctccacctccggcttcccccaaaatccatttgatcctctcatcctcgcctcgcctcgcctcgcctcgcctcggcgaatccgattccgagcactcacaaccggattgaagcgagttccatggcctgaatcgcggagggtgggggggtggggggactggccgaggagcggggcgcctatctctctcacacactggttcgtctcctcctcctcttccccgactgctcagatcggtcattgttttcgcgtagggggcgatttaggttttgttcgttgcctggatttttgggctgttgtaggattggatgggagttttttaatttgttgggtgttttcacgtctgtcctgttgcggctaaagttggatttgtctaggttttttttccactgtaggatcgattttgaatttttgatccgtgcaatcgcacggcttgtttggtaactcgagggaaggggattgggagtttacacgagggaattgatgatgagattaagatgggaatttaatttttaatcccaatatcttgtttggtagaggtgatggaaattgatagggagtttagttggagattaggtcattaataaaaacggatggctgagatttgcttagaaaaagtaaaggaggaattctctcctaattacctacccctacccaggtattgaaaaggagggagttccttgctcaattctccatccctatcccaccaaaattctcatgtctcccaaccaaacaaaaacacttaatagctacatccctctaaactccgaatccctcctaaaaactccctccaaccaaacaggcaggtagggatcattggattgtcggtgaattcatactcatgatgacatagctctcagctgataattttggtgaaatatactgtatggtgatgatatcttggaagttcagactaataaatttaatgatgatatgctccacttaaaaacagtttaatttgggttggaaaattaggatcagacaacaatttctcctattacttttactggtccttttaccgagctaaatatatacgatggaattgcttagtggttagtggtatttaacctgaaattgacgcctgggatgatcacggtattttaacctgaatcaattccaatactcggatttcagataatttctgcgggatcaagtgaagcctcgacacgacgtaccctcgtctcattcctcagtttacagagtccagttacaagaaggtataatatacatcctgcgaacagatgaatttctttggttttataatcaaaattagtttgcagtatcaatgaccctatatacctgctttacaatggtcaattaagtgcatgatttcagacccaggaaaattgaaattaaactaagcatcttatcttatgaaaatattattgaaatgagcaccatattattgggttgatcggtagcatcatgaattgaatcagaaatatgcattactcaattatatgatctatctgatattttgtagataacagactatttgactgacaatgtcaagtttttatgtgggtcagtaggtccaaatgcagaaaatgttgtttcatagtggtgacatgcttgctacaattctctggaaatctggggttgcattg

SEQ ID NO: 32503 - DNA, 12609 bp, Oryza sativa
  unsure (1)..(12609): unsure at all n locations
tgactgacaatgtcaagtttttatgtgggtcagtaggtccaaatgcagaaaatgttgtttcatagtggtgacatgcttgctacaattctctggaaatctggggttgcattgtaatttgtaggtggttttatccattctgtctatgcaagtgattttatgaaaaaatggaatttttgatgtggagtaagcgaagtcataatgccctaagaatatggtctgctatcgttgtttcttattgattgtgacttcttggatgatcaaccaatgatcgtgacttctctatgcacgtattagatgttgatttcactcagcctctgatatctacatacatgaggcattgcttagcttaacctatcattttttttcagaattatggttcattaacagtggggatgtgcaacatatttattggttttcagtgtttccagattatttcagtacatatatatatattatttgatgatgagaatggcgtgctcatgttcctatccatatgctcatgcttttctgctgctgctatgctgtaaacatgatataatcaagcgctacagttttttttaaatgctttttgaaaattcagattattgcatcatcttgtttatcaaaaattcagattattgcatcatcttggactgatggcatatattaatgtggactgatggcatatattatatattcgttgtgcgactgataggttcaactcagcatcacattgaaccagaattagtataatgcacaatgctttacctgtctctatttatctacgctttgaagctttaatttgtgctaaattaggattggttacactggatttcgttgcttaatttgtgcactgcaaatgcaactccacgaccagctcaccggtcgccggatgctggtggatcagtgtgactgattccgctaatcctcccattcgccagccggcactgctttggggaattctcgcttattaggcacttgttgtgatcaatcctgtcaccgaactgatagtaataatagccacagaaataataatagaaatctttgtaataataataataatataatcaatatgcagattcactgttgagtttgaaaataaattctttgtaatggcatcttatatacccttctttgtaattaacagtaatggcatcaacgttagttcaatttgaactaaccaacatgtcatacattaaaaacaaatggagcgtgaaaatagcatttttcgaggtcatgtgactaattcccttgaacaaataactttaaaatagaaaggaagaaaagaactgattcaaattaattatatgactcgttgcaggctgttgatgttttgtaagtcacagttgggaagaaaatttgaacttgtaatggctaaaggaacacaataactttgggttgcatcccgatgtgaacaggtaatgtgttgagttgctttttttttctccaaatgacttattaatttgcagtggtacaccatggcacctgctccttttttctatgtaagcaaggaattttggctggttctattaaattttctttggttggatgtaaggtgtagttttcaggtcattggaggctctaaatatgcttgtaatccatgtgatttcctcttatcacattgaaggcatatcctactgttgatatttgtcggtccccaaataatactcatctttgcaaaatttttatttccttgaattattcaatgtcttagagtacatgaccttgcaatgccacttccttcttgttgcagcacattattcagtttgcgttaatcatcaaaaagtggttatagtagacaaaaatagtttggaagaactgggagcctaaggatcctttcaataggtgtccgtgtttggccggcttgagaccatcttaacattgaaggtgcgggaaattgaacaaatgtaaaaggcgagatgctgatgttcggtgtagatgacatggatacctgaatcagtccaaagctgcttaggttggagctacttctcgataggaatatcagaggaaaggttgtccttatataaattgtcaatctagcaagaagtacagtggaacacagaggacgcaataaaagaagtggattacaaagtgtcgtccttatttaccatcatatattgttttaatgaaaatattgcattttattatgcatctaattgttattataaatgttacgagggatagtatgaatttcatactatatgagtgcattgtttgccgacagaaaaatgatgagttggacaattccagaggatgtgacacaaactgccatcagccaagcccactaattgtgtttgagtttttgagttgctccccatcttttagtgattatttcatactctgtggatgatgttttacaccgtgtaacagagttgactgaatctgagataatgttacagaatgaaaagcactaccattatgttagatctcatctcacaatgttccttaatggatgtgtatagctttgctcaagatctagaaagggaatgcaaatatcactccatatatataactatctttatcatttctttcttaagtgaattataaattaagttacgccgtaacgttagtacgggcatattattagtttatgtaataaggaaaagattccttacacagtggcggatcagaatatagagttattggaatcattacacaaatatagtggtgttaagagtaattcttgtttctagagtgtatgagcaaagagattagcaagaagtcaccggtgtcagctgacaccaatgcttacactatggatccgccactgcttacacctaatattcaaacaaaatattcttttaaattacttatttaatctacagtccaattacactattatgttcgtgataattacatatcgcaacaagatattacacaattagagtaaaggaaaatatatatgttgtgaattacttttattatacgtgtaaattacttttatgtattacataggtaaattacttttatacttgattaaattactggtaaaatattcataaagttataaatagtttattttattggtaagttgctgattaaatttatttttttgactggctaatgtttttatcccaacaatagatttacttttattgccgtaacaacttacaagggcgccatcaatttgcagttgctgctgcttttcagcagtactagcctgatgcttataagcatcagcaattccattgttttgcttatggctgattactggatcttctgtgaacttttgaactgatgcattgcctctgctttgcctgcctctgtgtgcgttgtgtgctcgtcagcactgactccagatgcgtggccgtagatagatcccgacatgtatagggcccactaccaatagctattcgcatttaggccgtaacagcgaaccgatgggcttctgctgcaaaacagcaaccgcaaaagcgaaccgatgtcagccaaatttttttttctttttttaagttacttttataatatatataaattactttttggttttattgaatttacttttacatgtctaagaagtaatttaataaaatctaaaagtaattataattatatatattattataaaagtaatttgtaatctttcatcaaaatataatcatatgagatatttttataaagatttaattacaacgaacataaagaatgtagataaataagtaatttaagagattacttaaattatgttgtaacatactagatttttcaagataaattttttgcgaaaatatttaaagtcgatgttcttcgttctttcgaattggagcctcccaattcttcttttgttccctctaagtttccgactcccacataaccttgtttagtttccctcaccaaacaaaatccgagatatcccaaagaaaattcccaaaatcatcagaagagctcatgtttattttaagttaaaccggagtcatcatgcaaatgttctaagatcccaaatcccatcaattcctattcaaaaatatcctatcaaaattccatacaaaaatctctccaaaaattcaaatagaacactgtgtttcttctcgggccgagttccttgcaatccagcccatattccggatttccttttccctggtcactctctgtgttgggctgttctagcccatgtcctggcccagcctaggtaggccggctccagccgagccgctgcaggccgacgccgctcagggccgctcgcgctacacgcgtgccgcctcgtgcctttcccgtgctcgcacacgctcgcccgtgccgccttataccagccacgcgccgatctccgatagccgttgcgcgaatcttagcgagaggctattctcccttcctttttctccttcttcttctttctctggaaacaccgagcactcaagctcatccctgccctcaaacctctccaaactgctgccaaggtcactggccaaatccaccgtcgccggccctttttctgccacaacagcacaccatcaacttttccgctcatcggtgaggcttctttctctattttccctctttttccgcttttgtatcgagcttttccgaagctcccatgggctgtcatagccatcaccgtggccaacacgtccagaatgtcctctttatcaactaaccacaaaaatggaaccttctcatccgggaacgcgttttgacgcgctcacccgcccgcgttcaccaccagagctgccacttccatgcccggtgtcaccatagctccagatctggaactcctgttccggccggtgtgggtgtcgtctctgaaaactaacaacagcatcgagttcgcgacccttgagaacgtgttttgctcatgatgtccttacctatcacccaccacagcctagcatccaccttcctactttttccctgttctctattcccttgcccctaggttcgtctcactgaagaagatgaacagtagtacgtggtactgtgccatcatggttgaatccaaccataagacaggaaacagagctaaacaaatctggctaaggctctgtttaatggttcaataattttgccttcggttcacctttggttcggccacctctagacacaatttcttccggtttccagtacccaaacctctgcatcatgtccattcttgtatacaccataaacccctgctttacagtgatattttgttatttgaaaccatagaacttctagtgcatctttccacagttctggctccaaccttcaccatttattttaatttttatttatagtatttttcttataggcttatttggtcgtttcttcttgtgcgtacgttagatcgcgttgaagatcccactggactcgtaggaactaaagtggaccaagaaggctacgttgaagcttccgaaggccacgttccacgaggcaagccacagtaccaatctttgatcatattgaaacctagtagagaaccacttagttattttatgcattgagtatttataaaattattttgcgtatgaattattttttaataaacttgttagtttaattattacccattgttatattgttattattggccaaatccatggattgctatatcacgtcctttgataacctaggtgtagatttatatacttcacaataatattctagtggataagaccaccaaatatctatactcatatacatggtttacccgtcgtcacgtggtggcgtatcgggtgatataaaatgtgttatttgatatgagtcactcgcctggagtgatatggaagtttaattccgggtgaagatggatgttgtggtgtgtgaggccgtgcatgttgttataattattttgtggaaagtgtatatttacacttaaagtatgcacgggcctgtgctagtttcagtggctttccccggatataaggactacccccttatgccatggaaaatgatgtaatttgcgcccatccacaggactgagtaattagacttagcctagtacattgtcccactgtatgaaagactgtagggtggctctatgagcaggtctggggtggacatgtggaaggggcttcggccaggttgacatgatccacaacggtggaacccgtgaaagcagcgaccgtctagccttgcttaggcccagcaagtgcctgactgctaggacggatcaatatcccactgggcagtaactagtagtaagtgggactctcgaacggctatgttgtccnnnnnnnnnnnnnnnnnnnncatcatgtgggtaaagctgggcagtctctgcagagatgagtcttaaatcattcgaatgtgccgtgcttccggttaagaagctatgtcattgggtgattcctatttatcatggtatgagtagattttaaattaaaatatggaatatgatgaagatgagaataaatggtgattaatattgctaccgttttaaaatgatgatttacaattgtttgcgaataaaatgtttgataaagtagggaaacactatttataataggcttgttatgcaacctccttgatgaactatattctttgtacgccttgcatatattctatttgtattattatgaatgtggcttgttaggtacctcggtactcacctcttacataaaatgtggttcagacgatcagttcttccctgaggaggcgcaggaaggggaagaattctatggtgcagacgagttcttgttctaggtcgatctgctctcaagcgttgcctgtggtgtttttatcctattttgtgtttgggtcttttgtttgtagggagtgtgtttggccggtcggcccctaaaacctgtcttagttatcttttatgtaataatttctgtaaaaacttgggtatatgtatcgaaagctgttctgtatatcaatctatgcgcgatcgaaatcctagacggtcgcgggtggtttcgggatactatactcaaaccgggtatccccacaactgtagactgtattatacactaaagaaatagaaagaaaatcaaattttatgtatggccaaaatcagaaacagtcaaaatgatactacttatacataaattttcataaatgtttttgttcctacttaaaatacttgatttatctgattattcaatagtagactgataactaatgtgttagaaatatgactgaaatgatgtttgggggtgtgggggcgacacggactgtagctgggtcggccgacccgccctgtccaatgggtgtgtctgccactgcacttcgtagtagagtgattccgtaaataaagtgtcatgacttcaatacaaaatctagataatcagtatagttttggtcatgttcctcaagcgcaaaactgatacaacacatacctcatctttcaagactagtgcaaatgtagtcctaaggcagtttggatagcggttttgactgacgaggcatccacatgcgatggacaaagagaatgacattggagacggtgcttcttgacgtggttgagcacgacacgtgtgcctcaacatcggtggtggtgaagttctgctctagattgaaggtgaggtggtgaagcaacgcctcccgccgctgctccccggtgctcccctgtcaccgctgagccactcagcctcagccttagcctagtaggcaggattacaggagctcttgcctgacaaaggacaagattaacatcactgctaggctccggtcaaagctcccttgtgtcacctcattattgttgtttcggatcgggtccgccaggtcctcctcctccttgtcccaccacatgctatagtctcggcctcctcccgcaacaaagaccaccactgtctcatggatctaggagcgagatctctatctctgtctcctccctttgtactgatgagaggagccaattgatgagaacgacggtgattggacctacattagccaaaggccatcggtggtggagaggctcctcttgctgctggggcgactgctgctcagcgagatggcgtcgcatcctttgtggtctccatgagcacttggcagtgggaggacggagaggggtccaacgctaggactggtgtgggcgtggcaaaggcgagctaggggtctggtgctggtgatggagtagtgcacaccgatgaaccacattgttgagccccgcctcgtccccttctcgatgtcctctcccttttcctctccttgttgtatgaagccaccaccggttggactccgccatggaaatagccacgtgttgtggtgcagctactgggcttcggcgagttcgttcctagctccagcgagcgcatgccgctgttaacaccgaggaggccaccaccattgttgtccaatgcctatcatggcgaggagctctagagaggaagcgagtgaaatatttacctttactgacatttggaagcgagtgaaatggagaggggtgccacatgcttgctttactctcttttggaccaaatttaagctggtgtgggtgcttaagtttgcactgaggagggtgcatatatgatgaaaatagataaactaatgctaaaagattttcttaaccgggttcctgggtcccccctttaacatgaacctccgcccctgcttttatacaattgtcacgtaggcgacacatcatctcgagtggacaaagttaacatgacatataggacaaaaacatcatccaaacagccaatggacctcattttcgcttgttttgcaacatgagggatgcgctatatcaagttttattatactgtaccgggttttatagttgtgggaaaccattcaaactcgaacattggatgggggatgcaaatgaaccttttttttgtgggaatgagtggctcactcgtgggtggtgtagcacatatggcatactgggggtgtgacctaaatgagccgacttgtgatacaatcacgcaatgttgcaggcttgcagttgtagccacgaccacgtggcgccgacaactgggcaggtctagacgtatggtcacccgtcaccctagtactaggggtggacgaaaaactcatgactcgttagttcactcggctcgtgactaactctgctcagcttaactcggctcgttgtatttttctaacgagctgagctagcattttagctcgttagagataacgagccagctctgactcgtgagctgcttgtgagcttagcgtgttagggtagcccataagcaccttactacacagcacacatcgtgacacacctcagtagtctacaggcctacaaatataatctttctcccaacttgcggcccataaggcccaaatataaacctccaaaaccctatccatctaccatctcaaactctcgaatcaatcaatcaatctctctctctctctctcgatccccttttcacgcagtccagcggacgcggcgacgccatctctagcctcccttcgccccttgccgccagctaaccacgccacttgtcacctgcacatcctgccacctgccgcaggcctgtgtgcaccatggaggagaaagacgaagtgctttcaacaccaacaagcttggaatcccgaagcaaacacctaataatatgacatcgtccttatgtcgtcagctaatgcaatggaacaaaggttggactggttgtgtgtgcccttgtgcttgcagaagtggtgctgctttgtgctgaaagcttgaaatatgtatgcatggatggaacttgtagttgtttttgttgatttgtcttattgattcaccaatttgcctgcagttgtattttttagtcactggctcacgagctaaacgagccagctcgagctatccaacgagccgaccgagctaaacttctatggagtactagctcattaggccatccataatcggtaccctcaacccgtgcccttgcaaacgacgcctgctttccgtcgccgggtcatccattatgagagaggcgtgacccctagcagaggaacgcgcgcctcggctgcttttctagagacaccgctcggggctacgtgttggaggagggcgtggctcgtggacacggctcccgctccacaaatttccccttccaccctcggtcttgtcgctagcagtggggaggagtcggaggcgacggcgacaaccgccaccatctcctccccgatctggctagggggggggacagatccgcccgctagggcgccggatctgccgcccccgaccggcgacggcgcgaggaggaggagatcggggaggcggatggcgcgaggtagaggagaccggtgaggcggaggaggcggacggtgacgacgctgtcggccacccccgtccctcgcgccgctcgccgtcgaccagtgcgtcccgcgcgcggccctccgtcggccaccgcgcggcagcgggcggcggcggtgggagcggcctcgcagcgagagggagaggtgacggtggtggagggaggtggccctcgcagctgccggcgatggcaagcggctgagcagcgagagggagaggcgaggacgggcagcgacgggagaacgggagagagggagacgagaaagggagagatggcaaggacgagagagatgggagtaaatgagggggagagagaagaagagagggatagtatagtaaaatacctacgtgggcttttgggttagggacactcgttgggcttctaggggtatctttcattgtgataggagtttccctacgtctagatgtgtcccagattgtggatgtccttaggatcgtaacgaggatcgagccgagccgagctgaaacggctcgatatccggccctacctagtagggatgaaactggttcggatagtttccgtccatccggaccaattttcggattcagaaaaattcgatcggaactatccggaatttcttggattcggaaacgaattcggatttttttctcggatatgaaaacgaatacagtaagggtgatatccaacggaatcggaaaacggtcagaaactatccgggatttttcattggatattcgggaatattttttagaaaaaaaaactggaaccctagccggccgtgcccgcccaccgccggccgccgcgtggccggcgccagatccgcgccgctgcggccgcccaccccgcccggcgccgctgtggatgaggaagtgagagatagagagagagagagagagtagaaactgagaaagagagaggagaggaagggtcaagagaagagtagataaggttggggtaaaaaaaggtggattttttttcaatgtaaaaatcaattttttttatatgtggctctttaaaatgaattttaaggcattaaaatcaactcgtaagaaaaagttgtcaaaaacaaagttgtataatttattgagatctaccatttttattttggtcatttctccatccgagtttgattaaaccatataaaatttgaatttaaaaatataagaaattcaaataattttccgggtagtaactgatttcaaatgaaaatgttgtcaacaacaaagttgtataacacatcaacatctacaacttttgttttggacatttttcaatatgattttgtttgaaccgtttgaatttgaatttcaaaatatgacaacttcaaacaatattttaaaatactaaatgatttcaattgaaaaagtcatcaacaacgaagttgtataactcatcaagatctataacttttattttggtcgtttcttcatccgacaaagtgatagtaatattgtttacaaaatttacatctgtctcatctggttctataaactatataagagagatatgtaaactttgtgaacaatgttactatcactttatcggatgaagaaatagtcaaaataaaagttgtatgtcttgatgagctctacaacttttatgttgatgactttttcagctgaaattaattacagcttcaaaatattatttgaagttttgaaattcaaatttttagttgataaaacaaagtcacaagaaaaaatgaccaaaataatagcagtaataacacaataatatgatagagtatgattttagaaacatttagaaaaaagaatcatctaatttggagttcatatgagtgagataaactagtctcaaattttcaaatttatttttgcatacggcttcttaagttacccgtatggaaaaattgatttttccatgtgggtccttaagtggtccacgtacaaacaaatgaaaaaaattcaattctgaaaaataatcactcgaatttttaaaaactttcaattgaaatgttcaacccaaaatttaaaatattcaaccaattttcaaaaatttcaatgcgtctgcgaaaatttcagtgatacacattaatttatttaatttcatgataacataaattgtatgaaaagtaaacataacattttctatctccccttgcccttataaatagagataaaatttgaaaatactgacgttttgtttttgaaaactaatggctatatttcttcctcgatttaagaaacttattttgaggggtgtcgatattttgataattattcgttaccgtattcgtttcgattcgtattcactctgtatctgcattcgataatatttgattccgttttcgtattcgggtttccaattccgatttcgattccgagaaaaaaaataaaaataaatatgatatagctagtttccgaccgtattcgatctgttttcatcccttctgcctagtaccgtgtcaccgttcgatccccaaccccaaccgaggcgcgacccacgcgacacgcccggcgcagagccctctgcctcccccacggcggccgtcgtctcctccgcaggcgtcgtccccccc

SEQ ID NO: 32504 - DNA, 8057 bp, Oryza sativa
tacaatgagttgtgacttgtgaagacaccttgtattgtatgtagaaccgtgcgaccgtggcatttaatctgcagttcttcttctctgcacaagctatgatttgtcttagggttattttggccagttcgtaactcagaacaaccttacagcgagctaaaacaatcaagtttccgaaaagcaacttctcaaatcattcttagttaattaaccaccatcttcaggaggagtaacaaatggctgaagaggcaagtggcgtggataagtcctcactactctgtcgggttgaagatctacaacgtggtaatatccttacctgataatattagttgccacattcactatacaagctgctttcctcagcttatatggtagtgtcagtatcttcatgcttttttcttgatggttgttatggatggcggaacactttatgcggtggatccaattttgttttttcaaaggggaatattttgttgagactattatgtgatgtgctggtactttatcaggaatttggtagccgttctgtaattgattaatagtcagtcagggagagaattggaattcagaacggaaaatggtagatgattgttaatttggagaggagggttaagtttattttcctcaatattacccctcgagagttctgttgcatgtgctgtttgcaaccttgcttcttattatagttgaggagttctgctgcaaatgttggtgctgaatgtaggaagttttttttttctcaaaaatgcaggagtgctgcattttatttcattaaggaggatatgctacttagtagtggatggagtactggtggtatatatgtgaactaccgaactatgcagtgagcaattaaaactatggagagcatgtgccatattacttaatagtgtatggagtattggtggtagatatgtgaactactgaactatgcagtgagcaatgaaaactatggagcctaacatgacccatggcagggataattaaatatatcatctggacatgcctcttgcatatagtagttcataaatttgaagaaaattctaggtaatatttgtgcttcaacactgaggcttcctttttcaagaggcacttgtattagtatttgtgaatgacatcttttgttgatggtcctgtttgttttccttagccttgcaaacatctcaaagtgttatcttgtcctcataacagaccaggcaattcaatgtgcatgctttttcagaaaaaaaaactactgtgaagtttgaactgagtcgatcttgaattcttgaggcattcctcatagcgggacgtgcccatgctaatgagatcaccagccaaacatgcctgatgtgtacatgcagtgatgaaatcccagggtagaaaacgtagctggtcgggggacataggggatcatttgtagaaaatgtaattgcttcttatctctacatttctacaaaccatttgtgtaaatgaatagttgtcttgcattctgtttctcatcgttacctttttgcagttttctgtcacttcatattctaccctttcctttccaatgtttcccttccttcccaacatctaactccaggttcctgttacaccagtgaatgcaaaaaatatgtaaagagttagtgtgaaaattaaacataaatatgcaaattaattgtattttctacttatttgatgcgcagtgcttgtattttgttttatgacttgccccactgttaatgttttgttatgttctaatgcaattgcttgcatataattagcttctttatatttcttaaacagaaagagatgaaaagcagcatgctttggaagtatttatccgtcgggttgaagggctccaatatggtgatttcctatttgacattcatatacttgaattctctgttataccaaaatgaagcttcctttactgctagatttctaggtgattcagcacttgccgatgtgcttctattgtaatgattattggtataacttgaaatcttgattacctgatacagtggtgaacgatttaaagatttccttactgctatgtttatattttataaccagttaaaacttctgggtaccagttttgtatcgccttcccatggtattctagtgttcctggtcagctagtgaccgttctctctccatcctgattatctgattgttgttctaaatatcgtattaccaatgttgatttttgagtcatgcatgactcggaacctacaatttctagctacctcgcttctagcacttcgtggagtcttgtcctgacaagtcaatttgtatttactcataaaaacctctcttatggtactgttggccaatgctatgcatctgagcattgttatgccagattgaccagttctcttgttgaacctgattgcaaaagtgggtaatggtccaagtatgggctttcttatttgatctttttctcactcaggtcttaacacacatggtattaatatctatgaacaattggatatcgattgcatttgttgattcaggatttcaggaacattggtcttattccccccctccccctctttttttccctctgcagatttggatgagaaaacagacctagttgaagtattatctcgtcgagttgaagaactccagcgaggtactcacaacatacaagattctcattcattaatcaattaatttttccatgtagttctcagcttctcatcagataaactctctaaagttctttctctgctcaagtagttcattcatagagcctaacttgtagcacggtgtaactattaaccactaaaaaaaattaaactaaggacatctggcagatagtagtctgctggggttgcttttttatatgcattctgttttaacttattttctgttaggtttcagtagttaaacgtttgaagaatacagattttaatctgtagaataaaaaataaatattatcctggaattacgaagttatactatttaaactttggcaagaatatgtgccatacctagattggtcatatgaagctgatgagtaattttgttccaatgaaaaaagttcacattaatataatttatattaggttttagcgagtaagactattctacaggcacccttagagaaaagcgttaattggatctatgccattattacttttatggttctgaaaaatgccactactatttaactatttagaaccatgccattacaatttaacatgtatttgagatgtgctactacataccctttcattgtactcagaaaattttttggaccaaattacccatgtgttcctcctgcaccccttctcccctgttcatcttttcccatcgatggagctagattcggacgacgcaggagcctttcttcgtccctatctcttccctggggcagcgacttggcagttggcacaggagacgttagccccaagcagtagtcaaggtggagaggtgaggagaacgctcaccgtgggctcgaccgacggagatggtttcccaggtattggtagcgaggccggaggcagccccgtgccaaagatgaccgacggaagccgaagactcgctcgacgctcccctcgtgcctccttgcgggcctgtggccatgcagctgcggaccgccgccgatggaaaccatctcccaccacaccatcatgtaccaaaccatcggtggctgtggtagccgcgcaccaaatgaggaagcctcctctcaccactgacgaggaacccatctcccactacgccatcttggcaccttctctattctttcaatcaatctgttcacagttctgctgcacgccaactgtttgtgaaaatgctcacgaaagcaaggatccctccagtcctgcctggccagatgttggtgcacaatgttgtcacctactccagcgttgctgctccctgtggcccagcttgacagcgtgggcaccagctccgcttgcacctgggcctgtgtgagcctccacggctccgcctctgcgtaccttgtcgtgttgctgggcttcttaaccggagaagcaccaggaaccagatctagagagagatgtcaggagtggaaagagaagggaaagaaggaagaagacatgggcattttggtccactagaaatttttagtgcagcgaaggggtgttcagtggcacatatcaaatacccgttaaattgtaatgatatggttccaaatagttaaatagtagtggcatttttcaaaaccatgaaagtaacaactgcatggattctctcccctcctgtgtgtcacccattcaccaatcccatatgagccccttgctccatggtgcagcagtgaagcgactctcctctgcacataaaggccaacactgttcctggccttctcagcacaccctgtgagttaaactgaacacgactgtagctgcatctagttacaccatctgttttgacttgccacttgccaggtacctgacacatacggcaggcaacaaaaatggtagtaaacaaagtgcaaaagactacttgagctgctgccttagatcatgtctctgtctgaggatagtaaccaactgaagcatattaccctacattgtttgcatttaacacatttgccgaaatatatacatgtgcactacagatgattttaccctttgtaacaccccatcttccagaatccaccaatgcatagtcaccccagtgttttggttggtttcaaccacgcatacgcatagcagtctgctcacacttttgcccttgcctgatgatcctttgggtgtgtttgattataggaaaatgagatcaatggttatcttaacattccctgatgtcctaactgtgggaatttgatcacagggaatgtgacattcccagcatgcacgcgtgagaaaagattctgcatgctaggaatcaagctaacaatttttacaaccagacacccttacatcataatgtgtggataaacatctgttgaaatgaagttggatggtgaggacttgaagtagaaacagtagtaggtgaaggatagatctaaaatagccggccatgtggaaggcaaaatctagagtttagggagtggataacttgaccctcaagaagcttatctttattccttatagttaggagttgatggtggttctgttttgtcctcattcttcggtggatgatagttatgtgctatttttagtgccatttgtaaatggctgcattgtttatttgtgtatattttcaggtggctgtatttcttgcgtgaattatgcacacaataccttaaatttgattatcacaagtatttttatatttaaagtttgagatttgtggaatttccgatgacaaatgactggttattctatcatatatcatactgcagctttgttgagtgaatggaacattaaaatctgttttcagaaagttgctcatgtggatttctttattaaatagttctttgtttcatcctgttttattgtggtactgaactacggggttacataatatatacttggtttgacagaacgagatgaacttaggaaagatattgagcaattatgcatgcaacaacaagctggtcctggatatgtttctgttgcaactcgaatgctttctcagaggttcttccatatcttctgttcatattccactgctgtttacagtaacagtagcataaataaagcaatatgtttattctaactgttcaggacagctgctttggagcaggatattgaaaatcttcagaagaagttaggtggatgtttaagagagaaccaaaatttgcaagaggagcttgctgaggcttatagaattaaagtgtgtttcgtaccccccccccccctcctttctctctatactgtccttttcttttcttttgttctgtctttttatgcttttgtaatttaaatttcagagtcagcttgctgaattacatggggctgagctatcaaaggtatcttactttgacttatacatctggctgttctgctttctctagaatgtgttgctttttggtatcaatgagaaatttccagtggcatgagattttgcgcttgtcctctattatccacaagtaagcagtatagtgagtaacagtttggttattttaatgggtgaagagtcatgaacttgagcttcaactgagaaaattttcttctagtcacaaggcacaactaatgcatactatagtaacttaaatctgacaaaattatcagagaaatccgaatggaaccttgcataacccgaggaatataaaggattactcttttcttcatatagcataccttcaaatccaatgctagttctacttcaaaacctgcagcgcgacaattaaacatgagcctgcggtcaatttttacatatttaaggtcttggtgttcgttacttaaggaaatacaccaattttctaagttcttttcatatgtattcatgcttatctttgaggtgacattctttttggaaacaataatgcagaacaaggaactagagaagcaagtaaggtttttccaaagcagcgttgctcaagcatttgctgaacgagacaattcgttaatgaaggttttttttattgagtttacctgccaaatctaattgtgcagcaggagagttgataactgcatacgtgacttttgctctttgttacaaagtgcatattttttctgttgaaattgatagtgtgagaaagcaaaggagcgagaagaagcaattttacaaaagtttgccaaattcgaggaaaggtaccataatttcctattcaatttgtttgataggtaccctagatttatttgtatttctccattggaatgatctagagaggtttggttttcatactggatgatggaattgataggatggcgaagttttgctatgttttcctgccagtaacttgatagcaagaatgtgcagaaattaataggtagcaattttgctctaagatcatgacctctcgccagtaactactactatttttttggtttcttttctttttcagtatattagttgtcatgcatatattagtttttggtaataaaatattactagctatgactgcagcaatctaaaggactgaaatgtatttcaagcgtgtgaagaagtatatggctagtcttgttaaagtatgggttctgtatcttagttatttcattaagaagaacgagagtacaagacctacagatttttggcagggaaaatggagttttatagggctgctgcttaaatcttcccctatttttgctatggccttttttttaagcatatggtttatcactttgtgctttttccctctgcttttgttaatccctaaagtttattgttggattatttcatgtattttatttttgcattgttgtgtcttttaaacatttcagcaattgtaagtggaatgctaacttgatgttttaaaagctattctcattatgctaaacttgcctgcacaagtttctgacgagtgcaatgtatcgtaatgattacttattggcaggacaagagaatatcaatcatcaattgatgatcagaaacggtcaaacgatgccttacaaatggagctgatgaggcttaaagagcagacacaatcttccttgaaagtatgtaattttgtccattagtgcggtagtgccaatatcatatatcaggaaattcgtgcaacaacttacgtccaaaatcttggcagtaaccttgttctagaagactgctaatccagggtgtgggtgctgagatttctggcaaaaccgatattcagaaccttgagaacaactgatatatacccaacctaaaaaccaagcagaaatctatgccaccatatacccaactaaacaatgaagttggtcaatgtcatccagcagcaacctattcaggcgaaccagcatcacatacagtttcaacatcattccaccaaccaagcacccgccttaatatgttaaatctaggatttaagtattcatgccttttcttcttccaaccttatagtgtaaattgatttaagcaggactattatagtattgtactataaaaataatcacgatcaaactcctgagtagaaaataagattcttccccttttaaaaaaatgaaaataaaataaaattcttcacagcatatttctttctgatctatggtgttatttatactatcatacacctccaaggtatatactctttaaaattctag

SEQ ID NO: 32505 - DNA, 2001 bp, Oryza sativa
  unsure (1)..(2001): unsure at all n locations
acattactcttgaagaaaaatgttcagttcttctggacgattctgctgataattggagtttcagctcagatggaggaacctcaacttcgaagtacattgtaaacttaaagccctttatccatttcaataattgaattcaaattgagttattacacatctatgaattgtttgattctatatccactatttaggagacatttatcctggcgtacgctccaattctatggtgaaaatagtgcaaaaatgagggccatgttgatactctctctttttttctctttttagaggcatttatgctttgatcttaagctttcttatataaccccctttgtatacatactactcggatacttgatgattgtggtgttaaacaactttgctttttctaatttgttaagttaaattatgctacagttttcaatttgttctttgacaaaggatgcaaagtctacaatgacttacattcagaattagaggcagtagtttgtaagaacatgccccattggttaagtaactattctttttgatagggttnntagaagaagagaaagattcactgagagctaaaatagctaagcttcaaaccaatctaagaatggtaagacgatttttttttaaatggtaggagaagcgtaatcttttggctttgctgacgtatttgtttttggatgtttagggccttgaaattgagcaacatttgcaaagaaatgcacgagtattagagaaaagacaggtatgaaaactgagattatatttctttgtcatgacatctttaatttgtgtagtacactttggaatgcaggcactctatgatgagtttatgagaaatggcctttcaactcttcaaaagttgcatatacaacaaagggatgacattatgaaaatattggaagaagaatcatctcagttgagcactgttgttaatgagattcaagataagttaagtaaaattcgtatcaaccctgaaatcaatgaaaaccctgttggagagatgcaatgctgtgacagcagttgtaaagatgtacatgttactacagatgtcagccctggcatcagccctaaggtttgttcagtacacaatcccaagtctctattgatagtaagcctcttccatgatctggatatatgctcacaggttgcagcatactctctgcaaatcagcaaattacctaatacaatatggtcatatcttctctccatgaactgatttttttgaagaaaaaaattctggtcaaggcacatcaacaaaaagtcttttccgcttgtttggacttttgccggattttaatatgatggctccttcctattctaattttgcttttctatttgttgatttgttgtttgagccactgtagaataacacaggtagagctttcacatagttcatattgctaattactccctccttcccaaattgatcatcatgtaatagaattcaaaatttctcaaattgatcatcatataactacatggacacggattttatcagaatacaattaatgcagtatgggagaatgtgtgcatgctagggtgtaattggcctagggttttaatcgatgcatgcattatggtgtattgattgatgtgatttattttgttcttggtctttgtgcataaacttatatgatgatcaatttgggaaggagggagtagtaattagctagactcttagtccatgattttgtcaggacgcaacttttccagcttacatgattgagttggtgattggtgtgctctacaccctcttctcatatgtcctctgtaacaagctcacagcagggcatgatcaaataacaagataaaaattttcaactgcatacattaactagcagtaatgtcttaatggtataacataagaacttttcaactatgggtttcctcttgtttctttcttttccaggagttatccttagtagtcaccctttgcattgccaaaaatttctgttgctttttagcagcctttgcagcctgctcatggccacatcatcatctgaatggtag

SEQ ID NO: 32506 - DNA, 817 bp, Oryza sativa
  unsure (1)..(817): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgacatttttaaattgttcgggaggagtttgtttacacacatttgtataaatattgtacttgcaggtggtactggttgccgacaaggtgctttgtgagggtgaatggttgtcactgaatggttcgactggagaggtcattttgggcaagctgcctctatccccaccagcacttagtggtgatttgggagaattcatgtcttgggtggatgaagttaagaaactcaaggtaaaaatgtcccaacgaattattagaaaacaagttacatgagccaagattttcatgcttcctaagcagttcaaatctgactaaacgcatgtagttattcatcaattatattgttcttattttcatgtatgcctgatgttccaggtcaaggctaatgctgatactcctgcggatgcactgactgcaagaaataacggtgcggaagggattgggttgtgcagaacagaacacatggttggtacactgctttatcttattattcaaggcatcttgatggattaattctgacagctgtctctgctacatttgttctttagttcttctcttctgatgaaaggataaaggccatgagacagatgataatggcggaaacaattgaacacaggcagatag

SEQ ID NO: 32507 - DNA, 854 bp, Oryza sativa
aaatactccccacctctatcagacctcaaccgtttgattttcctttcaagttggttttctacctcagctttataggtcttaaagtaatgcaatgctttcctttgttttcaatagatatacataacaaaatctagtgcaatcatctatcaatgtcatgaaatatttctttccccctttagtcaacacgccgttcatttcacacaaatcgaaatgaacaagttctagaggtgccaaattcctcgcctcagatgccttatgaggcttgcgagattgtttcgattgaacacaagtatggcacttagaacctttgaccaaagtgaattttggaattaaactcatattagctaagcgcgtcatacaaccgaaattcacatgacagagtcgcgaatgccacacattagactcaccattctcgctaatatggttcacaacattatgattattacacatgtcatccaaagaaaagcggaacaagcctcctctgtcataaccttttccaacaaaagttccatatttagatacgacacatttattggattcaaacacaagtctaaaaccttctctacacaatagagagccgctaacaagattcttctttattgaaaggacatgctgcacgttcttcagctgcacggtctttcccgaagttaacttcaaatcgaccataccaacaccatgaacagccgcaagcgacccgtttcccatcgacaaggaggaacctctcccgacctgataagaagaaaatagagaaatgtcagcacatacatgaatattagcaccagtatcaacccaccaatcagatgaatgaaaaacagagagaactgtaggtaataatttaccgtaccccgatgttt

SEQ ID NO: 32508 - DNA, 3792 bp, Oryza sativa
gcatgaaggaacaccagaacagcataccttgtaatctaccctctaattccttctccttcatctgctcctgttgaagttctttcaaccaaggaagcaacaagtctacaatacgaaaagcataacgtcgttgattttcctcagaaatcttcttttcagggggctgattcaatatgacagggcaagttattaatgccagactgtaaagcaatcttttgagcacaaacaaatctgtagaaaatatggaaacactagggagggataccaagtacataccttttcaactcctatcattcttaggcatgccttgcaattacagttctttctacaatatgggcattttgcagcaaaatcaacttctgacaaacctgggtacctatttatcaaaaaagttttagtgtagtgcaatgcacaagatcaatgtattacagccatagatcaatggccaacaaaaaaggtatttaaaggaacatcaaaattggagtagcacagtcatcaaaagaaaataaatgaagtataaaactataataacatttctgaacagtggcatgatacaatggatatgggtagtccaattagtagatgacaagattgagacaacttggcataccatcgtttcatgcatggctcacagaagcgcttattgttgcatgatttacaccaaatcaccctccctttgtcatttctttgacactggtggcacatcaaagcattttcccaagtgagcatcttcttccccttctatatgatcaaaaccacacaataattttcaatgcactcataaaaaaactgtggagtttccatacagaacatataatgaaatctgagcattaccttattgttcgcatcacacatttcatcctcaatggatatggtattattctcttcttcctcttgtttctttcctgcacctcttttcttcgattcttttgaaggcttcatcattatcgcttcatcattctgtcaaggaaagaaagtgtaagtactgaaaaatatggttaagacttaggaggcagatttttattagcaatacctagcgaccaacactcaccagaagttcattaaattttcgatttctctgagctaaagtatacacctcccagaggttacaaagcatcctattaaaggttttacacataccaatgatgtaaggtttacagcacaggactcagaatagaagcacagttacaattccggggaaaaaaatattggagctaaatactgcttatcaaagccagacaagacatcagagcaccaacgagccaactaatattcaagatctaaaaaattgggaaatgctcacttggtcagcagaccaactcattggcagagtattcttcctggcaaggaaagcaggattcaaagtactttgccctttctcaggtgcaggaattaattcagattaatcaaagactgaatgtgttctgccatgctacaacaataaaggagaaatggcctgcccagccaactaggcccatttctccaatctactttctttcaaaccataaaccctagaaacctccttcccctctctaaaatagtagtgacagcagtggatgtcacaacaagcaacagtggtagggagtagtgacaacagtggatgtgacaatgatagcaacaagcaacagctgtgccaatagggacatcctgcagtactgtgtctccaattttttagtgttagttgagttgaactattgctagttgaatctatagatgttcacctctatccatgcacgccatcgaagacataatatctgttgtagtagtggcaagtgcttggagttttaactttgcactagaccgagatacagctgcctactgcttggacttcgatgcaagagaagagtggaataaccaggctgagttctaaacagctacttggatcgacaacatccttgttttctatgagcacactttccaaactactaaataatgtggactaaatttctatttacaagttcttgaaaaatcaaataaatccattttccaaatttataacagttaatacctaattaatcacacactgattacccatctcgttttgtgtgcggcatattggcccaactaaaatgctctccctaacagagcataaggatgtcagcacacgaaacaaatgaccagaatggacaaagtagtagtactcataaactgaccaaaaatatgaacagcattagcaatatcaggtctagtgacagtgagataaacaagactacccacaatgtggtgatatcaagagggatcctcaataggtgtaccatcagtagaatgcagctacaagaagggatgaaaacggttcagaaagtatccagttttcggatgtgttttcagaaacaaaaagtcggttggatttttttcaaaatgtttcagattcggaaacaaattaggaattttttttctcagagacggaaacgaattcggtaaggccactatccgtcggaaacaggaatcagtcggagaatgttttcggacttctttctcagcatcggaaacaaattacttttcccatacagcagattagctttagccttctctactctagatgtttagaattgtaccgagtattgaggtaattagttgaatggagattttttttctagtctgctgctttatatcaatttttccatactacttacatatagatgaatatagttcttaaatattataattctcatgaaaagtgaagtgtgcaattaattgtattattattaattgataaaaaatagaaatgtcaatttactgttttcaaaaatattgaactacatctcttcattaatatgagaagctcatttggagttgttttcatattcctacaaatatttgttaccgtaatcgctctggttggtattcgctttgttttcatattcaataatgttctatcccgattttgtatttggggtttcgatttcaattccaatactgaaaaaaatatgaaagtggaaaaggtatagctagtttccgtccattcccaagttgttttcatccctagctagaagtgaagatccataagggtcgtagctacaagtgaagatccataggggtggttgtagagaatgcaaaacctcaattcctaagaaagaactaaggcctaaaatcagtcttctgaaattgctcaaggtgcttttccacatggaaatgtggccaacgccatcccccctaatcaacatatcatccacatataggtgaagcaaagtacatcgagcatggcttgcgcaatggggcctccaagcgacatgcgcacgacacaaactgcaagcgccgcaggtgggcaaggtctttgaatgagattttggggcgattttctggtgaggaccagtttctcttctcaccatggtacaaaaaaccgaaccatgtcaaaccaaaaaaaatagaaaccagcactcactagtaggggtgggcattcggtctgaccgaaaaattcggtctcggtcttcagtctttcggtcattttggtctttgaaaactcaggaccgaatttcaccccaaaaaaactcggggccagcaaattcggtctcggtcttggtctgactgaatttggacagtttcaggagataagtttggaatgaaaaaatttgacagcacttcccctcttttcaggcattttttcatagttatatatcacaaaaatacaagataataggcaacatcatacaccaaataatatatcacaagataggaagattaaatagcataggtctcaagtctaaacttcacagtcacagtacaactcacaagtcacaaataaaagttcaaggttgatgagtacattacttgcaaataaaagtcattattatgcac

SEQ ID NO: 32509 - DNA, 4261 bp, Oryza sativa
ccatcaggcttgactttcttgttgttgtgggatgcatgagggttcttcttctgtaccatattggcactagaacctccctcaacctttttgtgccggttgtcctttgccctcgccttctcctcaacacccaaagagccaatgagatcagaaacactgaactcttgtctcttgtgctttagagaagtggcaaagtccgaccaagaaggtggcaacttggcaataatgccacccgccacaaacttgtccgacaactcacagttgttgttctcaagttccttagccagcatctgaatctcatgagcttgttctactacagaacggtcatcgaccatcttgtagtcatagaactgctccatgacatacagctcactgccggcgtcggaaactccgaacttggcctcaagtgcatcccacatgtccttcccggaaggcatgtgcatgtacacgtccactatgttgtcagcgagtatactgatcaatgctccacggaacaggcaatccgaagcctcgaacttaacctcttcttcaggagagagaggtggttcacttcgtttaccccgtgaaacatagaagcattgcatcgctgtcaaccacaatagtgcacgtgctttccacctcttatagttagaaccatcaaatgcatgtggtttcagagcaaagccaactaccgaaaatgacctatcaggtttttggattgttggaaatatggtcatatatcggcatattttaatccaaaatattaagacaataatcatgacatgaacaatgtggggtgatctaatgataaaatgtaacataaccaggagcatgcttaaagtataataagcatcatgaacataccaagaacgcaatagaattgtgactaacaggacaaacagaggtattaaagaatgagttaacagtaggagaaagatataccccgagaatgtccctccactggattgtgaggcagaactgcctccgttgacgttgtcgttcacagcggctccggctcccggcatgccatctccagggacggtggcagcggcgccggctctaggtgaggcggcagcggctacaagtgcagacatggtggagacgacaatgaacagagcagaagtcgaaagcagtcatacagaagcactccccaaaaacctgatcacccgcctacccggtgcagatctcaggcaaaggtgtggttccggtgcgcgcaagcgatcagaagcggggaggcagaacagaggcagcacaggcgcgcggaggaggaagaacaccagcgagagaaagcaagcgagagagttctgatcggattagcggcctccttatatagcaggagtgatatccgccagttgccgcacgcgccgttacggaggcaatcgtgggatcgtgcacgcgccattacagaggcaatcgtgggatcgtggttaagtgccgttacggaggcaatcgtgggatcgtgcacgcgccattacggaggcaatcgtgggatcgtggttaagcggggaggcagcacaggcgcgcggaggaggaagaacaccagcgagagaaagcaagcgagagttctaatcggattagcggcctccttatatagcaggagtgatatccgccagttgcgcggaggaggaagaacaccagcgagagaaagcaagcgagagttctaatcggattagcggcctccttatatagcaggagtgatatccgccagttgccgcacgcgccgttacggaggcaatcgtgagttgccgcacgcgctgttacggaggcaatcgtgggatcatgggatcgtggttgcaaaaagggtagacgcgacacacgcctcgccggctcggcacgcgcgtgtggctttccgattcccacctcaaccggtcaacagggagcctccaataactctctatttaagttgagatacttctcgtttaattcatgaggtggtattattatccttaacatttattatgagcctttgacatttaatagaataaatcgggcctagcccaattaatctaacagttcctactactaagacacaacttgtgtttaaatgtaggaatatcgtgattcaaactctggtagatggatgagcatttatagatacatgaatagaagtgatgacaacattacagagtttgccttttcgtttttaaagtgaccgctctctccggtttaccggaaaccaataaaaccaatgactcatgccaatgtcatacggaaattggctgatatcgactggaaccgatacctagcggtttcacgaaaaccaatcgttttatgaatcctgcaaagacaaattgaatcgaataataatttgttttgaccaaagaacagcaggggaggcccatattgtaataattttcagtaataaatcgaagaaaaatacaaaggaatcagggatcgtgtaacaaaagccactgtgttaattctttcgtgcagcctccatttacccagtatagatgcagaggagtatcttctttggaggtcttcccacattgctaatgagacctcatttggataatgtgaactggaaataatttcccactcaccgaggggtaacttttaatcctacaacctatccatccattcttccagattcatttcatcctacccttatgttccaatcccaatccctcatatcccattatctaaataggccccgagggatgaacattctcaagaaacaaaccattgtgattgttccatattttccaataagccacaagggaatatccataaacatattccttggaattgatcatcgtccgttcaatagaaatcatagttctgattcccaaattgaaaatgaagccaatggaacccccacaggttgtactaaaattgtaatgttagactcgcataaagtcaataacatcatatttaaatagggaagtagtagttaattatgttcccctttagaaacgtaaaaaatttgtattgattaaaataccaacagtattctaacatttttggcacgtataattaactcctaaaattctttacattgtggataaggttaacataacattaactatcaataactttcaaaaatatttagtttgtagacattagaaaacgattatagattagtcttaaaaaatattttaaataaaattaaatatttatttttatatatatttgaagaccatatcattgtacaaataatcaagaacaatggaaacaaagggaatatagtataggttattagttgtcaacaatcggagacattaatgttgaaaaaagaaatgcctaccaacgggtggaatagagatcgctagtttttgaatacgcgtcgccggcacacatttctattgggattaggtagttaaactaatatattagtcttagctaacgtcagtttaagataatgacggtagtagataaggttttctttttctgcgagatttattttaactaacaaattgaaaagaaaatctatatctgaagtcaaattttcaaaattttaaaccagatttgaaaactttcaactcgaaattttaaatttttaagtcaaattttgaaaactttcaacttttcatcttaaatttgaaaactttcaactcaattttgaaaactttcaactcaaatttgaaaactttcatctcaaatttcaaaaactttcaactcaactttgaaaactttcaacccagatttaaaaacttttaactcgaggtttgaaaactttcaattccaaatttaaattttttttaaattaagatttaaaaattttcaagtcatgatttaaaaacttataacacaaaaaatttgaaagcacttgtgctgaaaatttttaaaagaataatcagaaaaaagagcaaaaagaaaagaaaaaaatcgtgaaaacaaggaaaaacgcatggaaaatattcgctaaaaggcggcgtgtggagggtgcgcgcgccagatacggatccggcgcgcgcgccaattagcaaaagccggtggaatgggtcaatttacattaacggaagaagccttcgagtggctgtgtcaaaataaatgcaaatggaggttttctaacaggagaagagagatggtgttggtgcggtgatgagaaatgacagaggtgtgttcatggcaattctctcagcattattcttatatttggcaatgctacgatggaaggtcatggttgaaatagattttatagaggtggtaaaggtggtgggtgttaaaaggaattagccggccatggaaatccaagatttgaaatctagcttgagtttttttttttttggcaggctatgaagttagtataggttcgtcgttcgactcacatggttgcacaaag

SEQ ID NO: 32510 - DNA, 3134 bp, Oryza sativa
gtgtacaccaactaaaaattatcacaaaaaattataggaaaattcatacatgtaatagtattacatctacgtgcaaagtcgtatcttcaaattcattctacatagagaataacaaaaaagataaaattttgacaaaattgcaaccttaaaactgtcagattttttgtttttttgttacggctaaaatataatgaatttgacgttaacattttaaccctaggtgtaatacaattgaaagtatgtgtatgattttttctagattttttggtgacattttttaattggtgtgcacgtgtgtacacgtgagggcctatgtgcataggatatgttgcccagttgtttcacaacctaggtctcggttcgtccagattttattttacctatgttggccggttaatttaggtgaataaagtgtcagcatagtttaacagttactcgtgttatttatcttgctacgcctatactcgtattagatgttgagacaaacggaccaaaatatacagttgagtcatgtaaaagtacacagaaatacaatttcgagcaacttttgagttatagcgcgtcgattaaaccgacaaaatatgacttcggtttgagctatggcacgctgatctagtgaatacattcatgccacggtacaacagaccgaccaagaaggtataactatttcaaaatcactggcagttcaaaattaacaagcatcagaatgagccataacttcatcaaagctattccaagtcaattgccactatcagcaacaaacaatcacatcattttagtgaaggcaatcaccccacatatgaacaaaatcgacaccatggtgatgtctgaggtgattcttgaactgtcgaaacttaagtctatcccagagcgatatcagcccaatcatttgggcctctgaataatcaaaagagcattaattgttttttaggcttctcatctagtcatctactggttcattgttggacaggatcttcaatcttcagatcaccgtttagatctccctcgctttttaggcttcctttcttctatggattcatcaatgggttggtcttccccactcttcaggtcacctcttcggttaccgtatttcctttttggtttggtcacttctaccacttcatccctgttctttgacctgatcaatcacacaaaacagtagcccaaatactttagctaatgctaaatccacaaacttcaaaaaaacaagatcatctgttagtctttcttacccttttggtaaaggatctaagaaatttacgacttctttaagagcattgagagcaatcttcttaatctacaatttgttaaaaaaacacaatcagcataagggtagttatcacagaacattacaccgcatgagcaaaccagatagctgaatacatgcgctctaacctctagtttatcttctttagccctgtgatcagatggaagacgtctaaactctccggtcagcttaacacactcaccaacattttcaggggaaacaaagtctagagcaaccttgatgcaagactgcacaaatcagaatgggtcttagttttctggttctgagcccagattcttgatgccgcattcataaatatttaatgggaaaagtggtatcaataaataccaccaaaactttatattttcaacaaataccacaggatgggggagacagagggaagtattcagctgcacctttaaatttctcacttggtgtggacatccagcaggaatgaaaactgcatcgcctagcttctgctcgaatgtccatggttcaacacctaaaattatgcatgccaacagacaagaaaaacaacattatatcagtgttataaacagctttggaagagagatgacagcttcaaaatagaatgttatctaaccgtgttcttccttgagctttctcttatgctccacagttaaatagaaagtctggtcatgaattgggtgagaaacctgcacattgtacagagctattgctcagaataagaaaataaaacatataggattcctatataatgtgattggacaaaaaaaagggtacatttttcactggattgcagtgtatgtgccgaaattctgaggcatgcttccgaagataatcttgtaacttctcagaatcttctcttcggaaaatatcccacaaagcgccaccagttttctgttggtctgaacagtctgaatctttgcgtttgaatccactcctgtcaatgtatccttggttgtctgaagtacaatgagctccagcatgcatcttgacagaactattaacctcgtgattgtgttttgaacattgtgttaattcactttctacctcagattgacaaaatgatggtttatccccaatatcacttccagaatcatcaggtggtaaagcattaatgtccaaacctgcatgactcagaaaagaaattagtaaaccataaccagacaaacaattcaatttcttgccagctcttgattttaacaagtaaagttttattatttacccttagtactttggttagaggtgtgtttgttttccatgttacatgagattttcgatgcttcatcatcagctttacccttggcgcctgattctgaaaccccaaacagttcatgaagatcttgttctctcattttcattttaatttttgctatcttgtcaagctgttcagtgtcataggacacttcagctgtgtgcatcaagatatttacctggtcaaaccaaacaccttttgtaattaacctttataccatgagaagccagtgaaacccaatcaatatataatggggaagaacaaataatttatggtaagcaggcctggcaatgcaatttttattctggacaggatgtaaaagctataacaatctggggaaaaaaatatcatcatgccaattatagaataacataccgcatcagacatgtcgcaatgaagcttggtcacagagtcacccctgcctaactcttcataacatccataagcaatataagtttttggcccaagatcaggcttcagtacaccagcaggaagcctgacagcaagatttagcgggccatatcgggatcagtatactcgggaaatggcaatgcagttataaactcagcaccatggcgaggtaacctctggtcaaacatactagatgggggccaatcttttagctta

SEQ ID NO: 32511 - DNA, 396 bp, Oryza sativa
agtctctgatcattaattattgcatcattgcttgtgtttcaggacttcctgtgactattcgactcttggatcctccactccacgaattccttccagagggtaacgttgaggatatggttcgtttgttgtcttctggaaacgtatatactcaggaggaaattcttacaagaatagaaaaactttctgaagtgaatccaatgcttggcttccgtgggtgcaggtcagctctttgtgttgtgctttcatcatgcatttgtttgaccgcaattaattattaaaaaggaggtaccacaccagtgattctgatttgcaatttgtttgacactttcaggcttgggatatcatacccagaattgacagcaatgcaagcccgtgctatctttgaagctgctattt

SEQ ID NO: 32512 - DNA, 7505 bp, Oryza sativa
  unsure (1)..(7505): unsure at all n locations
cgctgctgtcattctctttcgttgtgaggactgagtgcctcttctgtaagtattttacgctttatttacgtttggaactgtttattacttgttgttttgtgtaccctggctggtcctagacagagatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaaatgtctcctctcgtccttcggcatttctttgcgaaacggtttttaaaattctcctcgatgtccctccaattcttttagttgtaaaacctggaggacaaaccgtcagcttcgtgtctgttcggaagtcaagtcaagcatcaagcttcgtgcagcaaagagcgagaaggtcagttcagagtcgtcgttccgcgaaggtcaagaagagttttcccggagttacctaaacccaatctttcccggaagagtagttccgttagcttttagatcgtgtgttgtttgcttgtgtgtaggggtatggattgcatcattggtggggatgcgaccatactaggttgtttgcttaagcaacttgaatcataaaaatccattaacaacagatcagtaggcaatcggtttaagaccttatctttagtaacccctctcatctccccctccctctcttgtgcccgtagcaattggtcagtatgagggatagttgcattgggtcaggatctcaacagtttcatggatcaactcggtgcaatcctatgggcattccacgtcaacttcatgaagatcagcttcaaccttaagtcatggctaatcagactcagacagtggaagagttgttacaacagatgcgacgtcggtaccagatctatcagatgcagcaaatgcaatggcaatgtcaggagccacgtcaatgtctccaatcgcaggtgcaagtccaaatgccagcccggaacccaaatcagagtcagagtcaggagttcccaatatcggcaccgaagacccctgtcaaaatgctgtccagatccccgaagataactgtagccgagtcatcgtcagaccaaaggaaagtaagtgctacctgttatgactgtggtgagcaaggtcactatgcaaggaactgtccatggaaggtgttcaccaggtcacctgaaaaatacgagaagcagtgctcaggaagtaaccaagctccaagccagtctaccgacaagaaggatggtactttgcagcccaactatggagcgaacaggacagtaatatggaagatggataatggtaggaccatgatcatcactggtttggaatttactcctgaagacgccgcaaggatacccaagcgtcagagaagaaaaaataccttccgtggagtacgtcagctaacccgacacctcataaagtacggcccgcccagacccgaagatgatgaatcaggagagcggttctctgctgacgatgatgataatgacgatgatgatgatgatgaggatgaggcgacacttaacagtttcatggaaagaggaatggagttcaaagcatgtactagatgtgggatagtcggacacactgctagtttatgcctccccacatgtcgctgtggtgaatatacccattactcagatcatgccctttgaggaaggttacatgattcttgtgtgaaggaacagatcatgtgcctaaggactatcagttgaacacggtcatagctaagaccaagaaagaacaagggacaaccgtgcaacccattcgtcgaccaatggcagacgacaacagcagtcacaatccttctgctcttcctccaactccagctccagcggaagccaaccatggaagaagcaacatcgccagggatgttcagaaatcactgcttgttccagtttcagctgccaaagtgcacaatcagaagcctgcaccccgggaccaagcaagtcgattatgtcgcaactgtcgtaaaccaggacattgtttcagcgattgtcctcttccaagagcagcaaaggcagttcatcgttgttcacaagttaccagcactgcccacgacaccaatcgacagctgaatgtgcaacctccgcctcaatggattatcgtcaagggcaccgtcaaaggccgcattgttccaccagcaacagcttcaagccttcagcaccagcgccagcagggtaagcaatgccaggaaaccaacagctcgctacagctacaaagaggcagtatgctccttcgtcagcacccgcagcaagtgttgccagcatcaggttgcccaactattgccaatcctagcaatgcacctcgtattgctccaatccggaggcccatcggcaaatcatcactcggtaatcccatgagctagaagatcctacctgctacagctgtcaagaggattgccattccctcctcgaagatcaatgcccagagcaatgtttccgatgcaacttctgttagtaggaactaaagaaacaagtcagttaggtttaaataatggaagcaatagcagttctagacaagacttctacttttcaagttcagtcgtgaaaagggcagttctaatcagtagcagtctaccagtgtttaattttgtaatacttctccttgtacatatatgtttatggcagccatgtaatgaaaaggaaatgttgaataaaatatgagttagccagttcctctccttttatggttcatcttgagcatgcagaagcaatttattatgtgtatctgtcggtgccacaagaaaccaagagtttctcttctaactcatcgcaattttgttgagctccaaaacctgtttgctagccaatagaggaatggttaaccaacggagtgaaaatggttagacactcaacacttgacatgatgagatctctttaaaggcagcatcagtggtactcaaatgaaaagagggatggaatatttgaaagtgacatcatataaagaatcttgggaactctctaaccttggaagctgttacaggatggtaatcggcaattacgccctagtggtgtgatcatgaattcagtataagttccaggaatcatctcaatgtttctcaaaagttgaaaaaagaaattgttccatacatgagtcaggaagatacaagagtttggtccagaaatagaaatgtgtagtcaacaaggtatatggcagagaatctattttcaacaaatcatctttaccgaagatatgaaagcgaagtggttatgatcaaagagcagaaactctcagcagcatcaaagtcagtttccgatagttgttcagattgcagtattttccggaaagttgttgcaggatctatagtccgtcaacccaggaagagtcagcaaaggatggtcgaagaagtgaaatgtcatgccatggaaaggacctcttgagttggatctgttaagtgatcagtgcttgtttcaaggaatgttaactatgcaatctgtttaggcatatgacaccaaaaatcaagtcagaagcaagatagttgtaccagcagttagaactggttggggaagtagtcaagagttagtaagatcaggagcgaaatgagaatttctttatgtggagtttcctatcagcaactgagggttaagttccaaatcttgctgggatgaaagtgcgtcgtcatttctctattttgatgaatcggtgaagttcaattttcaaagtgagggcctttgtaagtaagagaagtgttggttatttttcaaggacaatagtccaattgttcccagtcaggcgaaagtaagactactccctgtaaggggggtaggtctcggagatgagttttggctcagttcgtcgctgttttagtgaaggttcaacctagtgcagcaatccgagtagcacttgaagaagcctgttgcaaggtatcagaagagctaagccgatctcagggcatccgattgaattctaaggtacacccgtgaggccagatcaacaactccgcttagagaagcagcatcagggacagttgcagttcagacgaaagattgatcaagcagcttcttagaatacttactgttcatgtcaagagcagcccagcgaattaagggtcaatgatttacgaatgccagagataagtcttaggaacaactccatccttctctagccagcttggtgaactgtcaggttatcaaattgctagtatcaacggttcagcccaagataagagagtttcacgagcatccgcagccctagtttgggtcagttcaagcagaaccaataagttcagttttgggaagcaatgggacaacagggttgaatccagccagattgctcgtataggtttgatcagttaatcgatcgtgttgggtaccagaactccagggatctaatccaatgaggccagtcagttcagttgtttgaagcaaaagaaacgaatggtcgatgccgatcagttcaattatgcaggtttggtccatcgagcaatcaaacaatcagtcaatccgaaacagaaaaaaacagtgcagtgtctagatcagtcagatcggtcaaaccgcccgcacaaccagttttctctctagccatcccagaatctcgggacgagattcctataagggggtagatttgtaacgccccgattttcgtttgggattaaaaatcatttaataatgcactttctagaaattaaataaaagttaaagctagttaatcaagtgaaattattgagggaattaaaaatttcctttaaaaatcaaggccgggaatattttgtaatattctttgtgccctaatgtactctccggaattttccgtgaattttcggagctcaagaagtaattttaatagcacaaagttcattgaatcaattaaataaaaagaaaacaaattaaaaactccccttcctccttgggccattttcggcccaagaatccttcctctcccccgcggcccgcgcgcccctccccctctcgggcctctctctctccccctcggcccgctcgtccttgaagtgtaaataaccccctgctccctctctctctcaggccgacaagtgggaccgcgggacccacttgtgaggttcatccccaaccttcctccatcccggccagcaaccgcccgaagccgccatgccacccgttgccgcccacgtcgccgctgattccggccctcccactcgctccctggcgcccaaaccgcataaaatcggttcccctccacctcctctaccaaatcccccacttttccccaatttttggcgccaaatcgagcccccacttcgcccacgatgtcgcccacgtcgccggccgttgccgcatcaaatccgccacgtccggccacaatttcaccctcccgagcctatataaaccctcccgtgctctcctcttccggttccccctctttccagagcccggcactctctccctcgatctccccacgccggtcctgcacaccgtgcgatttccggctagttccggccgcccaccaccgttgttccacccaccgccgcacaaatccggcaccaccgtccgcttcccggcgccgtgctgcagccaggcccctactccatttcccctctccgcctccggaacatcgatgcttcacgcaccacctctttccgccgccgttgtcgcctccagccacgcgccaccgccgctcccgccgctgttgtgttgcgccgcctccactcaancttcaccgccacgcgggcaagctcggtctccgcttcgtttccccgttccatcaccggaactccatctcctctgtcagcccgagccgccaccacctcgccgccaccgcgagcgacctccaacctcacactctccttcgtcggctccgcagcaacgatagggagcccgacatcccctcatccaagctcttcgtcgcgggaaatcctttccccgctgtgagaggtgagctccttccctcatcgccggcttccggccgagttttcccgccgccttgcgcctcctccctattccctaactttccctccttgttccccagatcttccggtcgccgtccgccggttcccgctcgcggaacactgccggaccgccgttgccgtgccaccccgaggagtgccgccgccatctcgcctccctttggtgccgtgccgcttcctgagcatcccctctccgctctttcccccgctctccgcgtgccgacccgcgccgccggtgtcgtcgccggtggtcgccgtccggccgcgcgttgccgtcgtcgttcgccgcgctcggccgcgcctgtactttggccacccgtggaccactcctgtggtctgggtccatggtgccgccaggctgcagtggaccgagtccaccgtgcgccctcccctagtcccgctgacgtgtggggcccgcctgtcggcgcgcccttcccctttgatgacgtcagcggctgtgccttttcctttgaaaaattaaataataattccgcaataaatcagtaataattctagaaatttatttaaatggctcaaaacttctaaaattcatatctaattcattcgaactccgaattgggccattcaacttgcaaaattcatctaaaattgacctctacatgtttgtttactttttatgtactgttttcttggtttttattagagtttttcctcgttttgcgtgccagtgtgtagttcccgtcgtttcggaagtccgtggtcatgaggaaaagagttcggaagatcaaagtgaagaagcaaggcaagtacacattccccttgagcatttgatcctaatttacaaatgttttatcgtttgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaacaatatgcttagccatgcttaattaccactagctcagttgatgggataactgcagtattagacctttttagtatcacgaggagctgcgtgctcaagacacccggccatgcttcatggtcgtaattgtccaactaaaatgcgactaaatggtgggctgtgggtgcatggttttgctagtcgcacccatggcaattaaggaccggttcacgggatgccctggaagaacttatcgtacttaccacaagccagcatgggcaactgctgggcttgtagtgtagctttactctagccgacgcatccaggcaagggtgggcgtgatggagtttggatgggccctgcgacggcctatgcggcttccggattttcctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacgaaaatgtgtcgtggggctgtgtcttgtgggtacagttgtacacctctgatcagagtaaaactattcgaatagccgtgcccgcggttatgggcagtcgaccaaattcaccgtgattagtcccaccttaataaattgactca

SEQ ID NO: 32513 - DNA, 6944 bp, Oryza sativa
tccaataacaaatgtatccatagggtgtacatgtctcatcacttcactttccaaaaacgtatcatatgaattacttgcttcaaactgtagataaacttcttgatcaatctaatctatgtacctttccaaccatttgcctgctcttaatatacaagggtggcgtgtttcgatatggacatctccattcaaaatcaacatcgaaggtgatcttcgctgaatttgctactcgtacaagtgcaatcttctcgtacgaccatggttcaatctgtgggaagccgttgtctgaaactgttcactctgttacgtgatgtaggagtatgtgcctgtgtgtatcttctgttgtattgaaagaaatttccttgtactgtaccatacgacactttattcttcagataaagccagtattgcaaaggacctccacaattaattttacaggaaatcgatacccctcgttgtgtactttttcttaattgatcccatcacactagctcgttcgtttgactacctatgtaaccttgtactcacgctcctgcaaacaccatgttatctttgacattggctcattctctaaactaaagcttttatcactattgcacaccaggggatagagaacacataattattggatcatattttgcatactgtgtacgtaacagaagcgatcattgcccattttgattaaataattattaaattttgtgtcagctagatatgtgtacgacaaatagtatgagacagattggtagtagagtatttgatacacctggtggaactacaatattacgaaatcactttacttgtttgattttcggatatgtaaacgattttaaatgagtgtcgtacatatcttgttgagcttcacaattttaatagtacatatagaacgttatgaagaaaatatacatatgagtgacaccatttttcagagactgatacaacttaaggcgatcgtctctaaaatttaatttttcataagctttcgcttgagagttagcatcatcagaagtgggcgtccataccgacccataccgttattacatcggcaccaaggggaatcgttactagctcatcctagtctcatgtaacacatggaaggagcgtaacaatggagtattcaagagcgaggaaacagcgctacctgggatcatcaatcgcatcatagataagctttgcgagaatcctaattagcgcatacgcatgaggaggttaagtcgcgcacgttttctggcctctacgcagacgtgtgttttcctttttttcgcaacgaagcaatctcagataaaaacattctattttttcggcacaacaaatctgccgcatgtgcggaaggcttagagaaaaatatgattaacttaatttttatacgtaattagttcctactagttgccaacccgcgcgttgcacgggttactgttaacgatattaccgtgacattcaaattttgaatgatatatatcactcagattaaaataattttagtaattttaacataaatcttactttaatctttattactaaattggtagtcgttactaaatataaattttttacttagttcggagtctgaattatcattcctctattatggtttataaaacccaagttcaaaatcaatattaatacccttaataattgtaagatgcttcattagagtttattattctttataaaataaaaattagaaactataatattattggactacaaatctaaccactattacaactcaccctcctatgtttaaacaaaatatgttctttcgtagtttatggttgaataatgaacttttattaaataaatttacagatgatagagtttttcatatttaaataaaaatattcaaacatggaaaaaaaatctagtaaaatgatactttttataaaattgatgtgaaaaaagctaaatttttttccataacattgtattttcttatttttataattccaaaattaaaaattagataatgtgaaagttgattggggcgataaaaagtcgacaaatttaacatgcatatgctccatgcataatcatgatgtaataaaactaaataaagacttgatctggctaagtgtaagtcaacagagtttgttcccttcttctatgtcgctattatagcagattgaacgtgtgtgtaaaaaagtaggaaaaaaattgttgagtcacaccattagggcatgtacaaaggcattaattagtgggctctctttattgctatgtaagcatatttgattaggtggaagagagagaaaatagaaaggagatgcatcgatgttttgcatgccatcggcttgacatcggctctcatcgagataaacacgagcacacgagataaacaacgaaccgttgtatggtccatcttcaagaaaagtcgcttatttagattcaaagtgcagaaaatcacgtaatcattgctactagaatttaattactgcatatcagtggagagacgataaaaaaagccagcctttgtagaattactgttttattctgacatagcatatctatgagcccatagtgggctcaaccgttgaacgtgcccttagaacatccacaatggttatctataggctctctacaagagatccatgttagcatattttcctacttggaaaagattaaatgaagagagagagcaaaactatctacgtactaacctagagataatctatacagaaaaacgaggcaatgtattagagagctatagatacccatgtagacatattattgaggtggtttactattaatctagtctattactgagatgtacatgttttatagagagcaccttactttactattgcgggtgctcttatagcagcaccgtatatatggctctgggacttgataggcgttagcgttccatcaaacgggctgacattaattgtagaaaaataaaggcactacaaatctttaatcttttgagaagtccatgcaaacacaccgagttagctcttctccagatatcaactgcttgcatcgacaacaggccatgcctcttgccgcaagctaagattgttgactttgccgtagctgctctagagtgctgagattaaaatttactttaccggatcgtgtattcgtgatcgaataatttgtcttggtccatccatgagattcagcaaggcaatcggtatggttggtggtcacaaatcaaaaaaggaaaaaaaaaaccccgaacatatatatacatgatacacgtgggttaataaagacatttgaacgtatatttttgtagcagaaagtatatttactcaccaggattggatggctaaatcaaattactgtagagtttagttggaactgatcaatcgacctcatcgtcttaagtgcacagagaattaacatgcatgttaatttagatgcataagagcacccgcaatggtaaagtaaggtgctctctataaaatatgtacatctcagcaatagactagattaataataaaccacctcaatagtatgtctatataggtatctatagctctctcatgcattgactcatttttctctatagactatctctaggttagtagatagctttgctctctctcttcatttaatatcttccaagtagaaaaatatgctgacatggatctcttgtagagagcctatagataaccattgcgggtgcgctaaggtagacggctatatcagccaccagagaaacttgaaatcgatcatgtactttccgcactggctgccggtacgtaccaaaattagctagcttgcatgtgcctgcccttttgatcaatcagtgcccaaggttttgctttttgggcagatgcgcttcccgatgaactacttcggtctagccatccttgcactctttgccgatccagatgaagagagtacgaaggagatgcgacccccttgatcgattattaggataggtttcgtcgctaaacgccgccgatctaaacgaagagcgcacgaaggagatgccgccgtcttgtttaattagagattagagatatggtgggggtcagatccataaggagaccgaacgggctttaattggcccacagtgtaaatagatctattagataaattatttacatgatgtacggtcaggatgatacaatcgacacaatagatggttaagatttttctgattaacgtgagagctcgtagaaagtgcccaattagtataggtatagatagatagataaattaggccaatcaagataaaccttttgttctagaacattattttccttttttactacaaatttgcaaactttaaactcaaatttggaactttcaaatcaaattttgaaaacttttaacttgatttcgaaaactttcaacttggttttgaaaaaatttaactcgagatttgaaaactttcaagggaagatctaaaaactttcaactcggattttcaacttgagattgaaaactttcaagtctaaatttgcaaactttttaagtgaagatttgaaaactttcaagtcaagatttaaaaactttcaactcaaaaatttgaaaaaacgtgtgctgaagattaaagaaaaaaaatcaggaaaaagcgaaaaaggaatatcagggaaaataaactggcgcggggagggagagccagctggcgcacgcgccagttagccatcccctaaaatttggttttggtcggctacaggggaaaagagtctcttggccataatgcgcacgagaatagtagcccaaacgatcctgtctaatacaaccaaacgtagtgtggacatgcttagcatgacactctttgtcactacttttcggatttgctttctggcacatacgcgtgagcaaacgaaatcacgcgtgtttcaaatccacgcgttttgactttttctctttttttttctttttcccaccggatccccgcaagcgcacacgccagcgcgcgttttctcctctcccgtaattaatcgagtggctgcgcgtgttttctattctcccgtaacgtaacggagttagtttaggataatgacgataattaaggaaatatttccaactaagatttagaaactttcaacataaatttgaaaactttcaactcaaatttaaaaacttttaactcaaatttgaaaactttcatttcaaaatttgaaaattttaactcagatttgaaaagtttcaataatttagaaactttcaactcaaatttgaaaactttcaaattaagttttgaaaacttttaacttaaatttgaaaactttcaagtcaagatttgaaaattttcaactctagatttgaaactttcttcagattggaaaactttcaagttaatatttaaaaactttcgactcaaatatttcgaaaacacgtgtactaatgattaaaaaaagctaggaaaataatatgaaaaaaagaaaaacgtgcgaggggggaagaaaaaaaaggaaaaagtgaaaagatgggaaaaaacacgaaaaaatagccaaaaaaaataaaattgcgtgcctcccccacctcttttctctctttttctttttactccatacatgggccatcctcaaacacctcgcctgcacaggcaacaaggtgtcgttcgagtgaatgcagacggcaacgggattggcggtgcctaggcagaagaaggcggtggcagtgatgatctcaaggaagacgagggggaggagcaagaagactatggcatcgtcgtgtttgtgtcagtgtgaaggcgcagcacgctagaagctagcccagcacaatcaatccatcactcgcgtacttgctaggctagctcctagcatgctaacggcctcacgtacgtctcgctaccccgaaattctaaccctaccccgaggtgtgtcgatatgaggtcgcgagatgcctagtttgcacacgtttgcgaactagtgattctttgacccgggccagtaactaagcacgtacatctcaccttgccgctgatagctcactagagcgaaacgtatgctggagcatggattcggtaagagcaagtataatagtaggctataagcaggctaaatgctgaggtggaggagagaaaagaggatagagaggagaagtgggctgtaaacttgcagccggcttggacacaggaaccaagaaactatgtgagaaagataagtgggcctgtattaattacaaagagctaactattatatgggtaggctgagagaaagctataaaaaaccttatagccactggtggagaaaccatctttcgtcggtcggccgatttccacaatagtcccggatgcaataaaaaccggggctaaagatgatctttagcccggttcaaaaggaaaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaactttagtcccggttggtattactaaagatcccggtgatctttagccccagttggtgttaccaaccgggactaaagatcttaactttagtcccggttggtaataccaaccgggactaatgatcccggtgatctttagccccggttggtgctaccaaccgggactaaagtcccacccctatatatatgtcttcttcctccttcagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaa

SEQ ID NO: 32514 - DNA, 635 bp, Oryza sativa
aaggaggcccataaatggaccaagatgttgaaggaccacagaacttcgttgtacctaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcatttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttt

SEQ ID NO: 32515 - DNA, 1097 bp, Oryza sativa
tggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggact

SEQ ID NO: 32516 - DNA, 326 bp, Oryza sativa
tcattggctagagaacgccttgaacagctcaatgcttcaccatcagcgactccatcaaaatactttcgtgtatattctgcactattgctggttctatcggctgatgtactatggtaatattccctggttagtctgcattttactgttttttgtttagaaatattatttacacataattttttctttgcttaggtgttgggtacacttaaatttattttgattttgtagatgtcagagatgcatgatgtcacttactcacttccaacatgaaattattgtcccttacaatttcttgcaacttgcaacttctgttataaacttactct

SEQ ID NO: 32517 - DNA, 10412 bp, Oryza sativa
  unsure (1)..(10412): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaccaacaatagtaataacctgatagtgtacgagttactgagaacagatttgatattgcatcaattgggttcttgttcaaaagtactttctttcgattgtgatctttgattaacaaaacattgtagaataaaaatttactgtcaaggcccagttttagaccatcaaaatgcgcatactggaaaaaaggaggttatgcaatatatagaaggagatgtacaagaaattagatcaaacgaggggcactgggtaatgttttgttcatcgagatcacgcgaacgtgatcttccatcacggaaaaggccgaacaagtctatgtagtagcaaacaatcttacatcacgcagcagaacgaacatggtaaaagtgagacctcaaaagttcacttcaattgcgtctacaaaccatttgaagcattgagggcaagtgctatgtagacgtgactaccacatccaaactcattcatatcattcactcataaattaagaggcaaaccatataatatgtcacctctaatatacaatgtcatctctaatatctctagtactcttacacctttcttgaaactataaaggaagcccacgcagatgcgcgggcaatttattttgctatttgtaatgagaatactaaaaaagaagttatatcacactatattcattataaaaaatcatagattaccttataaccataaaaactaaataagtataccgtgaaatagaccaaagactttgatatactaaatgataatgtctatcatattaaaaaaactttatcccgattatacgtaaactcgcatattaccatccttcccaaacattcgagtaaatatgggttttggctttttttctccttttattatacatcgatccacttatgcatgttcaggaggcaatatacaatggaatgatctatattgtcaaaattatttttactaattgttaacactatttagaagagactgacataataaaaaaaggtttataatgtggtttcattgacatttaggagtgtacatacgcatgaatattttttccggcgattagtagtctcgtacttatgtactttttttcttgggttttcaacaaacaaatattttttctctcctaggggtagagtatatgtatgtgcattcattgggtgggtgtgcacgtgtttatatgagcatctacaattgtcttttacttcatagttaataaaaaaatactttcaagtaaatagatgggatggcgtgcagtggcacggtgtgccttcttcgataacctcaccaggagtggtcactacatatatatatatatatatacatatatatatatatatacatatatatatatatatatatatatatatataacgtgaggaaaatcgtagagctacatagaaagaaagaaagaaagaaagaaagaaagagaactaccgaacaagaggattgtatacgtacgtactcttctttttttcttttcgtgtacatgtgtacatagggagggattaactggtttttaagagcgagcaattactttaatagatctaatctaatggttgaaaataatgaatccaccggtttaagtgtaaaacggtgggtagatgctttattttttcttattatttttcttacatttacttaatttattagagcatcatgtaacatcctagaagtggttgtaggagagtaggaatattattactcatagtcacaatctaattgtagtcaactattgtttgactgtcacttggtggcatcatctacttatctgtcatctttttatgatttcccagttagtatcgtccttcatcctcaatgctagatggtacacgtgctcattggatatgagataattattaggtgcattgtgtagggtatgactctgtcagggctacggataagatataccctttacccttagatgtacgcgatatggcaatacggtacatctgcgcgtgtatggacgttctctgtatacgctaaggaaattcatctcgaagtccatcaatggaaaggttcctacccgtataggactgggtcgtcactatatcgtgcagggtccgatgtctccgagtcctacctggagaccacctgacctgcgatataaaagggaccccccgggaagacctaaggcatcaaatctcatagccaacacaacgaccacagcctacgaagccggagcctacaggagccaagtcgctgggtgatctagtcgaatcaactcgactacgatctcgtcggtatcgtcgagttttgttattctctttgtaatttgtggtcatccccgtataatcccatatcaactggattagggctattacctattaagggacctgaaccagtataatctttgtctcttgtttccttgatgtcgtattacatagatcctcgtaccaacgtaccccaataccctctatattcggtctacgggtacccaccgtcgacagactcgaagattgatagacagtggtttctatatagaacttatatatacggtgaatagtagggacatataattgatatatttggctactactaattgacaaagtaaattatatactacatattaagaattttagtacctaagtactccctccgtttcacaatgtaagtcattatagcatttttcatattcatattgatattaatgaatctagacatatatatctatttagatacattaacatcaatataaatgtgagaaatgctagaatggcttacattacgaaagagaggaagtaatgattaaggttgagtaccgaagtacttataggattggccaccccttgtttactgtaagcatgcttaccgaacattgtgtgtgttttggaaatggtttctatataaaagtattctaaaaattaaataaatatacttttaaagttttaatatttaattcttaattaatcataatattcaatgccaatgacctacgttgttttgcacgtcctgataagctcagccaattagctagagcgaatgaagcctaggacataaagcacatcaatactatcaaaagaaaaacacataatatatgaaaaaattagtaatgttatttagttatatcagtatttaacttttgggaatgtttgaatgttatttttatttttggaaatgcaagtctaatttctcaagtgatatacagttatataatctatattttcaatttgtttatattttttatggatgatccgacagcatacagcttgttataatacaactccaaataacatatatttttgcatatgagcttaaattattagttttatttttcatctaatctaagtgagagaagaagaaaagaaaaaaaagacgtggggctgggcgtaaacgtaccgtacttttttttccttcctacttactccctctgtcccaaaatataagcatttttagctataaatctggacaattgtatgttcagattcgtaactaaaagttactatattttaagacggaggtagtagcgatcaatggcataaacgtggcggttttggggatagatttaattggtgacttttaagatatagatctaatggtgataactatgggttcacccgattaaataaaaaccaacgattagatgttttgcttttttaatagaattttaaggatttattagagcgccacgtggcagtttaaaaaagtcattaaatatctaattatggagctcaaacagttaatttaactaaaagaaatacaatggtttaatcttatcataaattggatgttaagtttaaaaggtcatcgttgtaaagacagtttattaaagaacgaacctaagaccaccaatgaacctcatatgtatcaaggtacatgggacatgcatcagaatttcgtccacaaccggttttgcctccatgagagaagtcaaggaattaagttgaccattagatatactaggaatcgtgcacgtgtataaaaaaataagtataaaatgtaaactacatataaaaattaggaagtgtgataaaatgtcataactgcataatttaccaacgtaacagccaaaataattaaaattatctcagtgcaccaataacataaacaaaccaaactttggtagatatatattaaaaaattgagccacatcacagattgaaattagtcaacaagttcagggaatgaactcagaaatgaaccggtacaaccgagaatattaagttcaggtacatcccaggataagatcagaaaatactatagcaaatgttccaaattttgtttctgaattctccttaatccacatgaattgtccttaatacaatccaggataagatcagaaaacaagacctctcttacaagcaataccgcatatattatttgtcaagacaaagccaagtgcataatccacatcaggttatcctctagatgatactccagccatgctccctggtcctccaaaaacaaccaggctcaatagtccaatgcataatgtaaataacagggccggcagaagaatctgaacatggtaatcttaaagcgaccttatataatctgcacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacgaacacaaaatggcattttattcttgcacgaagaccatgtcaaagccttgatatatgcattatgccttcatgatctttaaagtcaatagatacctgcataaagcatcaactaagaaaatacattgtttttgttccaaaaaaactgataaataacaaaaatggcatgataaaagaaacaccttaatggatacttttgttaaaaaagatagggaaattcttgattattcaacgccagatcgaatcatgtccaatggtcattggaattttgtctatccttctattcttcaaaataattcagatttgttagccaaaatgcgaagaaataggtttgccattccattacagtatcatcaagagcaagcgaaagaaccaatatcctgttttgggatttcgattgaaataccctttatgggtgttttacgtagaaatactatagttgcttattttgacaacccacgatacaaaaaagataaaaaggttttgagaattgttaaatttagatataggaccacataagcaacacaattaatttaaatacagaacatatggacatacttctctctttgctgccctgtgtttgtagatggttcaactatcaacataggatgctcctcaggataaaagctaacaaagcaaaaaacttcagtagttgcatctccatgccatacaaaggaaatcctagtatttaatcaactttatccggttgtacacataagaagggatttcactattagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggcgaaccacataagcagcgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattggtgaaatcacctattgggcatggaagagaatcagtgataaacaatagttaactaacctccatatgatccctcctaaatagaataaaaacacattttagtacatacactacaatagagtattatcacaggccaaatataaattgtctccaggtaaaataaaggtagcaagcaaagcaaaattcagacaaaaaataatagtacatgttattgcagaaatttgtagtgtagagcttcgttgactatccattgaaagtattcagaaagcacggctatgttgtggaccacgattatggtagagaactgcaaatgcaagacactcttatgcatcagttcagaatcctcttatgccatggacgcccatcgtagacagccagagccagccagcaacccactcagccatggacgccatggacaaagcaatcaaagcaaccataaaaccaagaaaagaaaaatcaccggttgccgaggagagcctggaggtggacgatgagcttctcctcctgctcagtgaagttcccccgcttgatccccggccggaggtagttcgtccaccggagccggcagctcttgctgcaacgcatcacccctgcacacacgcacagatcaaacatgcaaaaatctcagatctcgcaacccaacgcagatcgatcgatcaagaacacacaagaacacgcaccggtgttggtcggcacggcgcgccagttgccggagccgtgctcctggatgtaggaggccagcatcaggtcctcctccggcgtccatggccccttcttcacccaaccttgtcgcagcacggcggcctccccatcctgctcgccggtgcgcggcggccggccggtggttggtggtgtatgtgtcgactcgatctcgatcagggaggaggagactagcgtgttggcggcggcaacggaggtagccgggcgggtagcggcggcgtccctgcgagcagcggaggcgctgtggtgccggtcagaggcggctggaccgtgcctggccgtgggcagcagtgcggtagtgcctcggcgctggtccggcattgaggcggagcgaggaggcgaggtcgctggtccggcggtggaccgtcgcgaggagaggaggcgcagagcgaggacgcgagcggggagagagaggcgcggagcgagcaggcggagtcgtcatcgcaccggggatttgcgcgtcgcagttaccgcgtggtgggatgacatcgggcgaaatcgcttgtggatatagatctacggtgtacagcggacggctcagattggatgagagggtggatggacggatgggataagagtggttgatttcacacgtaggattgctagggggtgaactccttttttatattagcactcgtaatcgtgcacttgcacgttttggcaatgtatgtatgtaggtacttcctccgtttcataatgtaaatcattctagcatttttcacattcatattaatgttaatgaatctagataaatatatatgtctctagattcattaatatcaatatgaatgtaggaaatgctaaatgacttacattgtgaaatagagggagtagaacaatagtgactttttttaaggcagtgcagaccataaaaattgttaaggtaaaaataaagtttcatacatcatagtaaaaaccctatttggattatttctataaaatcctttttggtgaatatatccataacgtacaaggtagcccggcatgatttatacattgcaatgttgctactccctccgttttatattataagattttttttctagtcaaactttattaagtttgaccaagtttataaaaaaatttaacatctaaaatataaaattagtataattaaatataacattgaatatattttcataatatgtttgttttcttttgaaaataataatatattttctataaatttgatcaaacttaaaagaagtttgactaagaaaagaaaacaaacatctaatatgaagcggagagagtacttcctaagcaaacaattatgattgaagtataaatcattgccagctggaagtgaaattgtaagtaaagagaataacaaatgatcttatatcagtaagtgcacgcacaaataaatcaacagtaagtaccagtacttcaggaactgaattttacataatttcacaagctgactaaagttatatataaataaaaccggttaagaaagcatacatccagttggtcagcaaaaaatacatccaatttatcctgaaggcaagcaaattacatccaactctcaccagaattatggcatacactcagcaccaccatgccatcaagatctgtatcttagaccaaattttaatcctgcacaaatggttaaatggtcttccttattaaggaaaattcaggctgtacttaaacatatatctatttcaatgtgagcgcattggtcagcttctatttcaatgtcagagtattgtacctgtggcagttgtagaagtctcctttttccactgcttgaaatcttctatgaattgtccattgcattgattcagtccaaacttctccaaacctaacaacacctagtgattcagattgaaaaagcaaaccagtaatatttttgttgctatactgaggaagtgagaaaatacaaatacattcatttgatcaagtgtctggagcattttgtcaaacacatgaccgacatgggcaaagttttctattcagaattgtaacaacacggcaggctgttgccaactgccaatcagatgagggaattatatggaagctctcatattacagaacacatgaaatgaaaagcataatgtgctaaacatagtatgcgagctcgagaattagggagagtgaaaacctgatttagtcaagggtaagcaacttccacattgcaaaagtgagcgaactttgccacattggagaacgcgagatcgtatccatccatggccaaacatctatggatcttgcaaatgatttaacatcaataaccttgcagcataatggatgatgtccaaaattgctcaatttttgccgaaaaaaataaaaatgatagaaaattcagagtgatgtaagtatcctatgaaaccaaatgtaataatcagagatattatacaaaatcacatgtccatgaagtgctttataacagaacttttggacccattaaatgtaggaattttgttgtgtgcaagcctctgtacaatcatgttgaaacactcaatgcccaggtgatgattcatacgaagtgattcatgattttgtttttagactcaatcgaattggataagcctttgagatcacaatacactctttcctaaaacgcacatcattaatataaattaaacaataacataatgccatgttctattaatcgtatggaaacaggcttacttcagggattccttagacaagatgcatttgtaaagtccatcaaccaagtttataggtgatgattgtagaatgctcatgattagcaatatcaacatggggagcttctgagtccatttgagtaccacatgggagatgcaagtcaacacagattcaagaatttaaatgaggcagtgagccatatatgatagtgtgtcaacaacctgacatagtttcagaatttgaattcactatgcatacaagaaatatattccctattaaacaatgtatttggctgccaacatcataacactgaaattctacagcatatatagttttagaatttgaattaataaatgcaggaaaaaaatatcacctgtataaatgaacaatttaaacatggcagctaacgtcataacactgaaaatatttagcataagggtctagaatccatatatacttctttacagcaggaaaagtatcacaatatatcagactttctccccattacattagaggataacatatctaaaaaatattgagaagcacaagcagaaaatcttatagtcatcaccaaattattcccctcaacttcacttattgtacctaactatatctgcaattgtggctgcacagtgcacacacattttcttagctgtgcaagaattggttgttaaatggacatgatatagtgctgcaatagacaattagtatttttatagcaatccgaggcagatgaactgaatctctgtatgtattaaaagcaaaaaaaagaacttttatgctcattagtgtggaattatgctcactaagatgttggtaaattactaccttgtcagtgatgtgcccttccacagccatccctctcctcggaggcttggatcggtgccatcaagatcccagtcgtccacagctaaggtccaccagcctatctgctatttcagggattgaccgatctgagtagttcgccggagcgcgaatagcgaaagggaacatgagaggatcacgatgaggtagagggggagggaatcgcgggtcgaagattgtaattaccttccatctttccgaa

SEQ ID NO: 32518 - DNA, 986 bp, Oryza sativa
ccatcaaatggatgttaaggcagctttcctcaatggagagttggaggaggagatctatatggatcaaccagatgggtatgtcaggagggaatggtgtgcaagctgttgaagtccttgtatggtttcaaataaggcctaagcaatggcatgagaagattgacaatatacttacatctctggctttgttgtgaacgaagctgacaaatgtgtgtactatcgctatggtgggggagagggagtgatcttgtgtttatatgtcgatgacatattgatctttgggaccagcctcaatgtgattgaggaggtcaaggactttctgtccaaaagctttgaaatgaaggatttgggagtggctgatgttattcttaacattaaactactgagaggagttgagggtgggattacacttgtgcaatctcactatgtggacaaggtcttgagtcgctttggttatagtgactgcaaggcagctcctactccttatgatcctagtgtgctattaaggaaaaaccgaagaatagcaagggatcaattgaggtactcccagattattggttcattgatgtacttagctagtgcaacgaggcctgacatctcatttgctgtgagcaagttgagccggcttgtttcaaatccgggagatgatcattggcatgctcttgaaagagtaatgcgctatctaaaaggggcaatgagctatggaattcactacgccaggtacccaaaagtgctggagggctatagtgattcaaactggatatctgatgctgatgatataaaggccacaagtgggtatgtgttcacacttggaggtggcgctgtttcctggaagtcttgcaagcagaccatcttaacgaggtcaacaatagaagcagagctcacagctttagatactgccacagttgaggctgaatggcttcgtgagctcctgatggacttgccggtggttgaaaaaccagtaccagcaatcctgatgaactgtgata

SEQ ID NO: 32519 - DNA, 2415 bp, Oryza sativa
aacaaactattgtgtaactgagagaagagaccctaaaatgggctttatcttcatgatgcacttctcttctaatctgtatggtaggatggtatacaccttaatatgatccgagtggcttttcataaagcagagatgttggcctacagaacatcttagaaggaacacacctatatgagtccgactgctagtcacagtctatgagatctgggtgatatctagatactcatgaaaggccaggagtatgacttatacgctccaaacagaggggatgcaaacggctgcctagtaccagttaagggtttgagtgaaacctgaatcgcactagactgacaattcaaggcatagtccattattcagttgtgatctggtgtagctcttttcctaggtggaagttcaacttaacagtctccaccgaaacactggtataacaaacaggatcagaatcgagagcatttcctgtgagccatgaaatttggtggggattgttagattaatgggctaggcccaattaaatcctaataaattccattggcccacattaagtgctatgagtaataatatcaccttggaaatctaagtgaagaggtctcaacttaaatacgaagctagtggagagtctttattgaccggttgagatggtgcgcggacaaccaggcggggcgaggcgaggagaggcgaggcagacaactgctgctgctgcgctctctcgttttgtaacggacgataataaacacagagaattgatttcgtatcaatgaacgcgtcagttacggaattaaacgtcatgaattgattccgtcggttacggaattaaacgtcgtaaattgattccgtcggttacggaattaaacgtcgtgaattgattccgtattaacgagcgcgtcggttacgaaattaaacaccgcggttgatgactccgaacgttactctcgtgctcgcatatgtatactccgcagcgaccagaaggacggaagaagttcttcacgactcttgcacttcgagttcctcctcctctgttcctgagctgcagaatccttccccggttctattcacctgcgtgcacaggtgtatgggacgagcaggtgcctccggaactccgtccgcttgagaacttgcacgggtaggcgggcgatcaagtttttggatagcacttcaagcgcgactgctcttggtcttcgtggctactgctgctgcatcggcaccttcaccaagatgtcaacggagattggagacaagaagatgaacgacatcaacggaagcaatactgcctcaaaatccagcggtgggacgttctcggggtatactttcattctcccgattctattagatatttctttgttaatactctttgcaatggcagcattgcgttactttgtaaatgttgatgcttatttcatattaagcatactcaagttgtatacatctagcactgtcactagatctactcatactgcaaatgtcatgtttattgtcttaatattttggattaaaatatgccgaattatgaccgaatttccaacagcacctttgctctgaacttgcacaagattattcttcacttctgagcaatatcagagctatatgcttgtgtgcacaggcagcgcgcgcgtgaagatgatctatttcccgtttgaaatacgaagattaagtgatggcacataaaactggagtcattaacaactgattaatggtgttttaacaattataaattaaaaatagatttatatgatattctaaaacaacttataatcaaaaagtttttgcctatgaagaagtatatcatttagtaatttgagaaccgtgctaacggaaatcgaggaaaaacggtatcttcatcaagtttttagtatgcgatgtacatcagtagcataagatttccttctataaacatatcaacaaaatgttaaggtctacagcttgacactgaatctatgtacttcctttacttattatagcactgaatctatgttaaggtccacgttgactttctctaggaggagcatgtattaacgtctgcgccggcatgagagggagggagtggggggatgtcagcgtgggacatggagggagggatggaatgggggagtaggggatctgagaggtgtggactgtggagtggtgcggggcgggggcatatatatcgaccccattcacaccgctggtcacaaaccaccacctcccacgaagtacggacgtttgggaaatcccattggtttcgcttccattccatcattctttttgcaatattctcggtaaccgcacaatatttacgtgagttccaatgaacggccaggccattcgtggttaacgaagcaacgtagtacgtacatgaccatttacgcccgcaagggaaaattaaattctgatgtgaaacaatacgttgtgcaaattaaaatgtggttaacaaagcgtcgc

SEQ ID NO: 32520 - DNA, 4205 bp, Oryza sativa
ccatgtatgttatgttgtgtattgtcctgccgtacattgcttttgtactgtggctcgtacgtactctagtatataccgaacataacatttcgtacacacactgctgactcacgtacattttgttaatttgaagctgcaaggcaatgcatctagcggccaaggaggcctgtcgtcgggaagcggatgcattcggataatctggagagcatgaaatggccaggacaaagagagttaccacgccgtcctcaaacaccttgccttcaatggaaacaaggtgtcgtccgagtgaacgcggaaggattcggcatcgattatctctagggaagacgagggatatgagaaagaagacgatgtcattgtcgtgtttgtatcagtgtgtaggtaccgctcaccttgccgccggcaggtcaccttatagccgacctgttggctcactggtggagaaaccctttgtagtcccggttcgtaacccccctttagtcccggtttccaaaccgggagtaccaatccgggactaaagatcgctatctttagtcccgggtgaaataaccgagagtaaaagatcgatctttagtcccggttggtaacaccaaccgggactaaagatcgagctgaccttttttttttgcatgcccctgttgctgcatggtttatatatatataaaccatgcatatatatgtttcaatacatatatatgcatacatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtatggtcaggttatccctcatgcgaataactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctattgtcatttctttaccggtcaccaacggctcgatctcctggtttggttgctctccaagctgagggactggtttggactttccagaagatgctttcttcagcgttcgctcatagtccgatagcttgatagcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagttcgaggtcctcgtacgcgccttcgaccaactcaacttcgaccttggagtatcctgctggaatcggcctgcagtggtaagtacctgaagggtctgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggtgagtgtcagctcgtccctatctctgtctggtcggaacgtgccctgacaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggacagatctcccttaaagctctgaaactgttctgccattttcttcagagtccaccttttcactttgtcctctgtacccgcaggaagggtgaatgtctcgagcattgtggtccacagcatctctttctccgaatctgggacaaagcttcatgatctccg

SEQ ID NO: 32521 - DNA, 2304 bp, Oryza sativa
tcgatcgttctcgttcacgttgtcgcggcaacgtacgttgacgtgttcgttctcgctctcgttcgttcgatcgttctcgttctcgttcgttaacggcggtgtggcggcatcggggcggcggttggcacggcggcgtggcgacggcggcggcggcgtggcgttgtggggccgtggcggcggcggcgtggcgtggcggcggtggcgtggcgtggcgtggcggcggcggtgtggcgtggcggcggcggcattgcgcgcgcggcggcgaaggcggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcgtcgtcggcgcggggatttgccctaggcagtggcggcgaaggagagaggccgagagagatcgatcggccgaaaacgtttaagtgttggtgaagaagacgagggcgcaccgggaatatatataccccttgatctttactcccggttgttctcaacaaccgggagtaaatatcttatcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattttaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaagatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgt

SEQ ID NO: 32522 - DNA, 708 bp, Oryza sativa
ttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccgaataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgtt

SEQ ID NO: 32523 - DNA, 809 bp, Oryza sativa
ttggcatggctggggatgcaggagtgcacgctgggaaaggagatgatggtgaggaactactgccaacatcaaatgccccttgtccttccagggcagtagccaacagatagtcagatacagatcgagtgttggcgatagatggagcaagtctggttggggattacggttggaggagttggtgggctttgaacagaggcggaacggcgtgctccacaccgaggccagcttcgaacgccagcgaccaagggctgcagatcgagctcggcgatggaaggccctggattgacgccgactgcatgcggccatctcggatggggctctggcggaagggggaaccaccacgtcgcctgcaggggcacgatgcggtggcgtgcggcggggagtcgcgaggaggcgcaccagcgaatgaggtggtccggcagtggaccgcggcgggaattcgtacggctgagaggagggaggatgcgcacggagcgaggagggggcggctggtccggcggtggactgcgtcggccgcggggaatcaggcggggcaggtgaggcggcggggattcctcgtgctgctgagagagggaggatgcacacagagcgaggaggagggtggctggtccaacggcggcaacggggaatcgagcggagcgagtgatcgaggcggcggggattcgtgcggctgagatgagaagaggagggaggatgtgaagaggagcgatggggcggggattggagcggcggagtcgcgcgctcgggggcggagtaatcggtgggattagcacaacgatcatgatgacatgagacgacggatcagatta

SEQ ID NO: 32524 - DNA, 9038 bp, Oryza sativa
  unsure (1)..(9038): unsure at all n locations
cagtaaaatgttttccttttttttatagatttttaagaaattttctaatttctaaaagtgccacgtgacagcttagaagcgttcgtagaatgccacgtggcagcttgagaaaatttgtagaaaatttaatagacttttattatataatagaaatagatagatagatagatagataatagatttgtgtggaggttgcctcttgatttaggggtggttcatcatctctctcctcacttatctcctccacctcatcactcaatccaatatggcaattttaggggtagcatatagagcattatagtacttgccctgacctgtatacaacaaactacagcatagcaattagtaaacaagctcaatgcatgcgtatctatctccagcctaacaccaaattaaactttatattctccagcacctaaataaagcttggaggagacccttcattcactgttgttttgaaagtatgaaaacgcgatgatgcccaatccgggtctcctggaagcggccgagatgacgaaggacctgaaaaaacacgagaagattaatgcggcagaaaaggaaaattccaattggcaagagcaaatcagtagtagtttttgtttcacatcttcaagaaattagtgtgtagcatcctattttcattcaagcaaatattcatcattaatggtgccaagtaaatggctttactagtagtctcgttaatactggcctgttatacaaataaacagacaggaatgcagtgtaagtatggtgcgtcgcatgagttatgaaatgttaaatcaattttgttaaacagggcaaaacatatgaatggaattgtttaactgcttaacttcaataccacagttaatgtttaatttagcgtaccatgttctttctctaccccgttcaagtttgacaaatacaaattatgctaccaaatttctttgaaagggtgccaactacaaagggaaaaatttgaatagcatttttgtctaccaaatatgtatatcattaaaatcatcttagagatatagaagaaaaaaaatcatttgtacacaagtggtcaaagctgcatatacttacagtaaggattgctttccctgtggtatcaagttttaagcccggtccctttatatcagtttccaagaagaaatgcctccccttaactgactctcttgctgcaatgtcccttaattcctaaaaagaaaaaaaaatgctgattccgcacaaaaatgagtaaatcgaatcaacatccttccagaacttaccagtgccttctcccatgtgtcttctgataactgcaagaacattaaggatggtcaacaaccaatcctaccatacaactgggcaatggctgtttacaggttaaacttccattgatttgaaaactgtgacaaaagatgtgctggtttctgctatcgggaaagttcaattgtttccttaacggttagtacttatattatattcaagttctctccaaagtctccacataagaatggaaatttctacagtttatcaaatgatgcttattagtaaaaacagaaaatgaaacatctgattttgggggtaaatttggtttatgtgcaggaaccagctagttcccactgttttttcaataatcttgatttttttttataaataaaaggtggagtaaagttattgaaatgatcaacctttttctttggacatgcaacaagatgagcattgccgtccgcatatgaagccacttcattgatggcaatgttaaccttctccagagtgagcctccctctcatgtatctgtagtaacaaaatgggatgccatttttagtttgaaggcatggcaccagtttgcatgtcttatatagttctacacaatgggaaaatgaaatagcaaccttcctgagtaaaaatattgttccaacttccatgtgatttcgtctattctatagtgtataaccatttcttaaagacaagttagcaaagaacctagatttataagaaactcaaagaagttgaccataccagctatattgcattgtttgtctcttgagttttgatatttcaggttctctactgattgaacttggtgtataatgaaatagatgggttacaaaaccaataggcagcactttaacagcttcaacttataggaacataggtaaataggcacttatctccatactcagtagtgctggattgataatataaacctcatgacaaccttcattgcctgtgagacccacatagcaaaaagatgatgcaaaggcaaagaaggcagatgttttgactgcaagtcatgtctaggctcaattctaggggcttgttcagattgatgccatttcaaaccataccatttttttggcaaagttgccaaatatgtgcatccatttagtttcgtaccaaactctaataaataaataagaaatcttgccaaaacttggcaatattgccaaattggcaaaattttgacaatgccaaaatttggtaagatttattttggctacaatctgaacaggccctaggtaaatcacaaaacattcacctagcatttcttaccatttgttcagaaaagaaaatctaagtatgcagaaaagaagaatggtgtagaaagaagtagcacattcatatggtatacatcgcattatctcaaacggacagatgtaaacaccaaaaaaaaacacttaaccacatattggatgcagataaaggaatgtggttggtatataaagacaagtaaatgaaatgaagctatcattgcaattgagaactcacgatgacaacgaatcaagctcctcagtggatatgtaccaacgaggtgcaggtcctcttcccttcttctcagtaataaaagaataaattagatgatgacacaattataatttctatctgaaaagaattgtagacaatgagtaaaagttacataagattgtatatctttaccttgggtggtgcagttggctcctccttaatctttaaatcatggtctctgacttctggaacagccgagctgaaattgagcgactcaggaaacatcctgtaacgcacaaaacttgatatcacaaatgaaggtagaaacagccaatgtattttcctaatattcacaaatacattgatgaattatgttccagaggtgtagcaaagacatcctcgcgcatcccagttggcatgtttgcaagcataagctgcagcctccgctgttgcttcaaggactgttgtactagtttctacatcagtatttgaggaaatcactagttagaaatatttcatttcacgggtagattgaacaaaattaagattggatttaggagcaatagcaaaattatcgaaagatataatacttttttttcccagaaagacaaagaccttgtttttgttcaattctccaaatactcaaactacggtaactgatatatccatttacccccatacccagacactcactgcaaccccatcacgccgcaggaacaggcaagattaatccaaccatttctacacaacccatcacgccacaggaggattggattaacaagggattagtgggtatcaaatccctttgattgtttaggtcctaatcaaaatatgttgtgtcgatcccctccccatgttcgtcaaatcagcaaccaaggaacaacctgtactgccaatttaacagtgcattgattaaatcttagaaagaggacgataccttggccttggggaaggcttcgcgctcctcctggaggcggcggcggaccgcctgcaactgcgcttccatggccgtgagcgacacgtcgacggcggcgaggtccggtatcgccgtagccgggtacactgcgaacgtgtgggggaggcaggcggggtcaggggatcggagggtttcggtgatgggaggagagagagagagagatgggaatgaggaggggtgaggttgtggagagagggagcttactgttgcgggcgaggacgagctcctggagctccatgacgcgggactggaaggcggcggagacggcgtccagcgactcccccaagcggctcgcgtcgccggcgtccatggggagcggcggccccggtatcgctcggcggcggcggcggcggggtgggattgggaatttgggtggggaagcgaaatggagcgttggatatttgaattttcgggagcggtttcggtgatttgcttgcttgatcagttgttgtaatagcaagtactccctccatcccataatataacaacttagaatcagccgagacattttatagtttaatagatctagacagaaggtctatccagattagttgcactatgaaacatcccatcatatcctagattgctatattataggacggatacagtagaccattactataagataggtagtaaaaaacaggttcacatctaatactataagacaaggtagtaaaaaacgggttcacatcttctanccataattaccactaccattacagacactgacatgtgaaataatagaggtgggattcacgtaatagtgacattatggtagagaatcctcacccataaaaaacatatgcgaagaaagagaaaaggagataaaagaaaaacggagtacagatttatgttgaactgcagcacgagttttaagatattaatccctccactaaaacaaagaataacttgacaacgaatctagacatgagattgttcagatttattgtcttcgatggtgagtttttttttaacggaggagtacgtgtgtgtgatagatggggcacgcctaatgggcgggtcccgtcctccccctcccctatactcaatacactcctccctcctctcccccttcctcctcccctccttctacaccacaaatttttttttaaaaaaaaaacaaaagttaaaaaaatttatgtatagaaatactatatataaaaaatttgaattcaaattcaaatttgaatcggctatgtaaacttttaacttataaactttggatctaaactttaggtgtgtaaactttagaggtatagaaatactatatatagaagatatttgaattcaaattcaaatttaaatcggatataattcaaattcaaatttgaaatgggtatataaacttttgacttataaactttgggtgtatgaactttaggtgtataaactttagatgtatagaaatactatatataaaaaatatttgaattcaaattcaaatcggatataattaaaattcaaatttgaaacgggtatataaacttttgacttataaactttgggtctataaactttaggtgtataaactttagatgtatagaaatactatatataaaaaatatttgaattcaaattcaaatttgaatcggatatataaacttttgacttataaacttttggtctctaaactttagatgtgtaaactgtgtataaacttactaaaataggaaagtaatacggtgtcaaaaaaggaaactaggtggagggaggggggaggctacccgatcgctaccccatcggctgggcgatcgatcgcccattagaggtttcgtgatagatgggctaagtattaatagtgtattatatatttatatgaaactattgtatggtaggctattaaattagatgaacggaatagcttttatacctaacagttggctatacttctattaaacttgctctaatgctctctctcaaaaaaaatcaccgaaatccgttaatattccctatgtccttgtcgaaacaagaattcggcaataataaaaggggtagcgcacgagacctaaaagtggatggatgcggagacaatgatttagacaggttcaagccctctcaatgagaggtaataccctacttctgtttggggatttgaatccgccgagtgtattatagatctgacgatctagttgtctcatctgccccctagagggcctactgcccaccttatataggatggagggcaggattacaaaatagaaaccttaaccaatacggtatcagtttcctaaatctactttacaatatcattaaaccaggaccttaggccgttccataatatacaaggaaacgtaatacccaagtcatgatctgttacatatttcatagatataagttatcccctataactagtcggataaccatgccgtgtgtgtatggggtacccataatctccacagtcccaatataaatgtatctaggataggatatgacctaggattataaatttggatagctgtatatccagatttgtagtctttaagatatgttgcatactgtatagggagtactaaattaatcatgtgcaaatgagttatcttgttttttaagcccatgtgagaagttcctaaccatcataaatgagtgcagcccaagtcgcccacctcttctctaccccatgcttcccatgtatctacaaaaattagcggagaaaaccaatgatgtgatctaatgctctataaaaacaacggtttctcctaaaaaataggcaactatctctactacattaaaaaggaagtcgtcctcctctctacccacgctttcaacaaatctaaaaaaaccactggagaaaatcgatgttgcaccccatccccaccaaaaaaaaagaagaaagaatggttttccataaaaccagccaattagaaaatgaatagaaacaaaactaaaatttcctactacaaacacggaaaaatggtttcattttgtatcccatggcatagcatggctaatttgctagtactatgtagcacaatcgtctttcttcccttttcttctcgccccaatcctatttataaaaaaccacgacgttctcttcccaccacaatcccatattattcatgtctcaaaataaacaaatctaatacggaatgtgacacatcctagtactatgagttagtattataatctcatagcagtaaaacatgtcacatcacatactaggtttatttattttgaaaacggaggccaggtatctttactacagtaaaagggaaattgcccttcccctcttcccacgcttcccatgcaccagtgactagcaaattattagacgttgtaggatcgagatgtcgattacaaggggtgaatatataggcgattaaaattaaatcacacctaatcaaaactaacctaagttgctaggcttggtgagggataaacttaactaagcaactaagttatattttacaatcctagagtgatgtgggcttaaaatatgtctctatgaaagtaaattgcaactaagttatgttttgaaatcctagggtgatatgggctcagatatgtctctatgaaagtaaattgcacagatgaaaatgcaataagtaaatgaggcaagagacaaggaatttttcacccgaggttcggaaactcgccggttcctaatccccgttgaggcgaacccaacttcaccgctcaaaaccacgaagccaccgcaagcccccttcatcaaggggtggcaaggtgggagccggcccacgaagtggactacccaagcctctgtaacatcccgcctctcccaggccaggcccacttacatctggcagctttctatccaccgcaaacccccttcgtcatagggtgggcaaggtgggagccggcccatgaagtggactatcccgcctctcccaggccaggcccacttacatctggcagctttctatccaccgcaagcccccttcgtcaaggggtgggcgaggtgggagccggcccacgaagtggactatcccgcctctcccaggccaggcccacttacatctggcagctttctatccaccgcaagcccccttcgtcaagcgtcccgcctctcccaggccaggcccacttacatctggcagctttctatccaccgcatgcccccttcgtcaagcgtcccgcctctcccaggccaggcccacttacatctggcagctttcataggtcatatactgccctcatagaccaaaattagtcttttctgcacactttgtccttactcgtgcgcactcgggaagaatttctcgatcagtcatccatccctaaattgctccaggctaagcatgcttaacctcagagttctttagagattggcttctggaaaagaagttgcaacttgtcagccatgaacgttccctcttggccacgtccatgtgtccaatgccagcgcatgtgccatgctgtttgaccactccatatccacacaagccatgcacaccatgtctgcgcaactgcgacacacgcgcccgtaaaaccgcgagacctcggagttctttagagctcggcttctggaaaagaagttgcaacttgtcaagctaggaacgttccctcttggccacgtccgtgtgtccaatgccagcgcatgtgccatgctgtgtgaccactccaagtacacaccagccatgcgcaccatgcctacgcaactgcgacacacgcgcccgtgaaaccgcaagagtccacaccagccatgcgcacatgcctatgcaactgcgacgcgcgcccgtgaaaccgcgagagtcggctctaataccattttgtaacgtcccgcctttcccaggccgagcccacttacatcttgcagctttcataggttatagactgccctcatagagtcttttctgaacactttgtcctcacccgtgcgcactcgggaagagtttcccgatcggtcacccatccctaaattactgcatgccaagtacgcttaacctcagagttctttagagatcggcttccggaaaagaagttgcaacttgttgatatgagtattaatcctattaagccctcggccaggatgtcaaagcctcgatcactaaaggtagttcttccttaactccaaaggtggtaaactccaaaccactcacaactggcgtcgggccttcttcataatctccttggagaggtcacagggaaacacctccacaagccatctaggagatggcaacctctaagagtaacaagcgatgacccggctcgaagatgatcaagtgccgcactagctctacaatgaagcaatacacttgactcttgactaatcaaccctcaatcacacaaaatggatgaacacaaacactagagagtgtgagagtagttgcaaggggtatatgcaagtgaagcaagtgccaagagagtccccctgttgttggtgggggagtat

SEQ ID NO: 32525 - DNA, 1632 bp, Oryza sativa
ccacacacacacaaagactagccattgagggtcgaaatccccaactccgtgctctactggtcagactgccatggggtggccgatcagaccggactacattgtaacggttggaaaactagccgttacagtgcatttaatgtattaacacacgggggtcggtcagaccgccatagggtggccggactgaccggccatggctgcggctctggcggctctgggtcgccaatcgcgaggccaaccataggcattcaacccgctggtcaggccgacttgggatcatcggtcagaccggcataatgtcctcggtcagaccggccctggaccgaagatgcaattcaattctaacagagaaccaagtctaaatacaaatgacctaatgtagcattttgatcatctttttgtttaggtcattaccccttttgatagtatgacaaagctataaataaatatagcaaattttgatcgcccaaactcctcgatcaattaaaataaaaccactagtttactgtcttcattccttttactttgcgccatcgattttaatcctcgatagtcatccatggcatacacatcatatgaacctatctcaaaatgtataactcaagataatagttagttcacaaatagcgcttgtcattaattaccaaaatcaacgacgggggcctagatgctttaaacgcacatgtgataatgtgtgaaagtgaccaagcatgccctttggattgatctatgtatgtctacaaagctaaagggagtgaacagagggttcacaatttcgatgaacactgaagttttggcgtgactcaaaagtagtagtcgtctagaatttcaatgggtttcattcaaatttaaatttaaaatgataaaaaacgaaaaaaatcaaatcaaatcctataaatagtttgatgttcatagagcctactaggatattttttttttcaaaaaaatgttgcattccatgcatttcttgaattgtccagtaggaaagaaaagaataattatttagaaaaagggaagccctttcatgggccaaattccatgtagtaatgaaatggacttcaatatatgtattggactctaaactatgtacgtaatggactttaatatttaggtgacaggcattctatttggccaatggttggtgactggtgagtgatatgtattgtcttttatgaatatgtattacatattgtgtgtatgtcaatgggagattactaaatttataggaaatggcattttcacaatttttttccaattatctaacattttttttctatatttttcgacgaaaacaaatttggttttcttatctatttttcgaagataccaatcggtttttagtatgcttcgtcttctggtttcagattgaaatttgtatctcaaaagaaaaactagatgaatcgcaacaattttggactgagccatcaagccgggcaagcgagctttttttctaccctatatgcatcaagattgtcaatttcattcgagaggccattccaatttggctcttagaaaggaagttctcataccaaccgatacagatgtaccgtttcagggtttaataagataatactccctccgtttcaaaatgtttgacaccgttgactttttagcacgtgtttgaccgttcgt

SEQ ID NO: 32526 - DNA, 7406 bp, Oryza sativa
  unsure (1)..(7406): unsure at all n locations
agtcaacggtgtcaaacattttgaaatggagagagtataaatatgttactaactccatcatatactagaagtgattttagtatgcatttgagagattaaggaaaatgaaaaaaagatcaaatacccctcaatagattgaggaagtgtgtaatgcatacctagaaactactgtaggatacacgaatggacatccgagattcatccatatcaccttgagtatttttctcctagatttaatcataagtaattttttgttctggtagtaaaaaaaattgcttatgatgatatagacaaatctcaaacgttcacttgtacatcgtacgacagtttccagatttacactacatatgaagtttgtaatatatgttttccctactagattaggcaatattagggttggaaggttgtttagtgggaagaaaattgaatgagggtcaattggtgcacaggtagtgctctagactcccttatattttgggacaaatttaaataatttaatccctcatattatgatgggatggagggaatattatgcaatattttatcaaatttgtgcccataattatactaaaaatgatagcaatgagagcaatataacatggatgattgagtttatagctagacataatcctttctttgaatgtaattgtgacccactgacttttagtgcagttaatgctataaaaaagcctttaggtgaatccgcgttattaagaatacatgaacattgcacgagcaaagtccagtgcatggcaagagccactttggactgaaataaagatcactccagaatagaacttgcaatttacaaaatataaatagagtgattcaaagttattcatcatgttactatcatattttacaaaatttatcatgtatccttatgaatcgaccaagccaaattcaacggaaagatcactcatgtttaaaatatactgaaacaagtggtatgttaattctgatcaataccgaccagaatttaatcagaataactgaaattaacgatattttgattggaacaatatgccgctcgctcgcttcatagctttaggtggtggaatataatggcacatattggaacggaaccgataaacctggtttgtgtttagctcaatgtatgaaatatatatggaaaacccacttgctgctgcaggaacatgacaaaaatgctacaaaatagatgcaagttaagggtgtgttttctctgctagtagacagactaacactttgctttgttgttgtgatagttggatcaagcaataattatactacatggggtcaattgttataatatacaagattaattgtagtgtactattcttgttgtattgtgcattaattgggtgcccatttactttgtgaggcaaaccattaatttttattgcagtctggtaattgttttattgtataatacctgctgctagaggtctgacagtgctttctatagtaaaaaaaatacgatatttgttatttaaggtctttggtgtgtaactttggtcataagtttatattagaacaagtttattaacctaataagtttaagatattatgaagtacattagtacatttctaagcagattgcccataccacttttgcattttgaaattaactaattttagagttattgattgtcaaagtttcaaatgtttgacaatatcttatttcagtgttaaatatgtaattaccgaatagaataattaagggttgttcatttatgctagctgtggcagcacagccttgctgctgctgctgctgccgcggttaatttttgagtagctgctactgttgatgcagcctgcagctgcaaagtagcgcaaacaatcaacactttagtatactgcgtcatagcaaaatagttactcccccatttttaaatagctggcaatagaaatcattcatcctcaaacttttatattttataaaaaaagcaaaaaaaggccattttttgagtaacttaaaagcaaaatgtcaattttactccccaaactttttcaccagagcacttaacccttagacaacttttcgtctcattttatacccaactcttaacaatagttcaccttactccatgataatatttgggcttttcgtttatgcctgtataaatcatattttgaaataaaatttgatagcattaatatatgtattataacttacctctcaacattttttttgttatcgctgtttacataggttggaaacaccgaaactaattttaacatgaaggttttaactttcaagcaagtagttattaaatttttataaatttgataatgatgccatctatggctctataaaatttaagcttaaagtatgactcatataaagataaacaaagaagagaaatgcaattaaccaataaagtgaaccattttaattaaattcaggataaactaagcttaaaaaatacttaagggaataaagtgatcgaatattgaaatagtttgaaaaaataagttggaattttttgaactaaaagaccatgttcaacaaagaataaaacttccattctcttatgtggtgtttaaatctcctgaagatgaagatgaagatgaagattaagtgtttcacgcaaaacaatgttgtaataatatgtgattaattgagttttaattattacaaacttaaaaaatagattaatctgatattttagagcaactttcatatagaaaattttcacacaaaacacaccgtttagcagtttgaaaagcgtgccacgtccaaaatttaatcctctctttacatagtgttagggttaaggaataagcacacttccatcctcatagtctaatcaaactattgaggaataattagtggtcaagaaaaaaacgaatgtctcctagtcaatgttggcagtctagtggcagtactactggagtatttgaaaacgaagcgagtagtataattttaattttttagcagtgcatcttttttttttctccctccatttctgcaaagtcaataatgcccctcgctgtgtccacaaacggataagaggggtaggggtggaaaaaaaactcgtgctcgtgagcttggctcgggcttggcttgagtttggttggctaggctcggctcgtaagtcaaacgagccaagcccaagccatctttttagctcgttgctgaaatgagccgagccgagctagcttgcgagccgcttgttttggctcgcgagccttaggcatcgtgtgtttatatcgattattttactttatatggcgttattatttgtcaacttaaaatttatcattaagattttgaagaattgaatatataaacttatttaaattttacatgttaatgatttgtttttactttttttaatatttataaaatatatatgaagagtcgtttcaatagaaaggcttgcaagccagctcgaactggctcgagccaagaaatgagccgagccgagctaaagttttaacttgtttccctaaccaagccaagccaaaccaaattagtttgttgcgagctcagctcggctcgtttccacccctaaagaggggcagcgtggaattagcaagcccagggaaaaaaaaagaagatttttttttattttagccctcgtctgatcgtctcgtctcgcgtggcggcgagcggctgacccgggcgacctccgccgcgccgcaccgaccgggccgggtcggggtcgtgtcgcgcggtcactcgctcgtggcgcggcttgctgctctacgcgtcacctaccgagctctcgcttttccggtactcaccgacgcacgggacccacctgccttggcgcgccaaccgccccacgccccctctctcgctctcgctgctggtggtgtgcgcaggcaggcgtcgcacgcggcccgtaccccgttttgcacaaacgcacctaccttcgcagcatattgcaatattccgtggatgaaccattttttcttttctttttcttttgtgtgtgcaccacatcctttttcgaaatactagctaaatgtttatgctttactatgataaaagaactatatcatactattatcaaatacaagtaaaactatataattcatgaaatatgttactaccttatcttttatagggaaacattcacttgatttcatatgtgattgtccacgatatttctctatttttaacattaaatctttgaatgagtaatttgcaaaatttacgataggataaatgggttggcgggttcactgtcaccaccgctatctttttgcaataaatttcttcgctattataactggaaaaggattattacaatattaatgtagagagataaaaaaaatattttagcccccaacaatcgtagggaggagacatgtgcacagtaaatggtaataacagttaaatggagaaggtttgtaagtttgacagggaaatttagagaaatacaatagttgctagaaatccaacttctatattcataggaaatatatacatttaagtatgcgtgtattgtcatatttaaacaattttatggttcgtttcagattattgaaatggattatttactctaagctttggaaaatacactcaaaggacgcatatttgttaagtttgtttcttaaagtattcaatttattcatataattaagtatataatcagtagcagtaatctgcctaataatccaaatcaaacatagctcaagtccaaactctacagctttgagttttctctaggctggagcaataccaaacatgtcaatagatagataaagatatgttcgattgatgattaacattgccaaacctcatattacataaggtgaagctttaggcaaagtgttgcaaaaaattgtgtctttgaaataggccgatgaaaaatatagctacccataacaatggcatcaactaaacaactgcaaaacaaccacctaaagttgggatttggcaagttgaaggcatcatccaaccataacatagttctccctccgaaaagaaataatactaacatcatactaactccatcccaaaatataataacttttagtacgaatctagacatgcacttgtccaaattcatagctaaaagttattactcccttcatcccaatatatagaaatatagtatcagatttgatattttaaaatactacgaatctaatcatgtttcatatttatattcgtagtactataaaatgtataatgcacttttagtaacttttagctacgaatctatacatgcactttgtctaaattgatagctaaaatttattactccattcattccaatatatagaaactagcatcagacgaatatgatcagaggtttcctgttcatattcatattactataaaatatctaatctggtatatggctttcacatttaggacaaagagagagtactaatctattttaggaaagaaacaatattacagataacccttaggactgaaacgcacaattctcccgtattaaacccgtcaaatatctagactttaattaacataattaattccaatctatccatcccgtcgtcaataattttgtccccctggctcccccccccaccttcctcttcctcccctcaatccccccttttctcacggcgtcgcggcccccccgaaataaagccgtcgtcgacacctcccccgagccgcaagcaaccccgcgattcccccgcatcgccggcgaatcggcggcggcgacgacgaggacgacgaggaggccatagggttgtggaggaggggtgggggacctgtcttcgatgcgcggcgcatggcggcggtgaacagcctctacgtcgccgcggcatccaccgcggccagcgccgcggcgctgcagtggtgggcggggtccctcctcgacggggatgccgacgcggcgggcgggggaggaggaggaggaggaggggactggctcggcacggtgctgggctcgcacgtgaccgtcgcgctcctggcgaatctggcggcgcacgtgttcctcgtcctcatcctctccctcaaggtgagcaatcggtcgatcgggaatgggatgggggttgggattgttgctgctcagggccacgcggtcattcgcttagattgtgctgtttggggaaaaaaaaacttttgtcggttgaccacttgtcagtaataataatataagcaataataatatatgcaagctgatagttgggaagatggaggtgttttttctgcccaaatttgttgattcaaatttgctgcccaatttgttggtttaatttgcgtgctgaagatatgtttgatgtttaggtagaaataaacttaatttgtttagttagaatggacgtgttttcttcatttaaatcagctaatgacattttgtttccatgttgtttttggaatcatcaagtgtgtgagataatggagtgatttagtaggaatattgtgctttagctgattgcgaagaaccacatgttctcaggagttgcatttcagttgagtagatgcttatctaaactatggtagttggaacatatggggaagtagcaatgccaatagcaactatacaacaacatgcttgaatacaggcttgaacaccgcgattctgaagtctgaactggatatttgtacgtagtatttttgttgctcgatgctagaggatttctgttatgtggtatttttgttgctcgatgctagaggatttttgttacgttaagcggttctgaaatctgaactggatatttgtatgtggtacttttgttgttcgatgctagaggatttctgttacgtctctgaatggctgttatatggctttgatagagcaagagctaagctgacagtgtgtgacttggttcgttgcgatttccttctagactcatttttgtgcatgtggtttaatattcatgtaagaacttgtattgatacatccacttcttgattcatgtcgtaaactggctgtacttaattatttttacttccataggaatctttaaaaggagcattagagtttgacccaattttgtagttcaatcaaagcattttgtctgttggaaaagctcgtcctccatgtatgcatacagtttgcattgcaaacatgataactatgttatataaaaacactatttcatagaggaagctaaacttctagtctgctatcctagtttagattcttagtgacttatatatgagagaaaggatggttcatactattacaaagccaggtgtcccaggtggacccnttttttttgaaggcacaggagggcattgttcttctccattgttcaatccatgatttagcggaaaccattttacctgagcatccagatttcttttaatgatttttagtaaagaggatgttgcagcttagcttatatttaacgtatgcatatcatattagcaatagtggcgttaatgttgttttttcttttatgcagacactattttttgttcaattaacctcttctgagactagaaaggtgttggaacacatcattaactatgtgctttacaaggt

SEQ ID NO: 32527 - DNA, 12298 bp, Oryza sativa
ttcaccatctcagttagagtgcggttctttcttcagctaccccatttgactggggtgaatagggaggcgtcctctcatgaataattctatactcttcgcaaaaagaaataaactcattggaaaaatactcaccacccctatcagaccttaaccgtttgattttcctttccagttggttttctacctcatccttatagatcttaaagtaatgtaatgcttcatcctttgttttcaataggtacacatagcagaatctagtgcaatcatctatcagtgtcatgaaatatttctttccccctttagtcaacacgccgttcatttcgcacagatcgaaatgaacaagttctaatggtgccaaattcctcgcctcagatgccttgtgaggcttgcgaggttgtttcgattgaacacaagtatggcacttagagcctttgactaaagtgaattttggaattaaactcatattggctaagcgtgtcatacaaccaaaattcacatgacaaagtcgcaaatgccacacattggactcatcatcatcatcgtttacatggttcacaactttattacacatatcatccaaggaaaagcgaaacaaacctccgctgtcataaccttttccaataaacgttccatatttagatacgacacatttattggattcaaacacaagtctaaaaccatctctacacagtagagagccgctaactagattcttctttattgaagggacatgctgcacattcttcagctgcacaatctttcccgaagtaaactttagatcgaccgtaccaacaccatgaacagccgcaagcgatccgtttcccatcaaaaaggaggaacctctcccgacttgataagaagaaaacagggaaatgtccgcacacacatgaatattagcaccagtatcaacccaccaatcaggtgagtgacacacagagagaactgtaggtaaaaatttaccataccccaatgttcctctaccctcactaataaccatgtttgcaaacttcttgtccttgtgctcaggacaatccttggcccaatgctcaggcttgccacacaaaaagaaatctccttttacctttcccttgcctttcttcttaaaattggttgtagccttgggtttgacgtcaggtttgactttcttgttgttgttgttggatgcgtgagggttcttcttctgcatcaaattggcgctagaacctccctcgatctttttgcaccggttatcctttgccctcaccttctcctcaatacccaaagagccaatgagatcagtgacactgaactcttgcctcttgtgttttagagaagtagcaaaatccgaccaagaaggtggcaatttggcaataatgcctccagccacaaacttgtccggcaactcgccgttgttgttctcaagttccttcagcatctgaatctcatgagcctgttccactacagaacggtcatcgaccatcttgtagtcatagaactgttccatgacatacagcttgctgccagcgtcagaaaccccgaacttggcctcaagagcatcccacatgtccttccctgaaggtatgtgcatatacacatccacaatattatcggcgagcacactgatcattgctccacggaacaagcaatctgtagcctcaaacttagcctcctcctcaagagagagaggcggttcactcggtttgccccgtgagacaaagaaacaatgcatcaccgtcaaccacaaaagtgcacgtgctttccatcttttataatttgaaccatcgaaagcatgtggttttagtgatgcagcaaagccaactaccgaaaaagacctaacaagtttttggattgttggaaatttggtcataattcggcatattttaatccaaaatattaagataataaacatgacatttacaatatgagtagatctagtgacagtgctagatgtatacaacttgagtatgcttaatatgaaataagcatcaacatttacaaagtaacgcaatgctgccattgcgaagagtattaacaaagaaacatctaataaaatcgggagaatgaaagtataccccgagaacgtcccaccgctggattttgaggtagtattgcctccattgatgtcgttcatcttcttgtctccaatctccgttgacatcttggtgaaggtgccgatgcagcagcagtagccgcgaagaacaatagcagtcacgcttgaagcgctacccaaaaacttgatcgcccgcctacccgtgcaagttctcaagcggacggagttccggaggcacctgctcgtcccgtacacctgtgcacgcaggtgaatagaaccggggaaggattctgcagctcaggaacaaaggaggaggaactcgaagtgcaagagtcgtgaagaacttcttccgtcctttggatcactgcggagtatatatatgcgagcgcgagagtaacgttcggagtcatcaaccacggtgtttaatttcgtaaccgacgcactcgttaatacggaatcaattcatgacatttaattccgtaaccgacggaatcaattcacgacgtttaattccataaagttcattgatacgaaatcaattctccgtgcttattaccatccgttacaaaacgagatagcgcagcagttgtctgcctcgcctctcctcgcctcgccccacttggttgtccgcgcaccatcttaaccggtcaacagaaactctccactagctccgtatttaagttgagacctcttcacttagatttccaaagtgatattattatccatagcacttaatgtgggccaatagaatttattaggatttaatacaggtgctcccttatttttgagtgcaggtcacggcaagacaggaaaaggatttgcttaatgttaagatgtcacgctaagaaaaaaaaaagaagcatgtgctccaactccaacgctttgaaagagagtgaattttctttgtacaaccattatattgcaaatgtaaaaattatgttatttgagaatacaatagtgtaaaagattggcgctcctagatttctaatgccattggaaagcacccaatacttaaaaaaaatagggcgtctggttcttgccattgccattttattgaggtgtacgtgaggctcaaaattaggccaactagcccaccacttagaccaactagaccaaatagccggaaaactccaactcgagctatgctttaatcaactgtagagaatggttcaatgaactgactttggcctgatatatatgatccctctagtcaaaccaaccatgataagtacgatctttggtgaacgtcatttaagtgtatccaaaccaaaaaaaaaaagtgtatccaggcttggtttaagcacagtaggtggcaaaattaccagtacttacaggaaataagttaaataaatttagttattttgtgtgattattatgtaaaaaaaagttattttgtgtgattttatagatttgtactccctccatactcataaaggaagtcatttaggacagcgacacggtctctaaaacacaactttgacttcttgtttctataaaaatatttattgaaaagtaatatatgtatacttttatgaaagtatttttcaagacaaatctattcatataatttttacattttcaaactcaacaacttgagagatatttatgatttatattcctaagatttgacttaaacattttcctaaacgactttctttatgagtacggagtgaatatgtaaaattaattcaggacgtgcagttctatcggttgcatttatgggtagcggataatattccacgctaacaacaaacaggtagaggtagggcacgcagtaggctgtagttataggattgaaaaatagggggtcggtagttggcgcgcgtgttttctcaagtaaggtagagataatttcggtagtagttaagattttcttttttttcacgagacttttttcaactaacaaattgaaaagaaatctatatttgaaattaaatttttaaaattttaaacctatatttgaaaactttcaatccaagatttgaaaactttcaatttgaggtttgaaaattttcaagtttagatttgaaaatttttaagttaagatttgaaaaattttaagttaagatttaaaaattttcaagtcatgattttaaaactttcaactcaaaacatttgaaaaaacacgtgtaataaaaaaaaagcagaaaataaagaaaaaaatatcgccaaaagaaaaaggaaaaaaaagggaaaattgcaaaaaactaccccaaatatcactataagtttgagatggcccctataagaagatttgttgcaaatccccacctctccacctcctaattcaccttggttcgatttaggcaccttctctctacacatgcgtgatttaggcatctcatggcgtaattagccaagtcccgctcatcgtgatgatttgtcaacaggtccctttttgcattagattgtgtggccttaattttctgattaaaccgtactaaacttgctattttgggtcatctgatcaattacaacatatgaaatcatcaggtttaatctaaatatatgattactgcttaatgttcaaatgtttctatatgctcattacgtccctggaaaaaaaaaacggatatgttgttcagtccaaaagatatcgatttggaatatatagctaggataccataaaaaacacagtgaaatggtcatgacatcacaacgaaatgatcagtttatactgaacaaacatcataatctcttgcacccgccaagtgggactcggttgattttgccacgagattcttcaggaatcacgcacgtgtggagagaaggtgcctaaatcaaaccaaggtgaattaggaggtggagatttgcaacaaatcttcttatggtgaggcatctcaaactcagagtgatatttggagtgttttttgcagttttcccaacgagaaaaggtcgtgtgggaaggagccaccagcaatgttgctagcgcgcgaattagcaatcctgggaaaatagagcttttcggtccgctccggagaaaaatcaaatacgatcgtgacaaatctctgttacgaatatggataatttctaccaaatatgaataggaattttttttgggaggagatacgaatacgaatatactaacatttctgttcctggcaaaaaatcgggacggtggtggtaaccaagtaccacgggaccccaaagggaatttcgggtccctttctgccaattttgttagttctttaatggtattttagccaccaccaatatggttgtgtttagtttacctgaagtttagaagtttggttgaaatcggtacgatgtgataaaaaagctgcgtgtgtatgaaaggtttgatgtgatgaaaagttggaggttcgaaaaaaaactttggaactaaacaggacctatatgctacaattatatacttaaacatccattaaacctcctacaaacactctcaagctgtcacatggccttttataaacgctcataaactatcgtgtggtgttctaataaattagaaaaaaaataaaaaaaaattgataaatatctaaccattgatttcttattaaattggtgcatccataagttttaaccattaaatctcttaaaaatgggatttactatagttgtgtcgacagttttttcttctatggttacattcagtactctagctgccgttggatctatgttaaagatctgtgcttccatccgacttttttctcgggaagagtcccgcttgcagctatagcagctaattttgtgctacatacatgcattctaatttagcactaactttcaaatacgaattcctatatcttttttccgatgtactagagcatcaccgacagtatttcaataataaattcctaaagtgagaaaacctatagaagagaaggcctaaaattaatttcctataatcaaaagtgggccttttctactcctcacgcgcgcaccacgtggccagctcctccttcatctcattattttttttccgtgcgcggtcattttttctccttgcacgcacaagagagagattgggaaaaaatcgttctcttgaggtgaggaacgagatatccggagttgagaacctggatcactgggagaggatactaaatagaatggctgcgcgcgttcttttctgtggattgaaaactatttccctccgcacagaaaacagagcgatctattagcacgtgattaactaagtattagctatttttttaaaaaaaatggattaatatgttttttaagtaactttcgtatataaacttttttaaaaaaacacaccatttagcagtttgaaaagcgtgagcgcagaacacgatgtagaggggttgggaacagtgagcaaagaacacagactaaggaagctgttggtcatgctcctcggatttaggaaagttcagtcaaaaattgcatccaacgtaatccctaacctgtctcccaataatactagttcccaactccggatatctcgttccccgctttaagggagcgattttttttttacgaattgctctctcccgtgcgcacggagaaaaaaatcgcgagatgtaggtgtaggggaggagagaaaaactaattttatctgttggtagttaaagggagtgcccacttttcattacaggaattaattttaggctatcttttagagtgagattagttttctcactttctatattctgtttaggagctctgagaaaaaatagttttgagaattgatcattgtcaatctcttggtgatgctcttagcagtacgtacggttgactctaactttcaaataattattgtcaacgcacgctaacatgttgatcaaccgttgatctgtgaaatccaagggctaaaaagctgattattatttttttgccaaaaaatatgtcaacagatttatagatttatagatagtcccaaaaacacaaggtagcctcacccccactgtgggcaagtacgtacgtactctctctatccggccaccctccaaccctcctactctatatcttctcctatttttttaagctaataactatatttacattatacatatcatctcatctatgacggcccctcacatgtttgagttttgcaggccgtcacaatgaattcatctcaaacggcccaaaaaaaagagaccgacaaagatatactcgcatagacatgttagatatgcatagaaatcgagcccgtcacatatgacacctatcggtgatgagctccaacttaaggcccgacaaagataaccgatgatatctttgtgggccctaatagaagcccgtcaccgatgtccatcattggtgacgggctctaacttaaggcccggttgagataactattaggctcatcattgatgacgagcttttgcttaggctcgacaaagataactgaaacccatcactgttgtaagttttttttggccgttatagatatttattacagtacaaatacccgaactacctagtgtaatggttatcccacttctcactattttgatgggagtgtgagcgggccgatttttgtctctgttttccaagaaaatcataaattgcaaatggaattgaaaaatagtagtcaattctcataaatttagtaaatacttacctgcaaaatttatatataatacttttccacttttttcagctcagggatggaccaaagttggatgtatgggaaaaactgtatgacgtcataccaaggagtatagaaatggtgtattggatattattaacgtcgcggaggaggataggaaaacaagaaatagcgattacatgtgttgtacatgtgcagattacaaacatgagaatatatttgatagcagagtggactgtggacgtacacgcttatctgatacaaagaggtttcatggaggactacacatgttgggtgaagcatagagagcaagaatcaggaagtggtgcacaaaatcaagaagatgaagatcatgagcatgaatcaggaagtggtgcacaaaatcaggaagataaagactagggttcactctcactcagatctagatcgaaaatttttctaagctctgccactctctgaaccctagcggcgccgccctctgggagcccgctgccatccccgagcccaacaccgtcgtccaccgagcccggcgccaaccccaagccagcgtcggccgccgtcgacctcctccacaccgtccttgcccccgtccttgccaccaccgcatcgacgtcccccgccgtccccgagcacgcccaccgcctcactcctcctccgctggttagaaatttttgtgaattagtaggatttttaggatatgtttttgaattagtaggattttttttgaattagtgaaatatatttgagatgtttgtgtgtgatggtacttagtgaaattgttgtgaattagtgaattattaggatatgtttgtgaattagtgaattattagtatattttttgaattagtgaattattaggatattttttgaattagtgaatctagggtattttattgatgttaaggtgatttagtgaattattaggatatgtttgtgaattggtgaattattaggatatgtttagtgaattattaggatatttttatatatatgaattagtgaagtattaggatatatttgtgaattagtgaatatatatgtatggatgatggattttagtgtagatagtacgtaggttatcaaattatcacataatacaaggtgcatagggtccgaatttggttttatcgagttagtgcattcacagaactgattaagacaccttcggacccagcgcacctcgtattctgtcatttttttgataattattcatttatgtatggatttagttccttggttatcaaataataacacaatttgaggatcatagtgattttaggatttagtacctaggttatcaaaccatcacaaaatacgaggttctttgggtgccaagttggtttggtcgggttagtgcttggacggaaccgaccacgacaccttggcacccagagcacttcttattctattatttttgataattaaggaactttaataggaaatatgtatgtttagggtattttaggggtttaatgcaaatgtatgaaatttgtgatgtgagttactaatttaattaattttgtgattttgtaagttatttagacgatgcctcagcaaggcgaaccaatattgatgacaactagagggtccacaaggacacggacccctaggatagggaacaaattaaatccctaaggaacggtacaccataatagaggtgaaccacctaggagtgttgataagtcccccaaatgttctgaagaggtacaagttgatatgcggggtcatagcgagggagaccttcatcattttggaggatgacatcaacctagtacccgaagccgagaagaacgctgcttagctaaaattcaaggagagcttcgactatcttgcagccgatgaggataggctcaagagggcggctttcaagaatatgggaaattcttggaaaaactttaagtccaggatggtcagtgagtacgtcctcaacccggctactctggagccatttgggaccttcccgttcatcacacgaactgtgtgggagtagttctaagacaagaagtcgacccccgaatcctgggccataagcgagggttatcgggcactccagggtaggaacttgcacccgcatcggcttggcaccggaggatatgcctgacagtaccctcggcataacacaatttacagcagcgcaccgtatcagaggtggtctctcgaaacaccaggaggacatagttagggggtattggctacatgattgtatactaacaagtgtaaactactgacaactatatattagaagtatatgaacgattcttttttttattcatcctccacttagcctagattatattttggcagagtagttcttagttctttcttctgtgtgtcacccttatcatactcacgaattaattaaccccaacatagattttgatctatacaagtaatatatgaattattagcatagtactctcttatcatatgttccattgggattaaataaatatgataccttggattactcatggatgaaatgctacaatggtatatacgtgcgattgcggattatatctgtgaccataaatttaccaagaatatttcggtgtcattgctttgaattatatttctattaatgttgttaagaaatatcaacagggagttggcccgaggagggaggaagaaaaatagagggacgggaaggggactttgggctgggaagggagaggggggagaattttgggcttaaaaaggcccaaaggagagacagaattattttatatttttctttttataaaactctaaaaattggttatgttgattagaattatttatagtcctatgaaaattgaagcaaaattttagggttcattttaggctatggagaatttaagaaaaatacattcgaacttttcttgttttattgtttgttatattttttaggattttaataaattctattatttattttagagaatgatttataatttgggatgaatttatcatggcacgccaaatctccactgccgcagaggcctcctagcaagttctttgtattttccctttgccttcttcctctttaggtaacattttgattggtgtggtatgtgctcgatggaatctccttatgaggacagagaaaaggagatgagggaatttgtatgtgaaggaaacagttcaaagtcccgtgtcttttattacgatgtgatttcctcttttgtgattgtatccatggacctccgaaaggattgtatcactggtataagcctctttcggcttgactatgtggcatgtccttggactgaaacacaagtgctcagtactagccttgaattgtgctctttcttcttgatgaaacatatacatagaggagagaaggtagggaaaacaagaacaaggatgcctcacacgttctcggacacaagggttccatttcaatgttgttggaagaaggttatggtatgtgttgaccacgacgatagcgatagccatggcgacaataggatcttagtgggagccattgaaggtagggtaaaaatttaagggttaattaaatccatgccactgcaactttgctaaatttaaaaaataccactactattcgtcgtatcggctacatgccactgaaaagttctaaaattagaaccataccactcccgtcggtttttctgtcatcctctctcacgtctatcattggtttctagattttggatgtagtttttatttatatttttatatcacggcgttctacgactactcattgatggccgcgatcgacacggtcgtgctcctcatcatggtcgctgcgctaggtttcctcatggtgctttatgcgaaactgtagatccggaggttggggctcggtggtagtcttgacatgctcaacttcatggcgctcctggcgtggaccgagttcgaccttaactggaacaacttcaccagtgcaatcagagagcagcggggaggcattgtcagcgccgagatttgggtctgagaggagcataagcagagaaagaggagagaatgaggaaagacagaggtagaagatggggacattttcatccaatacatacaaaatactatcttagtggcatcattatagatatgcaaatagtaatagcatattttgaaaccacctaatttctaatggcatataggagtatctaattaacaaaaaaggaaaaggaaaatcacctcactctcccatcccccttctgttccacgacacggcctgcccacacggcacggtaagcccaacccaagatggaagaacccgccgccgccgccgcctttcccgatccgccggaggacccctccccctccccctcctccgcgccttctccggccgccgcggcgcctcctccggggccgagggagctggcggcggcgatggaggcggtggagcgggacgtcgccgccatctccgacagctacgcctccctcttcgcctccctccgcgtcgccctcgccaacgtacgtacgcactcacgcacgcgtaactggactaagctcccgcggcttcttccaccctccacccttcgctcgcttctcccatttctccgcctcgcttcgtttgctgctcgttcgcttcgctcactgatatattgtagcctaaccctcttgccgcaaaattgaattttaaaaaaaaaggtcacctcgacgtcggcggagaacatggagtgcctgggagacgtcgtcggccgcctccaagaatccggtgaggatgtttgcttacgaatctgcaaatttctctcgatttcatcataaaggtaaacgattggggggaaaaa

SEQ ID NO: 32528 - DNA, 10744 bp, Oryza sativa
  unsure (1)..(10744): unsure at all n locations
ttttctctttgtacagttggggtgtcctaatgttaattgtatcgtgggttggttgctttatttttctggataaaaaagaatgattagattcgaccaggtggcgatttttacctttttactctgtccctgcagcactcgaagcttcttcgaaaggaaataagtacatcaattcgtgcttgaggtgatcactttcagctaatcttcgtcatctttccgttttctgctacatctattttttctctatgaatgtagatgggctaattgtagtgattttatagcttattgtatgggtgttccctttcctgtttcatctgtaactgtaaaagcattcatccttgaaactgtggactgtttatatatgaaatagtaattttgctttcagttccttcatacattattttaatgacctatattgcaggttgaatgaggaaatgagaggtctggaaagcctagccatgcaactgtatcctttgttagtttttataaatttgttctcctggatctatgtcatataattaatcaaacaccattttgctgtgcagttttattagttctgaagtatattctgttattcattttgtaagccttaatatttgtaaaagaaagattttacggaagaatgttgattcactagacttggctgtcaatcagttgctccgcctcccctagtcagttgctgttatccagtaggcagtagctaatgcaaggtaactaccactgctatatgatttttggggtcatatgcttttaattcttttttagttttttatatgtgcagtaagtgtttaatgctttcacaaaaagttaacagctagaaatggtttttagattttctgcaatttggtttcaaagcatggacatgctactccacatgtggcctatctgatgatggaccccttgttactacatctcttttataaatgcaccattattagctgttggggaaacacgagctttattaaaaagagataaattaattgttaacagagagtgttcattcatggcctgatggcctcatgaattgactacccgaaatatatatttattatgtatatctgcatactgatagtttatattctggtatgttgtgttatgtactgattcttttataaatcatgtactgcaggaacatgtaatgacattgtttcagcaattatacataataactcgcgctccaagacagcaaatgctataatctgaaatggcacacaccagcaaaggagaagatttaccttgtgtggcaatataaaatactacatccagtgtttcacttcatttcctcttctatatgtgtgcttatgagctccgtatttgtatagtgggttattcaattcaacccatggtgacataatatcattatctgtaaattggctataaagactatcttcatcactttgttctaactccattcaaaagaaagcaataaagatcctttttattgtttgtttgtttgtttgttctactattaccctgtctccgtttagccatcatttgatctatcctatgtgatcacttgattgtgttaacacatatacaatttcttgacgtgttgtttgttcggtcaacttattttaaagtttaaatattctcatatgaataggtctgcactcaatagctacgctagttgcattatgaagggaacttaaagagtgttatcttatcatggacacttattggacgtgcacatagtaccttttcatgctattttttgctcttcatgcttatgtttgtacttaagcagattccatgtgattgcatgatggagccagaaaagatgaaggtctgtgctactctcaaatttgtaaggcttgtatagtgttttatctgctcctaattgctatggttgatttttacatttttattttattcttttacttaacatgacttgagtatgttaaaaaatgtgaatcatagctaccactagtttgcaggcagccttgtaattccatcactattgttgctctccaatatgttggttgatgccatatatttttttggttcttcagatcctaggagggtaaaggtgctgcttcaaatgaagagcacagaatgaatctccagatttttcataggcagtaggtactgattctcatgctcgtaatacattcagatttttatgctcagatttaagcacggctatttatttgaaagagactttatttaagcacggctatttatttgaaagagaatttattcaagcatgagtattaatttttattgaacataggatagattcctcagacgtatcaaattcggtactccttgattgtgccaatgttgattcaattggacaaactactgttgataatgattcttgtaagctactcatagtatgcaatttgaatttcaatatcaagtcaagaaaattatctgttgaactggacttattttatcctctcagatgaagcaacaattacaaatattaatgtatttcccttaatgctatcatacaacaatatactgaaaaacaaaaaataaatacacaattggatattgatctctgaaaatatttatagcaaagaatctgtctttgcaggtagcctcctgaagaagttcacaggtgccgatggaaccttatgacgaaaccgtgggtgcctcatccagaagaaaccaaggcagagtgcaatcacttggaatggtgtcacatacaagataactgcagtaagcaggcaaaacaataggaacatagatgttgcccttggatccctccagctgagcagcgactgcagcctctctccttgagttgcaatgtccccaacaactgtctgtatcctcccagcaacatgccgtagcctgtcatacctcatcctaaccagatctggactctttgatgttgggaatgtatcaaattcttcatcaagctcatctgggtttgtcatatcggcatgagatatccttgtgttcatatgaggtgggaaacgcggccggaaccggtaattccacaatcctatcaagaacatgtagaggaagattgttgggaggataaggtctgggtagaagacaagcatgataaatagcacatgaactaaaactgttgtgactgggtttttccactgacaaacgtcgccaaaccactttcctgcagcaatgaatccggagaagacttgcataagacggaagaagttagccttgcttcgccgcatgctccacaggtgtgagcgggcatctgacatgaactcaacaacttccctgcgaactggtggctccatgcgccctagacgctgtgcgacaagttgcacagcttggtggcggagcatttcctgctgcactattgacagtggttgcgcgtaatgcatcttgggcaagaggggccgagaatatgtgaagagcacattgagaagggatgtggctgtgaacctgatggccaggtggagttctcccattttcttaactcctgatgggtggaggacaagtaatggatacgtgtgtgtgtacaccctcccagtctcaagagttgaaagccgaattcgcactttcccgatgggcttgtccatatggccgggggaactactgtggttgctgtctgcagatatgtggcagttgtcaaataaaccaatggtgagcactgttccatggtcgaagacatcccatgtgtactgttcattgaatctagggttcaagttgtcaacaatagtacgtgtccgcacccatttctgaccatacttggcaacacaatatgcatcgcatgacccccgctcatgcttggtctttgttggattgagcccatttgcacttagaatgccaacttcaagcagaccgattggtggtttccacagctgcttcattgttggccggagatcgctacagtactgtgtggactcatcgagcacatggtaaccaccttcaaggcaaatacgaagttgcacctttgcatagaatttatcttcctttagttggttcagatcaatcagtcctggccttctgagatcaaaccatgctggcagcactggcttatggtcagccctccttggaagccttgcgagaggtatcatagtttcaccaatcacttcatccttgttctgagcaactcgatcctctatttgtatgatcaagtcctcctcgaaaggctctgccgcgacaaacatcatctcctcattccacatgaagtttctggttggtgagcgagctggccttgtcttcagcatttggtggcccagcctcaccttaacaaatacatcaggtatgtggttctccattggaaatatatcctgtgcccaattacattgaccctcacataccacattctgggtacagggtagaccttcccacggatgtagttgtgaagatgggaatcaattggttctgatcctgcgtggatggcacttgggaagcactcatctgcttgagttccataccagacagcgagcatcagctcccctttatccctgtgcccttccttccccacaagtcgataccactctggtgccaatgggctgtcaggagggacccttagtggtacctcatttagatctattgacacccggccaacataatcatcccgaatgaagtccttatccttcacaataacttcaagtgacgttgactgcattacttccctagggaaagcaaacacctcatcccactcaggcctctggttcttctcaaagtgccttgtcttcattttgtagtttccgaggtgcacctcaacataaggatcaagactcccagtgatgtccatgtggggcagatcacgggccttaaccacacgcacaaataggtactgcatcttctcaacaaggtcgtatgcccctgccttttcaccggggatcacccggccgccaataacacgtccgccaccaagtgttgggcttgtttccttcagctggaattctacaggctgctgctgtggaccttgagcatacatcctcatgactggaggtggaggaccttcagctttgttcccgacagcagagtaggttttctgttgctgttgtccgtatgaactttcagggtagtatggctgcgcagtcattggctgcggacggtgctggtgctgttcttttggtaagtgttggaattgcctcacttgatctgctctggtctcctggaaaggatttggaatggcattggcggctacctgctcttgggcagtcgtaggcgtgcttatgaagtcgaactcctgaccaggagcggacactctgactgatggatcatctgtaaggaacaccctgagaccgagctcaccacgagcacgggataagatcgtgcgcttctccagggggtagtgaagaggtgtggcatctgagtggctgacaaaggatgtaccggagatccgaaccttgccaaggcaagtcttggaattgctggcgcggtttgcgtggtacacatacgcctcgaggtctttctcagtgaggcgggatggatcagatatgttgaagtagaactgctcgttccagacagggttgatatccctctctttgatggctgtgcggaacttctggtcatcgaattcgatctcgacataggggttgcatgtgccctgctcttttggtaggaggtcatgagcactggtaacctccaccccaagcttaagattgctcatcatgttctgccactagatcttgtacctctgcagcagattttctttatcctgaaattagaacaagaacatgtatttagaaacctgccattgctgaaaccagagaggtagctggcagcgtaactaccactttgacaaatgttcttggttgcaacaagagatgaaaaaacaaaagaaggttattgcagaagaaagttgtgccagctaaagttggttgggaaagttttgttgggatatcgaatgcccacaagatttactttttcccaaggaatcataagattggtagtaggaatcatcaggttgtttgaagcatatcccgcacagaatgttcaacaagaaaagtgttgacaacaacatgaaaggataaagaagaaaaagtatgtctcctttctgcagatctttgtattcacatcagctggatatcagtttttaactccctgtctggaatttacatctttacagatggaagctatctatcatgataggagtattctgcctcaatttcaaatctttggagggttgctacatacgtgtacgcttgaaatctctattaattacatcctacaagtatctttactacaatagaagtatctttaaaaaattcaattatacccagatgatgacatgttgatgcacacatagtcatcaatcaacatttagactctaaacacatattaaattcaatccacagatagctgcatgcatgcgtataaaatgtgctgaaataataagttacaagtaaaccctcagcagcatttggtagaccagatgtgaggggtagggaaagtgagaggccaccggccaccctcttttctgattgggacatccattgtaaccacataaacaattgatcaaaaatattattataacataacagaaacatcaatttttattaaaacaagaaaataagaagcataagccggtatgaatacgatgcctgtttactattactacagcctaattagcttcctggaaaacgctttgattaacagtgatatgtggtcagatgacataaatgaagaaacaggattctcaggtctgaaaggtagcatttgaattgttcaattaaaagcacaaatgggcatgagctcagaatggagaaaaaaaagtaagagaaactttgatggatggacaccatggagcatggaccatttcttgcacctttattggaaaaggttggcaggtgatggctaagagatgggggagggtgtcaccattggagttaagtgaagtgctccatgatgttgcatccatccatacatacatcagatatcaaaatcatgtttattcatgtgatagtctctattctctaggaagttcaggcacttcattaaatagatggagcaaggaccaaatgaaattaaattggagatctcaacagagaaaataggatctgttttcacatttttgtgcctccttggttgaactttggacggttttataggaactgaaatttcatctcccttcctcaactcagagtaccataaacaaatctgcagccctcatagtaaacaatctaagaattcttcctcccttacctagttacctaactaataactttcatccgttcaacaaaaataactaatacaaatttcaaaacaaaagaggggggtgaagaaaaagccaagacaaacataccaaaacttctctcgggtacaaaaacagaatatgattaaattcacccaaaaacagactaaatcagccacgcagaagcacaagacggactctagaaaagaactaaagcaaatccggaatattcagagcaaagcaaaacatgcagaggtgtcagcagggagggtggtaaccttgagagctacgatagaagccggcagagaagcttctgctccacgtgttcttgatgtcttcttcttcttcttcttcttcttcttcttcttcttctccgttttgattgattcaaagtggagaggaaagagagagagagagagagagaaagagaagcgtacgggactatgggttatctatcctcttcgcggcaacaaggagagaggaggaggaagatgaggacaactggccacacggaggagcagccggagaaaaccccaacgtatggtagggaaatgaaaacggcaggtagctagcgagaggaggaagaagaagacgacgaccccgaagacgtaagagagagatggacagggatagatatagagaggcagatcattaccccagcctatagagcgagaaacacatgcaaatagttgttgcttaattgcgtgttaaggttattaagatattattacactgcttgggaggagctgagccgaaaccagcgtgtgaaaaggggttaatttagaaacagcagtgcctatttaaacaaggattaaatgctctcttaggaggaacccaaacaggattgtgttttgttgtctgtacttgcattgctagtataagggtgaaaacagtagaacatggtcggaaacagtatattattttttatgggaacggtttttggttggtcatgaattttttctatatacatcaacttaactatttagtgacgattacaatatagttctgatagatatgtaaaaaaaaaaatcaaaatttatactttctccgtttcataatgtaagactttctagcattgtctacattcatatagatgttaatgaatctaaatatatatgtgtgtctagattcattaatatttatatcaatgtgagctaatgttttacattatgaaacagatggagtatattggttgaaaatggtaccacttttacgaaaatgatatttcgaacgctcaggaatttcagccaccgtttttgttataaatgaacaatgaaagagatttcgttttaggtaaaattaatcaaggattgttctgttcaaaacttactgttttttaatatgattattagatgtgattaaccaagatttttttatgtaaataatcaaaaggattgggttaacagcgacaggtggaatatacatacacggatcagaagcgtggcgacggatcaacgagaggctgtcatttccgtcgcattccgacgctgacccttcactactgtggctggccactactgttttgtctgtttatttcttggtgtttgcttgcttgattattattccccttttttcctgcttgctttcttgcacactaatacccccatttacttgtggtccttttgtgataattatcacgctgaatcccatcgttttttttaacagtccttacctatcattgcagtgctagtcaaccgtcaatgcactggcggtttttgggggcattatactggcgctgatttttttttatttggttttgttttaacaatataactacctaccccacgatgtaatactgctagtttatagtttagcagattttattaattagtcgtcgtatcatcacatgataattgcagatcagctctcgttttctttcttgactcgacatgcactaaccaaaaaactagtcggggactgcacgcacgtgccggtgcaaccagcctctctttttttcttcccatttagcaccagttaatttgtaagaaaaacgtactctctccgttttcaaaatatttggcactttgactttataataacgtgtttgaccattcgtcttattcaaaaaatttaaataattatttattcttttcatatcacttgattcattgttaaatatactttcatgtacacatatagttttacatatttcacaaatttttttaataagacaaatggtcaaacatatgctaaaaagtcaacggtgtcaaatattttgaaatggagggagtagaatttagaggattttaatctatatatgaaaatttccaaaggaaaggtctttgaaacgattaattaatcctatcattttcttgaaatcctataaaacagataatcctataaaattttagagaaaagttaacaatagctccaacctcttaaaagatatttatgtgagtctatctctctcccttgtctcacgtctttcctgtggtagagtaaattgcattggtggtacacaaacttgttaggatggtgcaatttagtacataaacttataaaatgcccatttcagcacatgaacttgtctagtttgtgcgaacgaggacctaaatatcattgttcggtttttttcatctttttctactatcactatatcatattctattttttattgagaaggtgtatgtctaatagcaaccttcctagatataagtttacatagtatattaatcagcccctgaataataagattagccatgtagtttccttttcgccttcctccgcacgcaccagacaattttatgcaccaaaacgagtattttacaagttcatgcactagattgcacccacttggcaagttaatgtatcggtgatacaatttacatccctgtgatatattcaaaggacattttttttatttttcttgtattttacaatcctttattttgcacatgcattcctatccaaatcatgcaatttttttatattttcttttgtataagagaccacttctcttttcaaaatttatgagcaattgcttagttttgattgactacgattttgttgcttagttttcgtcaagtcaatgagcaccaacaacattttgtcattgacgcgtgtcatgtgggtttgctagtataacaaccatcattattttacaatctcggaaaaaagggcgttttcatgctaatctaggattgatgattatgagctactagtatctatctattgcatcggatccaatagtttttggttccattatactgcacctattaaaatgggtttataatttttacagggataactaaaattaaaattggaaggcatgactgtagaacaaatatactccctccgtattgtaatatatgacgtcgttgattttttatgccattcttaaagaacatttgatgataaatcaagccacaatgaaataaatgataattacataattttttttgataagatgaaagaccaaaagtcgacaaaaaagtcaatagcgttatacactaaaatanggcctcttactttcaaatatattacactataatagaataatggtttaatttattcctttaaaactttcaaatatttttttaaaataattatggaaactaatggttagatttagattctactgctccctctattccaaaatataattacctcttaaatttaaaatttattttaaatatacctacctaatattgccactcttacaagtggtgctaaattatt

SEQ ID NO: 32529 - DNA, 1649 bp, Oryza sativa
accctctctatcgacgggggatacccgtaaaccggatatagagggtattggggtacgttggtacgaggatctatgtaatacgacatcaagcaggcagaaaacaaagattatactggctcaggccccttggtaggtaatagccctaatccaattgatatgggattatatgatggaaaccacatattacaaagggaatagtggaactcgatggtattgacaagatcgtagtcaacttgatccgactagatcctcggcgacttggctccgataagctctggcttcgtaggctgtggtggatgtgttggctctgagattcgatgccttaggtcctcccggggggtcccttttataccataggtcaactggtctccaagtaggactcggagacatcagacccgatacgatacaatgacgacccagttctatccgagtaggactccttacatctgtgaattccgtaatggatttccccaacttatgccgaaaacgtccgcatacgcgcaagcataccatgttgatatgtgacgtatatcaaagggtagagggtataactttcccgtaaccctgacagtagcccccgacttctgcttgaataaactcgtgaaaccgatcgcgacttctgatgtcgaagttgtcgtcgttctcggtgtgatgaccgagagacaagaagtgatcgacaatgccgggtgaagctcaatggtcatgagtgaatttaaattgaagtccgagaaactgccgcgcgtaacggacccagaaatttccggcggccatctctcccctttccttggaattcgcaccgtcaaaggtgcgtctatttaagggagttttggttctcgattcacaggtctgagcagcgaagccgtggagcgctgtgtcagccagatgatgatcagtggcccgacaatggcaagaacgtccctgttcccctttgcgagaagggggcagccgaacgcgaagctaccatcaatgtaagtgtactcgacagctcttttgcacttttttcccaagatcgcatcgtgacttcataaagcgtaggatctctctctgactgacatcatcggaccgctcgtggatcacctggcggcggcgtcactgaaggagaacatcgccaaggaggtgtccgatgttgccgccgctgctgccacaacgagtggcggcaacgttccgaagagggggaggaaattctcctccgtgatcggaaatcgtcggaagacacccactccctcgataagcttcctggtccttcatcgcgtgatcggcaaacttccaacttacatcatacccgttatgctccaggcctcagacgcgtctcccccgcctccgcgacagcggcgggttgtgatgcttggcgagaagtaagcggatgaatttgaggttttgtcactttgccaaactcatttagcctgtctcaattgcaacctttcgcagagcggcgcaggcaaaggcggcgcaagacgggtctggaggaacctccagcgcgtctcctgctgtggcctcgacagacgtcgtggccgtgcccaggagctgcgaagcgacgcctagtggaccggccagtgatcttgcggctggtcggggtccgccggctgccgtcctcacctgggaggagctccaggtcgagatggggcgcctcctcggggctggtgctcgcg

SEQ ID NO: 32530 - DNA, 12291 bp, Oryza sativa
  unsure (1)..(12291): unsure at all n locations
gctttgtaaaacttttattggtcccaaccgccctagtgtgtgcggtcattgccttagctttctttagcattttgatcttgagtgctttgttgtcgtttgtagagatgttgatgtcgaggatgtccagcagcgtgggcagcctgagttgccagtggtcgttccgttacttacgtccgagccaaatgtgccggagggcgatgtagatcgaagttcgcctgtggaaatgagcatggcgacgactcccttaggttggttgtctttgttatcatttccttttcccttccgtctggatcgacttgatttgttgtgctctcgggagagaagagcagcttgacttagtcgtttccatgctgagcaaatcccgagagtgcgcttgctgaccaggattgtcgcatccagtattgaaggacgaagtttgaggtcgcgggactcgagaggactatgctggaagtgagaaaggaccaggccatggagacactccggggtcgtgaggtgtggttcaactcgtatctgaagagttgttgcacatccatgtcgagagtctgtagagagctccgagtaccccgtggggatcccgagggatcggcagccggatacatctcgtggctgaatggagcctgcgcctagctcgaaggcatcggtcaacgtctcgacgaggccttgaagcaggagtgtcgtcgctcaagccgatatgctgaggggcacgtgttggcctgcatacgagatcatcatccgcagctgcaccttgagttcctccgcgaagggttttcacgttctcggaggaaccctgcggagatagatggcctggcgaagttgatggcgccgctagtggagaaggtcttccagtcgatggactggcgttggccttcctggtagtctctgtgttctatcacaaatgtcttaggaaaaagtgtaatatagttttggactttgatggaattgtaagaaatactagtggaatagaaaagaaatctatctaactaagctttcttactctggatgtagtgtgtatgagtgtcttctcacttcgcgactttgatcagtcgtttgagttatacactctccctagcccccagccttgtcatcggagaattcttctcggaagataaggctcttggacctttgacctgcctcggttgaacaagcactgatcctagccctcagtcatgaagttggaaagtttatttccgattacacggcttggttaatacgcatggcgagaactcttacacgactagatcttacatggtctttcatctctacaggatccgacaaggccttatcggctctgggcgtccccagccgaagttcccttaggttcctcggaggccttgtcaagatggcgtaaagggacatgaggataggtttcaatgctaggtgtcatctaggtacgggatcataggaaaggaacactttgattgtggtcttgacctgaaaataggctttattgaagctgtaagatgtcttacaagtatggatactattaacttatacatagaatttacgtaattgatcaatgttccaggaatttgccaactcgcgaccatcgccgtctgcaattttgaatgcgcctggccgcagaacttgtgtgatcgtgtacggtccttcccatttgggtgagagcttgtttcgccctgcttggctttgaacccgtcggaagatgtagtcgccgattgaaagcgtgcgtgctcggatgcgcttctcgtggtaacggcgaagggcctgttggtagtcggttgcttgaatggcaactcgttcgcgatgttcctcgagtagattcacatcgtcgtttcgctgctcctcctgatcctcatcggaatacttctgtacttgtgtactttgatgtcgtagctcggtggggagcatggcctctgagccgtacacgaggaagaagggtgtctccttgttagacgttgtcggtgtggtacgcgcgacccatagtactgatggaagttcttcgacccacttcttgtcatgtgacatgagcctgtcgtagacgcgtgtcttgattccttgtagtactatgccgtttgccctctcgacttatccattgctctgaggttgagaaaccgaggcgaaacagatcttgactcccagcctgatgcagtaatcttggaaatcggcattgatgaactaggagccgttgtccgttatgatacggtggggcaatccgaatctgcagaatatccctttgatgaatttgatggcgttgttggccttgatttcccctgtgggtgtcacttcaatccacttagtgaatttatcgattgccacgaataggaacttgtagccgccctgtcctcgtgggaatggcccgagtatatctagcccccagcacgagaacggccaagtaagagggatagttcggggtgcttgcgctagcagttttgtgtgtttactgtggaattgacaggcttaacaccgctgaaccatgttgcaggcgtctttgagggcggttggccagaaaaacccttgtcggaaagcttttccgactaatgtccgaccggcagcatgtgacccacagatcccttcatgtatgtcgaggaggaggtgtctgccgtcgtcggacgagacgcatgttaggagtaccccgtttggtgccttcttgtatagatcgttgccgatcatacagtaggacttttgctttacgggatattttcttggcttctgcgtcgtcttcgggcaactcttcgctgcttatgaatttaatgagtggggtgcgccagtcgtccgtggtctcaatatcggcaacggcgcgctctgcctctgtagcccaagagctggtgtcaggggcgaccgggctatctttgccgcttgcctctttcactgatggcgtcgtcaggacgtctagaaaggtgccaggttcaagtggttctcatctggacgcacgtcgtgctagatcatccggttcgatgttgtctttgcggtatacatgtcagacctcgatcccatcgaaccttttttccagcttcctgacttctgcgagatacttggataactcggggctagagcacttgtaatctttatgcacctggttcgcgactagttcggaatcccctttcacgatcagttgcctgactctgagtgcagccgcaactctgatcctggcgagtagtccttcgtattcggctgtgttattggttgccctgaagttgaggtgaattgcatgcttgaattgatctcccgaaagtgatgtcaagatgaatcctgcccctgctccctggtgttgatgaaaaaaatcgaacacaccggcctgggagatctgcttagctccagtgcaggtccagagattgatgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggctatatgtccaatgtagataacgatataaaggcaatcggctgatgataataaaatataacaataatatagtccagtagaaaccaatcggcaaataatgatatgacaaataagcattgatccgaaggttaaagcacacatcggctggaggtccgatgtcatgaaatccacaagattagattaaacagtgaaacctttgttgccatcggctaaatccaacttatatatatatgcaatccttatgagccgatgcaacgtccagataactcaccggctgaaaccccgatgaaacccttattagcagtaaaaaagcaggctagagattatggttctaagcacgacttagtagatcaaacttaactgatgcagcactaagtatgaaaagaaacataatatctagacaatcaagccgttgactttgttttcagggtggtagatgtctaagctaatctaatttagcaacacgatttagccgatacctgcagaaaccctaaaacgagaagcagccattagagctaaattgatatgctaagactagattaacagagacatatgataaataggtaggcaaatatatcatccaaaccagagcaatccaagaggttgaatgtactcatgcagccttgaacgacgccaacgtagacgatacaattgcctggaccaacggaacattggacttaccccttcaccggagatcgaacaccgatgcagccccgcgtcgggtgccaagtcccgctggacgataaaataaagtagaaaaggtaaaaggtggcgatgcgccgaattgtattgatcgtgaggataaattacataaaccccgggtgtacatatttatacccatgggttgatacaagtccttgtcggacaagaaagaaactttactaaagataaaaggaaaagataaagtccttataggacactaaacacactttcctgaagataaaaggaaactaacgaactattcctaattaatagataacttgccatgccgcattctctttgaactcagtctcttctggataagcttcctttagtagatcaatttccttaaccgaatatagcaagaatccgacaaccgacgacttgacaactctcatcggctaatctcaggacatcgaagccgatgctgactctaagccgatgactactccgggcttgccaaattccactgttaacacctggctgttgagtgcgcccgtcaaacgccattgtccacgtttcattgtcgatttggttgtctgacctattatcaggcatggtccaatcggctacaaaatcggcgagaacctgggacttgatggctgttcatggcacgaagtggatatcaaattgacttagctcgactacccattttgcaatgcggccgacaacgtctttgttcctcacgacttcgtcgagagggaaggaggagacaactgtgaccctgtgggcttggaagtagtggcgtagttttcttgatgtcatgattactacgtagagcagtttttggatctatggatatcttgtctttgcgtcgtggagagcttcgctgacatagtagactggtcgttgcaccttctctctcgacaataatgacagtgcaaacggaatatggcgtggcggcaatatagagaaataattcttcattaggttgagggcaataagtacaggtggatttgataggtagcgcttgagtgcaatgaatgccttttcggcctcttgtgtccatacaaatttgtcttgctttttcagcagagcgaagaaaggttgtcctcgttctcccatcccagcgacgaacctacttagtgccgccatgcatccagttagcctctgtacttccttgagtcttgtaggcgacttcatgttctcgattgccttgatcttctcgggatttgcttctattcctctaccagagacgaggaagccgagtagcttgcccgatggtactccgaacgtgcacttcactggattgagcatgaggcgatatcgtcggaggttgtcgatcgtttcccacagatcgtcaatctgagtcgcttgtcttggtcttgataacaatgtcgtcgacgtaggcctcgacattgtttctgagttggttgctaagtgcgccctggaccgtgcgctggaaagtgtttcctgcggttattagtccgaacggcatcttaacgtagcagaataccccgaacggcatgatgaatgctgtcttctcctcgtcctctctcgccatgctgatttggtggtagccggagtaagcgtcgaggaagctcaacaactcacagccggatgttgagtccaccagttggtctattcgaggaagagggaagtgatccttgggacacgccttgttgaggtcggtgaaatcgacacaaattctccatttcccgttggccatccacaccatgactgggttggctagccactctggatgaagtacctctatgatgaaaccagctttgagaagcttgtcgagctcttctcgtatggcttgtttttgatctggtgcaaatctccgcagtttttgctttacttgcttggcattgggtcgcaccatgagtttgtgctcaatcacctccctgggtacccccggcatgtcggacggctgccaagcgaacacgtcagcattgtcgccgaggaaggtgatgagcgcgagttcctatttctcgtctagtgatgccccgatcttgacggttttgtcggggttggcgctggagagtggaacgatcttgattgcgccgtccggcttcagcgtcttgtttgttttgctcactttcttgggtggctcagctatggcgggtgggcttggcgtgtgctcgaccatgtcgaggctccgcttgtcgcattgtactgccagcttagcgttcccttgaatagtgattgttcccttcggtcccgacatcttgagcacttgatacgcgtagtgagacgcggccatgaacttcgcgagtgcagctctcccaatgatggcattgtatgctgtatcgaattcagcggcatcaaaggtgatctgttctgttcggaagttgtttgcttggccgaaagtcacaggcaacgtaattttgcccaatggtttggacgatgactgaggagtgattccatggaagggttgatcggtgggtgtcaactcgcttcgtgggatccccatcgcgtccaaggtgctggcgaagaggaggtttattaggctgtcgccgtcgatcagaactcgtgctaccttgatattccgaatagtgggttcgaccacgatcagatattgccctgggatgacagcagtcttggggtggtcctcttctgagaattctatcttctgctcggaccacttcatgttgggcgcagccccctgccatgtcaaatagacttcacgttccactttcttgtattctcgctttgaggagtatgccgtggaacctccgaagatgtgtgagacatgaatgtcggaatctagttatgctgagtccgattcctgagtaggcgccttagcgtccttctcaaccacatgtactcgcttgcctttttccgatgccatgtgttttgcgagtgactttttgaagacgaggcaatcttctagagagtgtctgtccgtcttgtgtatatggcaccatgctttcttcatgtcgctgccttgtgggtctaggcacttgggagggtccgcgtattctgttgcgaaaacttccgattgagctttcctcttcccactcttgcgatttttcttcttgctcgactcaggtgcgtccttggctggtttcttctctcctccggtcttcggtttgtcgttcttgcgtctcagtgcgtcatccgcatgagcgcatcgatcgacaatttcgaataatctccgagtagtcgtgatgcgcctcattgccaactcctgagtagtatagcgatctctgacatcggatttgaaagcgcgaattatagaagcattggtgatctcggggattatgtttctgcactcgttaaagcgccgaacataatccctcaagtattcgcccgggttctgtgtcaacgcatgtaggtcgtcttcgatcgcgtggcgcttgtaagttccttggaagttggctatgaattgctgccacaggtctgcccacgaagagatcgagtaggggggagatgcatcagccatgaatgtgcagagcctttcaatgcggttggcaagtaattcgccaatgcgttgtcgtccgctccggcagcgtagagtaccatggagtaaacctgaaggaactcttccgggtcggtgctcccatcgtatttctctattgctccaggtcgaaatctttcaggccatcggacatcccgaagtgaacgaccgaaagctctacacccagtgctgggggcagtgggttgtcggcgatcatacgttcttcgtggatgtctatctgatgatgaagatgacgaggatgatgatgatgacgatgagtcgcttggttccggcgtgcgattacgaggacgtcgaccgggttctcgagaatcctgtcgtcgtctcccgttgttgtctcggcgccgatctccatcatcgtcgtcattatggcgatttcctcgaccagtatcgcctggctttttttcgntcacgatcatcgggatcgtggcggttgtggcagttatcacggtctcggtcttcgctcgaacggcctcctcgttcttcgttatcgcgacaccgtgaagagacgcgatgtcgggaacggttctcgttatctcgtgtgcgtcgcgcctctcaacggccattcaggtgatcgcggagatcgccaatgctgcgaggtggaggggtggctcgatgaggcgattcccgctgttcagggttttcaccattagcatcgccagttggtggctgttccgggtgcgctacagcagcggcctcttcgaacgcgttgctgaggttggtcactgattcccgtaatcgttctgtccaacgtgcgagatcgtcgttcagaacgggatcgtagggggtttccctcagtattgcgttgacggctctgatatgctgggccggagtagtcacttgattctccgcttccgcattggtgcgcgctgacgcgccgacatcgtcgatagccaatacctcacgcggcgtgctcgttgtcgatgatccatagtcttcgaggaggtgcaagactgatggttcgtggggatcgatgtcgattaccccaacaaatcgatccgaaattggcgtcgctccttgttccttgtctttatccctgatggggatgtgtgactgctggaccttaggagatggcgccttcatggcgctgagaaagaccttgcagctcgaaaggtcgtgattctttgtcttgtgaataggacaatagacatcacgagttggagaggtacgctgaattccatgctctttgcaggcacgaatttcagcatggacgttgagaaagacccagcaggcttgcagggtgtttttcctggttttgtggataggacaccaggaccttgtcaccttggaagtaatcctcgtcggcttgtgattcctgtcggaaagacaaggcttggccgcactaggatccttcttgggctcggatgtcgtcgacgctccgatctccgcttcggcgggaggatccttcgacatggagtcgccccgggttgtagccacaacgttctcgtttccggccattggcggaccagctgagatcggcatagtggtataaaccggaaagacaatttcgccgacttgagtccacaccagtgttgttgaagtaggaactccttggttgaggttggtgttgacactgttgtcaacgaagctggatgtcatagtagtagaaccttgagcaccaagtccccctacctggcgcaccactgtcgacaggggatacccgtagaccggatatagaggttattagggtacgctggtacgaggatctacgtaatacgacatcaagcaggtagaaaacaaagattatactggttcaggccccttggtaggtaatagccctaatccaattgatatgggattatatgatggaaaccacatattacaaagggaatagtggaactcgatggtatcgacaagatcgtagtcgagttgatccgactagatccccggcgacttggctccgataagctccggcttcgtaggctgtggtggatgtgttgactctgagatttgatgccttaggtcctcccggggggtcccttttataccataggtcaactggtctccagtaggactcggagacatcagacccgatacgatacaatgacgacccagttctatccgagtaggactccttacatctatgaactccgtaatggatttccccaacttatgccgaaaacgtccacatacgcgcaagcataccatgtcgatatgtgatgtatatcaaagggtagagggtatacctttcccgtaaccctgacactctcgacgagaagtaatactctgctcttatttaaggattggaatctaccgggtgttgtattgatttgacgatcttggtgttggttgtgcccttgagaggcctcatgccctctttatataggtcgaagcgcaagattacatataaaaacctaacctacggcatctactttacaatattgtcgaaataagactttaagacgtttccttaataccttaatcataatccgttacatattctagagatataacctatcctctacaaccagtcggataaaccagccatgtggatataaggtactcataatctccacaaatacaataaccatttaaagctttgttcaaatcaacagttagcttgagtctttcagttgcatgtaaaacggagtgagtgattagtacaaaattaattaattaagtattaactattataaacttaaaaatgtatttacttgatataaaaagtctcttgtaaaatacagatcatttagcagtaaaaaagtgtgcttgataaatgcaattggacgcaacctaaagtatttatagaactttttacgattaagataaatggttaaactttatgtatttgtactccaacgccaagtatttgtgcactgcatcagttagtgcacaacctagctagttcttcaaaacaattattcaagcacgcatatataatgcatggctaatgatccaagtatgtagattaaataagagacatgagaaggtagctactccgtgcacatctttggtggaaaaactagcctgactagggtaggggatcaaagagatgataattaatttactatataatgaggtactagatgacatggaaatggaataagataggcagatatgttccccgtttataatgtccttcctcgatcggaactgctaacatccccgtttagtataaggggatgtttagttcatactacatctttggtcccgttcgattctgtaactgggcttggatgaaaatgaagattttcatgtcacacttttcaaattgttaaacggtatgtttcgtgcgaaaattttctatataaaagttgttctaaaacatcagattaattaatttttcaaacttgtaataattaaaacttaattaatcacacgttattaccacctcgttttatatgaaacacttcatcttcaggagattcagacaccatagggatgttagccgcttcttaggcaagtttgaaaaaaaaaagttttgaagtcatcaactcgtaggattgtgcggttgaaaaattaatgtgcctagccatgatcacaaatcatcaaccaaactcttcctaagtaacgtgtctaaactttatttgacaaatttaaggcattcaattaaacactccctaagtattttttttcagccaaaagttaatagatattttcatcttaggagtgtttggctagtgaaaaaggcaaaaataaacatttagctaacccataaaaaacatagcttaacatgnaaatgcatattttagcatcaatccaaattaaactactctctccgttccaaatgtagcaatctaaaactaaattagattttttgcactaagaatctaaacacatgttcctcaatccattttcacgctagtatcctctagctatattttataacaaagtgagcgtttaacttacacacaccaccaaaattttggtacaatatcaaaccaagccgatccttagaccagcaatctaactatgatgaacgtttacttacactacatgaagcaccatctacgtaccacacatcacatataatagctttctcagtttctctgggtaaatatagttatggggtgtttaaattcaggggtgtaaagtcttggcgtgttacatcgggtattatataggggtgtggtaaggagtgttcgggcactaataaaaaaactaattacagaatccgtccgtaaattgctagacgaatttattaagcctaattaatctgtcattagtaaatgtttactatagcaccacattgtcaaatcatagagcaattagtcttaaaagattcgtctcacaaattaatcgcaatctatgcaattagttatttttgagcctatatttaatacttcatgtaggtgttcaaacgttcgatgttacatgatgtaaaattttggggtgggatttaaacatggcctaaatatagcttttacgacgcttacgacatggttacattttgcggtaatattctgctaagaccatgagagtgtgtctccgcaccttttttttttagggtaaatttgcttgatttgatatcatactttcacaaccatgagaagagcatagtaatccggtggtaagagagctaccagtactattgactgccagcgtttgagtccccccgtactgattttcacaccatttcttctctcttcgctgttacgtaatcgaatttttcggacaaaatccccaataaattataagcggatcataactacttctatatgcaaaaatcacttcccagatcagatgtcggtctgctataataggttattctcg

SEQ ID NO: 32531 - DNA, 24641 bp, Oryza sativa
tctccactgcatctttcctctcccactcattttattcactccacaccttttcccacttctcttctgcattcctctcctcatctcttccccttccgtatccccattctcttctctggcggcaagcgggcggcgacggatctaacaccgctgccctcggccccaagaaaggcaatgaagatggtgggcagcgacggtggagttcgagggtggctgatccgtcgtagccatcctcggccctagagaggcgatgaagatgttgggcagcgacgtcggagctggaggatggcaaatctggcgctgctgcccctaggcctagggaggggcgatgaagacggcaggtggcgacggtggagctcgagagcggcaaatctggcgccaccaccctcaaccccaggaggggcgacgacgagcccgagtgcaacagaagctagggtttcagcggaattttctttttggtattctttaaccaaaattatttttacagtcggtcggcttaagcgttcgtatgcgaaaataccgaatttaatttgcatgcggttgctatacccgcatataaaattatcgattttcgcagacacctaggtgcaagtgggccacccatgcacctatgaaaattgatctttttttagaaacacattacaaatgcaagcacccaacacccacacagtcatctctatgaacgtgcacacacacattacctctataagcatatccgaaagactataccggcatatctatcgattctatagttatatgcgaaaatcttttatgtagtagtgcttataatcgattctactatcagtatcccatattatcatctttcaaattaaaatggagtatttcacaactgtagcaaccgtattatttcacaccacacgcgttcggtgtgccgcgtactaaaactcttttttcagagatcacgcggcattattgatcgttctctcactggtttaatttcgtcgtaattgcgacatgacaggagtatttgtcagcaactagtattgaaaaagaagagcgcctaaaagaatctgtggcgagcgctgagtgctgcaaaaacatcatcatgagcaatctccatctaaagcgcaaacaaaccacaaattaatcactttttaaaaaaataggatagaggggttatttgagaggtcaagaatccgaaaaactaggtttctcaaattctaggttctaatttgttttatttgttttatggattctaatttttaaagtttactccatccgtcccaaaacagacaaactctagttatttatctggatatacatcatgtccagttacgtagctagagttttttttttttaagacgaaggggtagtgataattttaactgtttaaaaaggtttctgacagctagaaattctgaaagaaggatagaggtgtcagaatgttccaaacagggcaaaaatagaatatgcactgagccgaggggaaaatcagataaattaagagaaaaatagaatatgcactaagccgagggggaaatcagataaattacgggctcccacgtggacgttccgtaaacgacaattcgcgtgcggcactgcggcccaccaccacgtcagatacgtactgatattttcaagcggagtagagtatacgcatgatgctaaaatctattcagtatacgctttctatttttttaaaagagttaaacagtacaacatatacactcaaaacacacgcacactaacccctataaacgtatgcacgcaaatcctacccctatgagcatcttcgaagactgggccgacaaatcctcgagattgataaagtcatcacagacgcctcgttatcgacggatccatctcctaccactgaaaccacaaagctgttaaatcctaaaaaattcgctcccatggagagtcgaacccaggacctaaggggaaaatttgctcccatgagtatacgctttttatttcatcttatttagataccctttcataagtccgatcagttaatgatgattgaggtacaaacacgtgaatattatatagataaacaagatcacttgcgagaaaaagagaaccacatgctatctattactacctccatcctagaatataagcatttttagagttgggcacggttattaagaaagtaggtagaagtgaatgatggagggtggtgattggttgagtagtggaggtaagttgaaaaagtgaatggtggaaggttataattcgttgggaaaagaatgttggtggagaagttatattttaggataaatcttgaatgctaaaaagttattatattttgggacggagggagtagttgtcatgttgattcacgtgcatgttagagcaggtacaatagtaagctataagccagctataaccacatatccagaagaaaagagaagagatagaagaaagcgggctacagatttgtagtcagctgcagtacggactctaagatgttatgtgtgtatgagaggtgggaccaggtattaatggtatagcatgattttatagtcaactattgtatgaatgagctattagattaactatagacgatttagagtaaatatttagctatcctattaaacttgctcttacgaggctaacatatcgttacactagcacattttccttttatagaatctttgatgacttatattttttttatagacagtatattatttgtaagattcgtttgaactgtcctatttcacttaaaatatgtaacaaataagtctaatattgaatatattcaaattaatttttttttctgaactgttctcgctggatagttaaagagttacttcctcagtgtcgttactttcaacgccgtgataagttaattctctagcaatacagttatttctaataccttaaatagttatttatgttttatgtttcttagttactttcctctagaagtgtatttacttataatattatgaagagttccgtctatttttcaaaaagttaatttcatccagtagcgtagttacttttaatataatgaaggattactttttatataacgtaagatttgattttttctaaaataatacagtgattactttaaataaagttggacatcttctctacactttagttgtaagtttattccacatagttttgtattccaactcagtcgtaatgtaattacttctaatgctatagagagttacttctattgcatagctaggttacttctacaatttaaataaattacttttaagttaataaaatgtttgaatatatttaacattgatcttgttttatctcatattttaagtggagtacaatgaagcaaatagattttaaaaataatatataatttaagagatactccctccgttctaaaatataaggcacaaccacccttaactcaaagaccaagaaacaattattatcatctcctagtttgaatcactctaataaatataatgcatacatctaatagaattagagatcttgaggatggaggatttaaaaaagtaataatttaatggagaaaaggtcctaattaattatatgcatgcatgtatatcttatattatgaaacatcttaaaaaaaatagttgtgccttatattatggaacggagagagtacaagttatcaaataggtaagaaaaaaaatacaatttagctaaggagatttatacgtggaggaagtgatcgcggctttaatcaaaccaacgaccgatcgttgtgtagtcgtgttcgaagcagcatcagctatctttcatatacggtacaaatttaagccgccttttgaaggctaaagccctgcaaaaatcgttttgtatagtgtcagtcggatatcttgggcccattgggccacgtctgcgcgagggcgaccggccgcgtcagcgtgagtcggctgacgctgacgtgtccgcacgcctgattcttggtctaactcatgtccggtgattaaggttaatctctagatatatcatctgtttacgtaatatccttcattcacagatataaaaaatattacaaattaggatgggttggatttgactctttctacgataacgaacctgaatataatcagtttaggacttggtcaaatcctattatagattgtaatttttggagaaaaaaaaagtaagtactccctacgtttctaaatcttttaacaccgttgacttttttaaatatgtttaaccgttcattttattaaaaaaatttaagtaattattaatttttttcttataatttgtttcattgttaaatatacttatatgcatacatataattttacatatttcacaaaagtttttaataataagatgaatggtcaaacataaacttaaaaagtcaatggtatcaaatatttagaaacggagggagtacttgttttctcaactacctattttgtaaatcagtagtaatatattcatatgatataactagccatgcctatataagtagggatatgttataagcaaattagggatacaattaattttagatccggtggttacataagtaagctacgcgagtgagcgcagtgggaagatgggaaagtaggactgctaatatatataatatatattcttcagccgttggtcggctttatccatttcgcggaagacaaaattaacaagtccatgatgtcccgtagttaattatttatttacagctttcacatacgtacaactataaataccttcccacaacaacaataatataaggggcaattttatttttacccctacttttgatcttcaatgttgattttaccctgtttttaagggtttttatttttgcccctttttttttttaaatgaaagcaaactctacccctactttagatggacaagttgacggcgttaaatctttggcgaaaagacaatcatacccttatttgatattgcatatttgtctgaatgtttatttaataactgtgtatttgccccctttttacatgcagcttgtattttgataaacttttacaaatatgataattttgatagaatattaaaattttgatataatttttccacaaatttggtaaaatttgggtattttgaagaaaaaaagacagaatttgggcacaatttcggcatggtttttacacagctaacaaaatacatgtagcaatcatcacaaaatcacacaaaatcaagcaaatccaaatcatgaagccaagcaaatacagtccagtagcatgtcgctcctccctatcgcctgtttacagccgagccaggttgatgctgcttgccgcagcgtgcacctccgtcgtgccctgcttgccaacagcttgcagtgcccctgataactgctcgctgcgcgcggcctgctgcttggcgtgctcgccgccaccgcttggccgggccacctgccgtcgcctcctctctgcgtcgagccgtcgccgccttcccgcattaagccgccgatgcctaaccgagacgccgccgtcgcttgctcctccgtcaagccgctaccgtctggacaagagcccaccttcgtcttgtcccctcgtcgagccgccgtcgcctggcctgccttgatacgcgccgccttctgctcgccaccataggtgggattggggaaggcaagaaggacggctttggttatggctcaccaggggtacaaaggtccatcaacgaattaaaaaatcactatttctttttctctctacgttttagctccataatcctaggtcggctaacttccgttaaaaatagggataaacgtctatttcatttcagaaaagcaggggcaaaaacgaaaaccacaaaaaacaggggcaaaatcaatatttaaacatgaaagtgagggtaaaaacgaaattatcccataatataaagtaccttagattaaaagaaactacaaaatattatcttttcttctttttgtttttgaaaagactatatatcgtcacgatggtcgagttagagcatcatcacaacaccaacatgtctagtcggtcatcaacagatcgaacagaacgtccttatcagtacactattgagagagaaaagcacgtttcggcacatcgatcattcagcgtagacccctgagaaaggataaacgtgtggcatcagatcacatattgcaccgacgatcatcacacacctaatctctccatccccaactaacagaaatatactggagtagtatctattaatttttcaagtgaattaattagtccgttaccgatttgtttggtgagtagtgatttaatttagaagtacgtacacgcgatcgatctcggacatttcagctacaagtgcgtgccagcggtggtgtgaatataatgaaattagccgctccagccgatatatgtagacgtgtactaacacaaatactctatccgtcttataatataagtgattttaagtttttacttacactatttgatcactcgtgttattcaaaatattataaaattattcttttacttactttattatccaaagtactttaagcacaattttttaatttttatatttacataaatttttttgaataagacgatttatattatgggacggaggtacatgctagcactgggagagaaatggcgtgtcgtcctcgtacgcagacaaagccatccccactagcttactgtacgtacaggttcactgagaaccagtacatgtacgccgcgcgccattaatttttaaagagtaaggtatacgatcggtgaattttttttgaaaataatattattttaatggaaaatcacaaaactttaggtcggctagacgaaatcacaagtttagcgccctgtcgaactgggacagggtactgtcgaactgccctagttcgacaggctagttgtccaagaaaaaaaataaaaaagtacttgctacaatgcccgataaggacgtatcgaacagggggagttcgatagggcgcgtggcatggacgtatcgaacagcgggagttcgataggcagcgtcgctacagtgtcgctacagtgtcgctacgtctttgatagagaaaagactggactagcatttttgaatgatgcaacaacgcaatatatgatgttgttgttgtttctttgcttccaagtcgtaggccggtctcctcagtacgtgtggatagatatgccacaatgaagctttttggttaagacgtcacaacgaagctaacatcggtatctctgggtaggtttagcttgaaaacgagcccgttgcagtcttatggaatgaaacaaatgaaagaagaaaaaataatgtgcacaaggaaggcaagcccagctataaaggtgctggtcacctcacattcatatgcctcagcccaagtgtttctagcggtcgagcccgatcagatgcaacggcaaactttattgaggcccaagttcaagttagcaaaatggcttcttttaactttgttaagttttgaagcacaacgtaggcgagtagagataaaaatagagcggatagcagagaggatagcttccatccgctctaaagaaaaacaaatacgaatataactcggatatgaaaatgaatgcgggtaagtttttgctagatgcaaatatgtaatcatggtattcgacggaaacaaataatacgaatatccagtgaatagtgttatttggacatcgccaaatgcatgaaacatgtcccacatctttttaactcaccttcgatatactccctccatctcataaaaaaaccaaggatgagatgtgacacatctagttctatccagattcgtagtattaggatatgtcgcatctcatcctaggtttttttttatgggacggggtatatctttagagtttaataatagcacaccccactagcactagctcgcactattaattgagagaatatactctttgtctttgagtttatcttagttcaacgatttaccatagacattatcttttctataatataccggtaagtttatcaattctcctacaatataccattatccattgagttgggcatggttttaaaaataacactaacacacttatagatataaaaggttaacaattgttttatcctgtcataagtctcaaaaaaaattatgaatttttttagcctctttacacaatgtatatgttcaagatttttgtatttctactttttataaaatataatttatcagttatatgttatatagaatatgttttgtgttgttgtttttaatgtaaatcatatttcttaggctacacaaaaatatttttatgctattatttttgcataactaatttctctctcatatactccctccatctacttttgatgtgtatatttccaaatctgaaaattttacttttgataggcatatttcaatcaacaacctatcctcttaatgaatttttcggatttaatgcgtgactctctattcttccacacaagattggctacatgggcatcgagaaatataaatattaatgaatcgcctgtttacgggaaataactagtagcatgtttaaatggataataagtagaattacttatccttagtcattgtgccaagatgcaatatgactatcaaaagtagatggagggagtaccaaacaaaaataactatgttttttaaaaaatagaaataccagaaaaaacatgaaacttatatacacacttgagtaaggaggctaaaaacttcatatttttaaaaacttctaatgggataaatcatttttttaactttgtatgacttcaagggtatttttagtatttccaaaaaactgtcgacgggtgatacccgtagaccggatatagagggtattggggtacgttggtacaagtatctacgtaatacgacatcaagcaggcaaaggacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaggtcttccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatattcgccagccgttgccgcctcaaatccgccacgtccggccacaatttctccctcccgagccaatataaaccctccccgtgctctcctcttccatttccccctctttcccgagcccggcactctctccctcgctctccccacgccgctcccgcgcaccgccactttctggcgagctccggccgcccgccaccgctgctccacccaccgccgcacaaatccgccaccaccgtcggcttcgcggcgccgtgctgcagcccggcccctactccatttcccctctccgcctccggaacatcgccgcctcgcgcaacacctctctccgccgccgccgtcacctccagccacgcgccatcgccactcccgccgccactgtgctgcgccgcctccactgccggcttcaccaccgcgcgggcaagctcggtctccgctccgtttccctgttccttcaccggaactccatcccctctgtcaacccaagccaccaccacctcgccgccgccgcgagcgacctccaacctcacgctctccttcgtcggcttcgcagcaatgatagggagcccgacatcccctcatccaagctctccgtcaccggaaatcctttccccgctgtgagaggtgagctccttccctcgtcgccggcttccggccgagttttcccgccgccttgcgcctcctccctattccctaactttccctccatgttccccagatccttccgatcgccgtccgccggttcccgctcgcggaacaccgctggaccgctattgccgtgccaccccgaggagcgccgccgccatctcgcctcccttcggtgccgttccgcttggtgagcatcccctctccgctttttccgccgctctccgcgtgccgacccgcgccgccggtgtcgtcgccggtggtcgccgtccggccgcgcgccgccgtcgtcgttcgccgccgctcggccgcgcctgtactttggccgcccgtggaccactcccgtggtctgggtccacggtgccgccaggctgcggtggaccgagtccaccgtgcgccctcccctagtcccgctgacgtgtgcggcccacctatcggcgcgcccttcccctttgatgacgtcagcggctgtgccttttcctttgaaaaattaaataataattgtgcaataaatcggtaataattctagaaattcatttaattggctcaaaatttctaaaattcatatctaattcattcgaactccgaattgggccattcaacttgcaaaattcatctaaaattgagctctacatgttttttttactttttatgtactgttttcttggtttttattagagttttcctcattttgcgtgccagcgtgtagttcccgtcgtttcggaagtccgcggtcgcgaggaaaagagctcggaagatcaaagtgaagaatcaaggcaagtcacacattccccttgagcattttgatcctaatttacaaatgttttatcgattgcaaataaaattgcatgtcttgctaattacatgggatcagggttttacctatctgctcacttgtgccatgtttacttgatatctgtcctttgtcaatattgggtaataaatcgactagctcatgttacttatgtgacctagctagaactatatgcttagccatgcttaattaccactagctcagttgatgggataactgcagtattagacctttttagtatcatgaggagctgcgtgctcaagacacccggccatgcttcatggtcataattgtccaactaaaatgcgactaaatggtgggctgtgggtgcatggttttgctagtcgcacccatggcaattaaggaccggtttgcgggatgccctggaagaacttatcgtacttaccataagccagcgtgggcaacggctgggcttgtagtgtagctttcctctagccgacgcatccaggcaagggtgggcgtgatggagtttagatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgttgtggtggcatgtcggcgcacggaaacgtgtcgtggggctgtgtcttgtgggtacagttgtacacctctgatcagagtaaaactattcgaatagtcgtgcccgcggttatgggcagtcgaccagattcaccgtgattagtcccaccttaataaattgactcaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaatcgttcttgtgttccccttgcacgtctgcatcgttggtgtggcttgctaagtacggtggttgtactcagccttgctattattcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcgttgtgaggactaagtgcctcttctgtaagtattttacgctttatttacatttggaactgtttattacttatcgttttgtgtaccctggctggtcctggacagggatttaatacacaaaatagtctggaaatttgggcaaaatttctgggcgtgacagcggctagcaacacgcgtaaggaggtgatggaagaagtcggtgatctgggggaatctgttctccccctttttgaagagtaggacctcttgtactcccaagacatgctgtgtaaaactgaatcttaaccgcctttggatgtgcacttattattctagcttactcttgcatgttgatcttgaaaacttttgtcccttgtagagatgttgatgacgaggatgtccagcagcgcgggcagcccgagtcaccggcgactattccggttctcgcgtttgaaccacatgcgttgcccgacaatgtagaccagacccttgctacggggacggagatggcgacgactttcttaggttagttgtccattcatccctttctgctcctccgactagatcaactatgttctcgaaagaggcgcgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaagctgtggaaacgctccgaggtcgtgaggtgtggttcaactcgtacttgaagagttgctgcacatccatggccagggtttgtagagaacttcgagtgccccgtggagatcccgaggagtcggcggccggatacatctcttggctgaatggagcctgtgctcaactcgacggcgtcggcaagcgtatcgacgaggtcttgaagcaggagtgtcgtcgatcgagccgatatgccgaaggacacgtgttggcttgcctacgagatcatcgcccgcgcctggacctcgattttctccgtgagggttttgctcgttctcggaggactccggcggagatagaccacctggcgaggtcgatggcgccgttggcggagaagatcttccagtctatagactggagttggccttcttggtagtcttcgtaacctgtgatagatatctcaggaaaaaggtgtaatatagctttggatttgtgtaaaaattgtaagaagtattttgtgaaatagaaaagaaatctatctttaacaaatctttcttactccggatgtcgtgtgtaagagtgtgttctcagttcacgactttagtcagtcatttgagtcgtacactctccctagcccccagccttgtcgtcggaggaattttcttggaggataaggctcttggacctttgacctgccttggttgaataagctctgatcctagcccccagccgtgaagttggaaagttaatttccgatttcgcggcttggttaatacgcacggcgagaactcttacacgaccagatcttacatggtctttcgtctctacaggatctgacaaggccttatcggctctgggcgtccccaaccgaagatcccttaggttcctcggaggccttgtcaagacggcgtaaagggacatgaggataggtttcaacgctaggtgtcatcagggtaagggatcattgggcggaaacactttgattgtaatatgggcctaagaataggctttattgatactgtaaggtgtcttacaggtacggattgtattgactcatacatagaatttacgtagttggtcaatgttccaagaatttgctaactcgcgaccatcgtcgtctgcaattttgaatgcgcatgaccgcaaaacttgtgtgatcgtgtagggtccttcccatttgggtgagagtttgtttcgccctgcttggctttgaacccgtcggaggacgtagtcgccaatcgaaagtatgctgctcggatgcgcttctcgtggtaacggcggagggcctgttgatagctggctgctcgaacggcaactcgttcgcgatgttcctcgagtagatttacatcgacgtttcgctgctcctcctggtcctcatcggagtgcttctgtactcgtgtactctgatgtcgtagctcgctggggagcatggcctcggagccgtacacgaggaagaaaggtgtttccttgttagacgttgtcggtgtggtgcgtacagcccatagttactgatgggagttcttcaacccattttttgtcatgtgacatgagcctgtcatagacgcgggttttgatcccttgtagtactatgccgtttgccctctcgacttgtacgttgctttgagggtgagagaccgaggcgaagcatatcttgactcccagcccgatgcagtaatcctagaaatcagcgctgatgaactgggagccgttgtcggttatgatgcggtgcagtagtccgtatctgcaaaatatccccttgatgaatttgatggcattgtcggccttgatttcccccatgggtactgcttcgatccatttagtgaatttgtcgatcgccacgaataggaacctatagccgccctgtcctcgtgggaatggcccgagtatatctagcccccagtacgagaacggccaagtaagagggatagtctggagcgcttgcgcgggtatctttgtgtgtttactatggaattgacaggcttcacatcgctggaccatgtcgcatgcatctttaagggcggttggccagaaaaacccctgtcgaaaagctttcccgaccaatatccgaccggcggcgtgtgacccacaaatgccttcatatatatcaaggaggaggtgtctgccatcgtcggacgagacgcatttgagaagtaccccgtttggcgctttcttgtatagatcgttgccgaccatacagtagatctttgctttacgggttattttcttggtctctgtatcgtcctcgggcaactcctcgctgttgatgaatttgattagtgggatgcgccagtcgtctgtggtctcgatatcggcaacggcttgttctgcctttgtggcctccgagctaatgtcgggggtgaccgggctaacttcgccgctaacctcttttactgatggctttgtcaggatgtccagaaaagtgccgggctcgagcggttctcgtctagacgcacgtcgtgctaggtcatctggctcgatgttgtctttgcggtagacgtgtcggacttcgatcccatcgaaccttttctctagcttcctgacttctgcgagatacttggataactcggagttagagcatttataatctttgtgtacctggttcgcgactagctcggagtcccctttcacgattagtcgcttgaccccaagtgcggctgcagctcttattggtcgccctaaagttgaggtggattgtgtgcttgaattgatctccggagggagacgtcaagataaatcctgccccaactccttggctgttgagtgcaccatcgaacgccattgtccacgtttcgttgtcgacttggttgtctgatttgttatcaggcatagtccaatcggctacgaagtcggcgagtacctgggatttgatggctgttcgtagcgcaaaattgacatcaaactggctcagctcgactacccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtaatttatctctctcgacaacgatgacggtgctaacggaatatggcgtggcggcgatatagaggaataattcttcattaggttggggggcaacaagtacaggggggttctataggtagcgcttgagtgcaacgaatgcctcttcggcttcctgtgtccatacaaatttttcttgcttcttcagcagagcgaagaaaggttgccctcgttctcccatcctagcgacgaacctgctcaatgctgccatccatccggttagtttctgtacttccttgagtcttgtgggcgacttcatgttctcaattgccttgatcttctcgggatttgcttctattcctctgccaaagacaaggaaaccgagcagcttgcccgacggtactccgaacgtgcacttctctggattgagcataaggcgatatcgtcggaggttgtcgaacatttcccgcagatcgtcaatcaatgagtcgcctgtcttggtcttgataatgatgtcgtcgacatatgcctcgacattgttgccgagctggtcgctaagtgcgccctggaccatgcgctggaaagtattccctgcagttatcagtccgaacggcattttaacatagcaaaataccccgaacggcgtgatgaatgctatcttctcttcgtcctcttttgccaagctgatttggtggtagccagagtaagcgtcgagaaagctcaacagctcacagccggctattgagtccaccagttgatctattcgaggaagagggaagtgatcctcggggcacgccttgttgaggtcggtgaagtcgacgcacattctccattttccgttggccttccgcaccatgactggattgactagccactctggatgaagtacttctctgatgaagccagctttgagaagtttgtcaagctcttctcgtatggcttattttcggtctagtgcaaatctccgcagtctttgctttactggcttggcatcgggtcgcaccatgagtttgtgctcaatcacctccctggggaccctcggcatgtcggacggctgccaagtgaacacgtcagcattgtcgcggaggaaggtgatgagcgcgagttcctatttctcgcttagtgttgccccgatcttgacggtcttgtcggggttggcactggagagtggaacgatcttgattgcgccgtccggtttcggcgtcttgtttgtcttgctcactttcttgggtggctcagtcgtggcgggtgggctgggcgtttgctcgaccatgtcgaggctccgtttgtcgcattgcaccgccagctttgcgttcccttgaatagtgattgttcccttcggtcccggcatcttgatcacttgatacgcgtagtgagatgcggccataaacttcgcaagtgcagttctcccgatgatggcattgtaagctgtatcgaattcagcgacatcaaaggtgatctgctctgttcggaagttgttggcttggccgaaagtcacaggcaacgtaatcttgccaaatggtctggatgaggattggggtgtaattccatgaaagggttgatcggttggtgtcaactcgctttgcggaattcccatcgcgtccaaagtgctggcgaaaagaaggttgattgagctgccaccgtcgatgaggacctgcgcgaccttgatgttccgaatagtgggttcaaccatgatcggatatcgtcctgggatgacggcggtcttggggtggtcttcttccgagaactctatcttctgttcagaccacttcatcttgggtgcagccccctaccatgttgaacagacttcgcgttccacttttttgtactctcgcttcgaggagtacgttgtggaacctccgaagatgtgtgaaacgtggaggtcagagtctgtcgacaggttggatctttcgacatggagtcgtcttggtttgtagccactgcgttcttgtttccggtcattggcggaccggttgagatcggcattgtggtgtaaaccgggaagacgatttcgccgacttgagtccacaccagcatcgttgaagcagggaatacttggccgaggttggtgttgacactgttgtcgacgaggccggataacatagtagtagaaccttgagtaccaagtccccctacctggcgcgccactgtcgacgggtgatacccgtagaccggatatagagggtattggggtacgttggtacaaggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgtatgatgatagttatttctattagatagaagtttgggttgttttggtgttacgagaaatgtttgttttcatattcatgtccgatcatattcgatccttatttatttttgagataatttttattactttatgtattcgattttgtcagggttatggataccacatacctaatagtagttgactaaatctcggcaagacccaccacataccatgtcctatacggaaacaaccttcggatataggaggagttccagataaggaaagacaatcaaagttctacatggaaacgacaaggactactcggattgtatccatattggtttctctagttctatttggacaaggggacacctatgggtataaatacaaggccccctaggaggagaggggggacaatacacacccaacacaatcaacatacacggaacaacagaagccacaacatacaagccaacataagccaagacaagacgccggatatcaacttcggagataggtatggctagtcctctacggtgtctccggatactgtcaggaaagacgaaagcgctatctctgatctcgccgggcatggattcgaggaggaagactaccctgttgtcgactacgagtcagaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggcaggcgaattctgcgtcagggctggcggtgaacgacgagtgcaagttcaagttccaggagctgaagacgaggagggggttcaggttcatcgtgttcaagatcgacgacaaggccatggagatcaaggtggagaggctcgggcagactgccgagggctacgaggacttcgccgccaccctccccgccgacgagtgccgctacgccgtctacgacctcgacttcgtcaccgacgagaactgccagaagagcaagatcttcttcttctcctggtatgggtacttaaaaatatatcctaatcttttgaggggacgtcctctcatttctcacgtctaaatagttaaaaaaaattaaaatattaataagatatattaatatgtgatatatcattaatttgaacctgacttcaacaaggtgcaaaagaaaaacaaatatgactgaatacacgcatcttagctagagtttaatttttttgctttttacaaatcgtaaaggttgaatttgaatagtatatttgtgtatataataatctatcttgataactttttttactaaatttttcattactaaaagggacaagatgcaagaaaagaacgacagagagttttagaattcattcccctatatagctataccatcgaaattaatatgcgtggctaagttcaatttcatttcgatgaggtatcatttctgttataccagtaaagatcacagaaagtgccatgcatgtatgtgtaggtcgcctgacacggcgaggacaaggagcaagatgctgtacgcgagctccaaggacaggttcaggagggagctggacggaatccagtgcgagattcaggccacagaccccagcgagatgagcctcgacatcatcagagccagagctcactgatgatcatatcatttcatcatccaacaccaccagattaattaattcattcccaacgtcgatcgccttattcaaccccagatccatgcatatatatatgcccatgggttaatatatcatcaattatggggtttatgtccgcttaaatttaccctacgtacgttttgatcctcgcaaaaaaaaacacatacatatatatatataccgttttgatcgactatttatacgttgttatacgacattgatgtcgtccaagtattattatcctattatatataattccttcatttcattctatttttcttctgcttatatcttcaacttttcatttttgtaatttgtaagttgtattgatgcaatttgttggcaacaagaatacactttttctattcatgtataatagaaacaacatattctcttattacgtgttatgagttgtgtgtgcataatggaatttactgtgtccaaacattaggtgcacggctagttctttacttttagattggttgggtgaaggcgaatactgatggggcgtttttgtgatggcacactagtttggagcagcggtggtagtcttgcgaaatgaccgcggagattttctgccccattcgaatgtcctgaaaaggtggattaaatttcggattaaagtggcgcgctttttaaactgctaaacggtatgttccgtgcaaaaactttttatatgaaagttgttctaaaatatcagattaatctatttttcaagtttgtaataattaaaactcagttaatcacacgttattaccacctcgttttgcgtgaaacacttaatctacatcttcatcttcatctttagaagattcaaacaccttaacaatatcatctaaggattaggatgctaccatggcgaaaattctaccttatcgcagagcgactaatattgtaagggagttaggagtatctaaactaattattgagactgattctttggaagtgaccgaccgagaatggtgggagtgtctagcaaacattcgaatgatttttgtcatccatttcacttagatttttcaacgtctatccggatgacacgttgccgagtgaacgactttactagttaatcgttctaaccgattgctcggtgaagaaaaaaaaaaagccaagacatcccttcattttgattgtctagaaaaaacccgagatgaatgaataaatattactaatacatctacttaaaaagttacatgcagttacattatagtcatattagctacagtataattacagtatagttacattgcaattacataatagttacactacaattacataaaagttatactgtaattttataatagttacactttaattatataaagttacactgtattttctagaattacataatagttacgatgtaagtttatcgttgtaactctaatcaatatttattgtatatatattttttgagggaactattttccagcattgcatgcttgctcggttggtcgtagtggttctagcgggaagcgcaggccgcgagatcgatctcacatgtgggcatctgttttatattttcccaccagtacagcacgaatcttgacacaaatcctacggccagaaaattgacagatgtgtaactaaaaaatctgtcgaaagatttatagcaaatccggagatgcttagaggaaagttaacagatagatttgtaggactttggcccaagacctgaagataaagctgagttatttcgaaagcgcaagggtcacagattagctcaaggagagtcttcgagtagttttaccacctggctttctatttttccaggttctattagttcgattctgactgatgattgtaagtataatagtctaagttaattaagtgcgagtagtgtactgtgtaattcttaaaaatgtagtgccttggtgtggttcctattttagcatatatcaggccttggtgtgaacatatcaatctttcttgcatttggtgcctaactgtggacacggttatgcatgaatgtatgatgagactccaggacggttgaaaacacttcaacaatatgatatcaatcttgttttaatcaagatcaacacgcatcagtttcataccaaaaaaaaagggggaagaaaccatgcaacatatctggcagactccgatattaaggagatattatgcaatttacaaaaccagtaacatattacaaaaaaaaaaacccactaggaggtagaaaacgaagattaaagacagtttatcagatgtccatcaaacagctgtcagcgtttcatatccaatgaaggaggcacacaagaacagcagcacacgtttagacgttttcactattcattggctctcatcgacaaataattttattgggatgacaaacacacttttatttggatgataacatcttctacacatgctatcctacgccatattgagcataatattatacagctgtgattactatacaaagccggggcattttagtacattgggaagaaataaactaaaaaaaacacttattacaagaaccaagaggtgcttggacacccaggttcgtctttaacttaactatacatcctttcatatatgaacttatagccggtaaacatcgtgcttatatgttgtattgctggtttatcttttattgcatcagcagaagattatttacagtagcgtttatattatttgtctcatcagatcctacaaattggtgaagaaaaaacatcagtgcataccagtgcgtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaag

SEQ ID NO: 32532 - DNA, 6120 bp, Oryza sativa
gtaaggtaatagctaaaactagagttgagaggaaatagaagtgtacctcaataattagctcgtcagggatatggggtaaaacttctcgtactctatctaccatggagagaacctccgacatgctaccattcgcgggtcttgcagtgcctcggaaccgcaagccagcagctgaagcaccatcaggcctcgaggaagaggatggaacaaccgaagatcctgcaactggctcaggccatagactccaggtggcatctggatgcccataattatcagtcactgaagtcaactgcctcatcatcatctgaactccactaagccccactgatgtcacggcgctggaagaactgggattgtccatcccagggctcgaccatggtggtgcccagctagaatcaagaccagcacctctgcaccacccaacacctatgcatcagtgctgcagaatcgtatgcatagcagtacaactatagggttatggtgatcaacaaacaatttccaaaaacgaggattcactgatatagcaagtgtatgtgtgctaaattataatagcatctgagagataagtcatactgcatatacaatacaagtaggcacagaagagccatcaggcaaccataagaaataaaaggaatagacgagagatggaccagtttgacccatccaacccacctgcacgcatgagtgtatgcgtctctttcggccctttccagcccaaccaaccaaacctgcacagatgtgctctataaaacttagccccttatctctgactccatgtgtatgcaagacagtagcagcttcacctctttctccatctaggtttctctaccctcacaattactctccccactccccctgcccccctgctctctatcctcgacctacctcttctgcctcactgccacgaatcaaggtagaattctcccttgcatagttgcaatatggaagagctggtagcaagcggccaggagataatgcgtttttgatggtcaggaagttgggggagcgagaacaggagctaaacgcacactatatcaaaggtacaaaagtaccaggaaaatatcattacttattcaaattattttggaaattaaacaaatcaacaatacccgataccatatccccttgtaagttgtatcccaccacatccatgtattggatacgtatttgcacacaggatcagcattttgttgtataggtgattaataggaagataaaacatatatcttctggtaattttgagtgagcatgagttttagtcatctttggggatcccttctttgccaagttttcaaaattatgtttcctttggtaagtctttattactaccaggttacaatttcaatgttcaatcaagattcaatcctaaaaatatgctaaacctgccagtataaatcaatctgactggaacaaaatattcaaaataatgatggtaataggcaggtgagcaccatcagtttgacatactaaacctacttagtttcacctagaatgaataagattcgaaaagatgcattgaaagactttggttcatcattatgaacaaagataaagtccattaggaaatgaaactatggctattattcttcctttttctttagatcaactaggcctggtaaactcgctttcatacccatttaaaacttcaattgaaccacaaactaggaccaccattaagtgatacattacaacaaacaatagcttcatcggattaaagattatcacagtatctagatagaaaatgtgcatgccataaggctaacaaaatctttgcgagggtagtaacttgaaagagaacaggaaattaaaaatgccctcaaactataccattcatacactcaaataactgaggtagtctatcaaggcctagtttcaaataacgatataatgtcagacatttgcccaatcactttataaaatgagcttaagttgtgacaatgaacaccaggggcgaagaatagggaagacatgcatgagtggagcatcaacatggtagcacaatgctgatcttggttatgttcacggtcacggcagatgaatatgggctgggaaaaatatgttttgtgacaaatgagctgcagagatatggtgcttaggtgaggcaatggtagccagatatgagaaggggacaatgatgtttcctgagaacttcacatagaagtgatagtgctatgaatgtggccatgttggcgaagaatgaaaggaatgacaaatttaggattttccctcctgtgagtgcactctattgtgctgttctacaagccatcatcatcttccttctttcagcaaaaagagcatatcttcctcttccttctatctccgaaaagggcatatcttcctccttgtctgagcaggatgtgtgctcaattcagatctagcatgcataatggagtcgaccgctaggggtgaggtggaaggtgttcgtgcacatcagcctatggcacacacaagggattcacggtaaacagcgacagggacaattggacatgatctctgctgcactgtctttgccacgacagccaccacctacactacagtaatctggtaagcaatttggcactgcagcagaaagatagcctctcgcttctttaccctgtgtgagatcaccaccctccctaagacttataagctgcgagataacacttgttggcattgcccacgcataccaccaaggatcatccttgccaagtgccacagcccacaaccagtgccaggaacagtccaagatcctgatcatattatctctacatactccatcgttccaacagctaccagggtaaatcaggcggcttttgtgataaattatatttgcttaggcagttgtaaattaatgaattggcagttgaaatgagatagttgggaggaactctacaattatgtcaagttcaatctaccatacaacaactgatcaccaagaatgtagtggaattagctcggatgctggacaaaaggcattacaataggatgttcaaagataaaatttctgagaaagtttgatccagcacctcaggaatcaatgatggctccaatgtacaggggttttctagacagcaaaagttaaccttttcttttctcatattttttgttcattcccgtactcttgttgatgtagaaacacatgcaggaagcgcttatggaacacatagagcatgctggtgaggaggcaagaaactggtaaacgaagaggtcatagagtggcatactcactctgagtaagcaacagatgcagttggttgtttcttcattggcacaaactgcagagcagcctcctcagaggcacctgctgtttttgctcctctaagctcccatttagtctttgcactgctgatttccacattagctgccttctcttccatattatctctctctatatatagctaggcctgcctgaaggttgcaactggctatccagctagcattgagtaacaaatgatgggaggctgtcaggctgacttgtggatccacattgttagctaatatgtgggactgatgggatgtagtgatttcataaaatcgagcacaaaaactatcgtaagatgggtccttaaaggtgtaggtttgtgatagttttgaagttttgacaagacatgaataggttcattgaatttaccccaaatcacatcaataatttgacaagacattgttataacatgaatatgatgagcaatgtgaagaataagaaaatagatcattccaagtttgttatacacacctccaaacagcatctgcaggattctgatgttcaataggatgttcatgaccaggaaccctctgctgattcaaccccgcattaagttgttctgcaattaactggacgtttcctacctctgctgtagatcttgtgtgaccttgagatgacagaaagagaggtcttcgacaagttggacatgagtaaccatccattaatccttggtccaacctacacatagcaacaatacttaagggaaaaatcaaacatagaatgcaatttgatgtggtcacatttgatggtaagatgtgaagctatacacaattgctaagcatatctacttttgtgggtgtagaagtgttgcatatttttgtactaagtgagaagcagaggtcagtacagttgtacgaaagagcaacaaagggagctgaacaacagtctaagctgaaatacaagtaatactatgatctgttactaatgactaacaactgcaacttcttcacatcagcttgctggcaagcttcaatctcgtcaaagatatttgtgagaatctgactaataatttgctaagaaggttaacagaaggaccatccaccatgctcagcaatatcaattttccttatgcagagattccatgacagaaaaatttaagtcaaccgtaaaataggaatgttggtcccgtattttaataagtaaatttggaatgcataagatcaaatggacagttatgacggcatatggagtctgttcataactacagcctgcagtccttatgcaaatagtgggagcacaatttccagaaaatgaaaatgaatctacttaaagttttttttttggtaggacattatgagctataataaaattgaaccacagaccatcaattgcaaaatagtaaaaggaactcatcgcgtaccatgatcgcaagcaagctagatgaaatagatggttgcaggataactttttagctcgagccattggtccctaggagttgcagatttcaaaagaaaatcagatacacaagcactcaaaacactacagatcctgtgaaaatctagaaattgtttaccctacagatggcacactcatcgtcgtatgcacagatttcatcatatgtagcatctggaagtgctccgtcgagtgaactaagtgcctttcgtaacttggcataagtttttatccgcttccaaaatgaagctataagagcctgcaaacattttcaaagaattccagtcagtacatcatacatatttatttaaagtttatcgaagttaacaagtgaatgtcacactcacgcgcaagttcaataggagaacagcgtcaaccagatgaaacgccataccacggagccagaagatcattgagtaatgaccaagtgacatcaataagcttatcaagtcaatgacaaaaccaaaatttctgactagtctgcctctccactcagaaaaagatcctgcagttacaaagcatgattggaccctggtggtaaagttgagataattcaagagacgcatgtacaagaaatgagacatggactgctcaacctgaactaaattaatgttccaacagatcatagagcaaaatttacagtattacaaacagaccagaccaacataacaaatgtcagatgagtgaatgaaacctctgttatatactccggcctgtcaggaaaaaaaaaaggttctgttttttaccattggcatggccttggaaaaaaaagatcagcaatttatataaaaccgattattgagatcaatatacatgttttttctttgtgaccaatctaaatattcatagatatgttaccagtgaaagataaaatagtttactgtatgcgttctaggattttttttttcattcactgaatctggtgtttgcattcttgtctaggttagtaataaccggttaaccacgaaactcatacagcattatcctgcatgctcagccctagagggtttactaaactgaattaaatgagtctctgagcagcgaagacacgcttatcacctgctgcttgcttataagttttttggaaatcaagatagtccacaccactgtccatttgatgtcgttgccatatgtcaaacaactgaaatccatgcaccatgattgactgctaggaaaatactatgtgagaaaaggttgaagatattcagaagtaataactgcatgcaggtaaatgctcataatatttttaacatctctagttggcatttataagcaccacctcctttgaacattaaatgcaatgcagatttctttgataatgcaagatcgttataaattaagaaaagataaggaggagaaacttcccacaatctgggttgaagtacctgcagtgtctcaaagccaatactaagtggctcaaaaaacataagccaaaatagttgagaattacacgacttgcagaacccaacacaaagctttatcctggagaa

SEQ ID NO: 32533 - DNA, 601 bp, Oryza sativa
agggtacaatagaacaccacacacccaaaggaagtaaaacaaactagtgcattagcagcacagccctagtaaagagatcacgaagcctagcagctcctggctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgaccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtt

SEQ ID NO: 32534 - DNA, 539 bp, Oryza sativa
ctcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccaaacaatgtccgggcaacaataacaaagatatgtgcattcatgaacgcaatttcacagaaggtcatcgatccggatagattagaaacccttcagaatgaagtggtgcaatgtctcgtcagttttgagttgatatttccaccttcctttttcaatataatgatgcatctgctttgtcaccttgtgaaagagatccgtattctcgggcctatgtacctacacaacatgtttcattttgagaggtacatgggcgttcttgaagaagaaatttcgtaaccgtgctcgtccagaggcaagcatcgccaagggttatggaacagaggaggtcatcaaattttgcatagaatttatcga

SEQ ID NO: 32535 - DNA, 220 bp, Oryza sativa
aaaaaaaaaacaaaaaaaaaaaaaaaaaaaaaaaaaaaaaaaaaaaaaaaaaaaaaccaaaaccaaaaaaaaaaaaaaaaaaaacccaacaaaaaaaaaaaaaaaaaagaaaaaaaaaaaaaaaacaaaaaaaaaaaaaacaaacaaaaaaaaaaaaaaaaaaaaaaaaaaaaaaaaaaaaaaaaaaaaacaaaaaaaaaaaaaaaaaaaaaaaaaaaag

SEQ ID NO: 32536 - DNA, 841 bp, Oryza sativa
tggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaacaatattacatgctaagactaaaatagtcatgtatatgctaagtgtttcttgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcct

SEQ ID NO: 32537 - DNA, 721 bp, Oryza sativa
ggatatagagggtattggggtacgttggtacatggatctacgtaatacgacatcaagtaggcaaaagacaaagattatactggttcaggccccttgataggtaatagccctaatccagttgatgtgggattatatgatggaaaacacaggttacaaagggaacagtggaacttgacggatccggcaagattgtggtcaagttggttcgactagatccccggcgatttggctccttgcaggctccgacttcgtaggctgtgagggttgtgttggctctgagattcgatgccctaagtcctccccggggggtcccttttatatcacaggtcaggcggtttccaagtagaactcggaaacatcgaaccttacacgatacattgacgatccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaactgagataaactcagtggcataagctcctattaatattatttgaacttttaaataattttatgaattatattatatgttatctattataatatt

SEQ ID NO: 32538 - DNA, 13878 bp, Oryza sativa
aatgcgagtacgtggccatcttcgacgccgacttccagccggaccctgatttcctccgccgcaccatcccctcctcgtccacaactccgacatcgccctcgtccaggcccgctggcgtttcggtaagtatagtataatcgatatctatcccgactctacatgtcatccccctatatctcgtgttgactagacatttgcgtgtggtgtcggttggtgagtgattgggggtaaataagggatctcatattccgcgaattttatatagtcggaatattgtccagttgatctgggccatttatgggtgatctaatggctgggccgtgcgatcgagttgttggttgggcgagtgagagtgagtgtcacttactgacggggcatgtgcagggtacgttgcacatttctgacagctactagagtatataagcttaagatcctcgtgcccttgtctcatactagcattgtactggcaactaccagcatcttgctagatcttctcatcaatcgtatcgagccggatctctcaatccgatcatgatgattatcaactacctcattcgttcaaaaatatggttattaggatctcatcgtttggcttattcatgccaaacgaaatatttgaaaacgaaaaataatttataaataaattttttatatacatatttttagcgataaaaaagcaaatgctgaaaaataaactttgacgaaaaaactccgaaatcaactacaaatttaagattaaaaattgaaattaactaataaacataagcataaacgaaatgatgtgaccgatagatttaggtgatgttaaatccaatactaaataattatattttaagatggaatatatgcgcgtgtcgccgacgatcgccggcggtgctggctccaccggctgggccaggggtgttgctatcgccgtcggtgatcacggcggcatggagggtcgtcggtgattgcgtctggcaattatgcgtcccatttcttccgggatgcaaattgtgttcacatattattttttagggtttagttggtacttgttggtagggtatgtggcagtgtggacttcattaagtaaagatgatggagaagatccacgtgcctcgtacttctatgacgactcgcgatagcccgaccgacagttagtaagagctgaactttggtcatatgacctaaaatatcattttttatttataataaattaaaatccgatctctatatctaacatgattgtacaaggtcagacctaaattaacaattggtttataaaatataaaatattataggattatggtcttataaacgttttctcactatatgattcatcaaattgtctggtgctattcgtttaaaaaaaagatatcagttggttcatataaacaccttcttctatttggttcctataaaatcctctaaagtaagcatagttaacaaggtaaaggcaaagatcttcttcacttaattagaactaattatatttccattagcattgatccaatcgctagcacaaacacgagtacacaaggaaagtaaagtacaagccccattccttccttggcttccatgcagtagaggagctgtgcgtcccagggcggctacgtcagcacagcagcagcttgtcctgacactgaagctgagctgagctgagctgacccatctcgctgcagtcactgtgacgtggggcccacccgtgctgccactgccgccaccatgtggcgtgtacgtgacgggtgggcccatctcgtcggtgatccttgagccctaggtccggccatgtcctgctgtcaaatgctgcagcgattagtgtagtaattaattaggggccgtgccctctgaagctccagcttaattggtccttctctccaacagtggtgtgatcaagttgcaattattatcaaagcatagcagtacagtgacagtggcatgtgagatctccagagttttggcacgagcagaaattgtgctgcgatgtgcattggatcctgcagctaaattcagagattagtgtggagtagtttgggtccaattgattattagtattggccactgcccaaggttactgtttagtagtagtggtagtagtactagtcttaatacagtagtagtagaagaaacaggacaaaacctgccaaaaataaagaaacaagcaaataaataattactacagaggacagtgcagtgcaggcatccacagttgcacaatttcttcacaacagtgtagcagtagtaaaatgtttgctactagtctggttagctgagaactgtttccaggtctctttgttttaatgatgtatatagtacagttgttacctgtcaagtatttctcatggagctatgatgttgatcttgtctttgaactatatgatgttgacattgtctttgaactacaatgatattgatactgtcttttgtttctaccagtgaatgcagatgagtgcttgatgacaaggatgcaggagatgtccttggattaccacttcacagtggagcaggaagtgagctcctctgtctgcgcattcttcggcttcaatggtaagcttcaaccttcagtaatttcatctgttcttcaccaagaactttgtctctgaagattctaggatatagaatatgcattctatgttatgatttttatacataagggctgattgattcggtgaattttcaatcaggaactgctggtgtgtggcgcgtttccgcggtaaacgaggcgggaggatggaaggaccggaccacagtggaggacatggatctggcaatcagggcgagtcttaagggatggaagtttgtctaccttggagatgttcaggtacacaccaatcatggatatcctacacatgatcagcttgagatagcatccaatgcatcctttgtcattgctcttgctaagttgctattgcatttcccttctttttctttttcttgaggaaatagtacattgattcatgttgcctaagagagaaaaaaaatgagtttaacaagaattgcgtcgttttcaggtcaaaagtgagctgccaagtactttcaaagcctttcggtttcagcagcacaggtggtcatgtgggccggcaaacctgttcaggaagatgctgatggagattgtgagaaataaggtctccccaaacatagtgccaagaaatccagaaaaatttaatccatgcagcttcttgggttggcatctaacatgctattattgacattgttgcagaaagtgacaatctggaagaagattcatgtcatctacaacttctttttgatccgcaaaatcatcgcgcacatcgtgacctttgcgttctactgcttgattatcccggcaactatctttgtccctgaggtcaggataccaaagtggggctgtgtgtacattcccacaatcatcacccttctcaattccgttggaactcccaggtaagattttcttttgattttattataatcctagttgaatatgatcaacagtaatgctcctttggtgaatcaacagttcatgattgattgcatgtttagttaacccaaggaagtgaactgtttgcaggtcttttcacttgcttttcttctggatcctctttgagaatgtcatgtcactgcatagaacaaaggccactctcatcggcctgttagaagccggtagggcgaacgaatgggtcgtcaccgagaagctcggcaacgctctgaagatgaaatcatcaagcaaatcatcagccaagaaatcgttcatgagggtatgggacaggtaagaaaaattgatcagaacaaaaactctgccaaatctttataactgttttctcagctcatgattcactgatttcgagtgacaatttcttcccttttttcaggctaaacgtcacggagctcggcgtggcggcattcctcttctcctgtggatggtatgatcttgcattcgggaaggaccatttcttcatctacctcttcttccaaggcgcggcgttcttcatcgtcggtatcggatacgttggcacaattgttcctcaatcataacagaagagaagcaaatatatatattttcgagatcggccgccttcaaattcaccatgtcttcagcaagagtctagtagttatataaatcagtttgaagtaaagatcatgcagcatttttttactctcatttttctctgtttcttttcttttctttttcttttcttctttgcctttttctctgttatgtgctattgtaaaaaatagtgcagtgtaaggtcactgcaggaagaaaaaactagggcaattggtgtgatctgggcaaggaggaggtgaggaggatatcgtgatgtgtttttgcttgtagcaaagtacgtgagtggtatgcttaaagaggagcaggatgactctgcttccgttgtactgtaataacatacagaaaaaaaaaaggtcagacaagtgctggacaaaaccaaaatgttcagccttctctcgcattccactacatcttttattttgtttccttcgcatgtgttcttaccacttgagctaaaatgacatcaaagtagtaatatttatttatttttttgtcgggaagagaagtacagtaacaacattgtaaaaaaaaggggggaaatgtacagtaacataatacacaaggtactactatacatctcttaatgaaaaatactcacgtgcttccttctcaaagacatgaaacaaaaagcaatagtctcccaaacagagaggctacatcaagtaccagagcaccgtgtccgtgcaccacagcaacgtctactacatctaaaaagacatggagatgcgtccaaaaaaaggacacgaaaacgtaacaaacatgccacataccaacatactttttttatgcagataggagttagaactttcattctcgtcttattttaattaaggaaaaatacattcttgggctagaaaattacaaagaagttaaaagagtagcaacaataaacaatatcagaagcagatgatttttcatcattcgttcctttcccatcctgacaatctccgtttttcactaaaatgaaccagaagaagatttcacaggatgggatttttcgttaccataagcaaaacagaatttgcagaattagaaaccagtgagatattacgaccactcgctcaggcagccgaatcattgttgactaatcattattggtttcagttcagtttagttacaatcaaaattatatctgtcgcaagatgaatctacattcctatcagatgttgcaaacttgccagaaacatcaaacaaatgatcaatacaacgccccagagcgccccccctaaacacgacataagtacagaccatgagaatgagaaactaacacccgctacactacccactgcggctaatagagtgaaagtgggtagaaaatgagacatatcctccctacctgacatgtctcctctatctcctatggaataacctctacaatgaatagggttagtccaacagagaaaattgcaccgggtactcctggcggatcagatcaaaatgccagcacttgcaggtgcctcaaacaatttacatggtggcatcaagatcgaatgctcgcacatggagtaccaattcttccttctggaacctaaaaccacaacagaagtcgaaaaacggtaggctggtagatacgaggtaaaagaaaacacagtcagggttgaactcttgcaggggtaccggaacgatgtctaccacgctaccctccttaagcgacgacataacagaagactttgtatcatctatcatcgatctacttgacagcaggataatattcttttgctgcccgagaggcttctaactttggagtctacaacggagagtcctacattatgatgctaaggattcaagctctctcctcctcctcccacctctgtttccagaccttgtattgtcagctggctcaacgcttggaacttgatccttactgtagatgatacaatcatctagagtgtagaccctgagcgcgagtgaggatacagttgatgtcttcatagctgctgtgaaggaagaccagtaccaccaatcgttcttcaagaactcagcttttatcatgccctccaacaagttagccgccaaaaccatctaaaagaggatggatgtcattaatcaggaaattggataatgcaaaagagctctcaagtaataatttatactgcatcttcacataatgaagttaaaaaaagaaagggctaaattatagctcaggtcttggtggcccataattcctgtatcctgtttacttgtgtatctagacttacaacttaggaactaaccacttgaatctagacttactgctaaaaattttaaataaatggatcctgtataagtaattttacagttaaattgaactgttgcagacacaaacaaagacatggtaaattaacgctgcatgcttgagagtatatcttagaatttcggaacactatcaatttgatgaacgtaagccaaatgcagtatgccaagattacacattaagctacatagatatatttctgtaacaaacagtgaatagatagattaaggtacctgggatattgattctgcatctttgacaaatgcacgccatgaacgccttcttatttgctgacactttgaggctctcagtgcctcctcaggcaaggctgcttcgatgtcaagcaagtttatcttttgctgcttaagtatgtgagagtttcgtcctataagaggcctcaaggatgactctggaaccaaccccccattaacagctagcaatcgtgttggcttgcctgttgtagaatgtgcttcctcaccagaagtattatcaggggtgggctttttagatttttgcaccttctcatcacccacattgccaggacaactttgaccagatttggaaacctcttgaactagcttttgagcagacattgcattgcattcctctaaagaggaggtccaatccttgagttcatcatcttttctgttttgactttgtacaattgcaggttcaagaaaaaatgcaggtgaaggcacaaatgatggaactccattggacccattaagtccaatctgctttactgtctccttgttcgaatcatttgtgacgaactttctgcaaatttcttcaaagtcatatgggcattgcatcaattttctgtcactggacggttcaatgacagagctacattcaagggaatctttttccttcgtatcagatttggtaaccttcacttttggctcatcattttctctgctttcatcaggagactggtggattttactgcattttccatcattatgcccctcaaactctgtagatatgagataagtctcatgacatgttaaacaatggtatcgagaaggccatacaggttccaaacagtcgcagcgatatgttctatcttcagaacttaactttatcttctttcctcgctttttcggtagatcacttgtgtcctggtccaattgcagaccatacttttgttccaaaattactgcagccttggtatttggaagctccataagctgttcaccctttggaccagaaattggaggatcaacgagaggagaactgctttgatgacagaaatgtctttgccactgcaagatagagtctttcagttccttctcccttgggtcatagtctcttaaccagtcaagaaggcactggatttcctcatcagattcataaatgaaaatagatgctgaattccaacctttgcaatcaaaagcagatgggggataactgttaaccatactgatatctctctccttgggtttcagcatgcttccatcagccaccaaccaaggacgtttacccggtcttcctataacccagtataatcgaccaatggaatccttacccagacactctcttctcgatgatgccatattaatctgtgactctagtaagctaattgaatcctgcaattttgaaatgtcatccgataaagtatccatttcattattatcagcatcaagctcaattgatttagttgatgatgcttcaagattatcttggaatgatgtgctggctctttcatcaggcaactctcttccaggtgtgctaaattcagtgtctttcaagttcaagttatcacatgtactgctcttggcacctaatgacctcttctcacaactctgggacccttcatcaatagcatccccatcaatctggtcaatagccattcctgatggttgttcagaaagtcctgaagatttgcgttcttcaaccatagatgcactggatatgtctttgtcacttttgtaaggcttgcctacattcaattgcccatcaggaaccccatcagctgggttgtttaggttaactccaacattaccctgttcagcctcttccagatggtccaatgctgtgggcgtgcactgctgttgattttccacgggtccagaactgttgttaaaatgctgttcagttttactagatctactttgtctagcatatgaagtcctcatctcctccttatatttcaaatctttcaattcaaaatttgaagcacggaacttctgctgaagatcgcctaacttatctgaacattgatctagatgttctctaattagagcagtgttgagcatttcgtcgcatagaaatttcagtaaatatatcctctgcatttcaaagatcacaataaaatattaaaacaaatatgtaggtcactttgtcaactatggaaatcagcataccagcaaatgcttaggcaatcatagtattgtacagtacaataatagagggcaggactcttaagtaaaaaatcaaaccagactaaaattgtatgcaatgtccatgaaatagacatacttataacaaggtatatttgaaatggtaacaagaactgtatccagcagtatatatttaccactgagaaataagaaaaacacatcaattccttacgtgttgcttaacttggatgtccaaagcaacaaaacattgtagctactatactattccatggatgacaaaattaacttcaagctccaaattattgacctgaccttaagtccttataggtttaggggcctatagcaggtccaactttgtcttgtatcactcaaaactctaagaagcttattttgagtcattattttgggattgaggagcctcttggtttataccacacattaacaacagagaagcttacttcaaatacaaaggaaaaaagaaaaacaaacctcttgcatgttaaggtcccaatattccttctcttccattgctgtagctaatttattaagttcctcttgaaaggcatgggcttcctccccaacaaatttcttttgctgccgtttcacatcttgaacaccctgatcatgatgtgctttcgtttgacctaacatacatgatggacagtaccagttcccttctggtatacgggctagtgggggattcaagcagtaagtgtggtattctgagtcacatttgtcacatagcagaacactatcatcgtccctatcaataccacatactttgcaaacgccatcttcccatggagctttaggtaagctgttcgctgcagttagaatatcatgtagctcctcgtgcatttctgaaccagcattcttgtccgagaggtatttgtcaaatttctcaacaaggtcaagcacctgcaccagccaagtagaagggaaatgagaagataaaagacttctacataaccctgactataatgttttaaaatatgaaactataaaaaggatctatatattcgaatcagcattagcaatcacatgagataacacacaaagaggtggttttttttttcaagtaacaataacattgtttccatcattagattatgaaactaaattggataggtaaactaaactgataatcgtttacaacaatggtctgaccaatgtagctcaagggtgcaatgaatggtgacaaaacccatgaatggaaaatgtaatggctattggtattttgtacaatatctagttattgtgatggcatttggaggaacaataaagctgaacagaaaagcaaagatgcaacagaaaaataggattaaccaacctctgtcttgtacaatgactcaaaactctgagacaatgcaacaaccatttcaagcacatcagggcgatcaccaaatgcagtgtgcaggttgcgtattacctacaggaaagcataatggcagcataatttgaccagggaacttcttgcagtcgaagacagaatattaattagaatatgtttcagtatttttgcactgctcaattagttatgcaaatgaacagctcaattttacatgtaaatgagcaagaattactatagtaggttcacaaaatatcaccataaaaaattcacaaaataaactaactgctgttccaagttgttacaacagtgcaaacagaattcattggatccacattagcaaaacatacatgaaaaatcttgcaaaatatatcatgtgcatcataattgaataatattataaatgttaaagtaaaacatacttcctggacatcctcaagaaaagcctcccatgatccatagtaagctcccatagccaaccttatatcaattgtgcggaagtccaaagggcgggacaccataccagggaatcctagtatgccttcatcctcattttcattggaattcactagagtagttccgagcaaattcccaaaaagtttggattcatctgaggaaatagcagagcgcagggcaatacggcacttcttcaagatagcctctgagatggaaatagcatttctctcttttcttggcttttctggattatgtggtacttttacacgacatgcttctgtcaacacagatagaactgctttctgtaacaaaaaaaaaaggtatgcaaccaaacaatattttaggcatagggataggaacttcttaagaacaaaagaaacacaaaatatcagcatggacatcaaatttaatctaatgccagatccatttcttttgaatgatgtttaagcatggccttgccattagatcactttttggcatatacactactccctccatctcaaaatacaactacttatgccctttttttttatgagattaaggtaggggtgaggaatggttgtgataagttgagatgagaaagtaggtaaaaaattaatgggaaaaggttgtgattggttgagaggtaggcggagaagtagcaatattgtgagacggagggagcatattagtagaaatgcaatttcaacacagagctaatgtcaacatttttccagctaaactaagccatggaagcatcaagcatcatcacatcagcagaaaatccgacacagtcatgagggaaggcatgtgagctgaaattaagaaagttaaaacgtatgacctacagctacaagagctattaaaccttgactaaccaactagataaacataaaaaactcattggaccaccaaagcctctcatcaaaatcaaaggtcacagtgattgttctcatggggctcccttttttcatcacatcttttttagggaatacaatagacatagtaaaagcacaaactattggggagatacggaactatcatgcaatatgtattacatgatgtatgacaggaactcaacagatgaattaatgttgtatgccaacttggcaagagccaaacatatagggtacatgaggactcccaagtcctaatataagcagaaaaacacatggtaataaacctaaactaatatgagaccatgctttaaatactcttaacataaagcagtatgtgaaaatcattattttgcagaagattgagccatagttgcagggagcacactaaccttagttggtccagatgcattacccttgtagacctctttactgattgaatgctccaaaattttccttgcccattccggaggttttctctccaaagattcataaacgcattttctaattcgtgtccccacatttgttggtaattttctcacaggctccagtgattttgcccagtcaggcaatgttttattatcagtagcagacacctcaggagaatctaccatgtcagtatccttttgatccatcataaaaaccttactttcttcattcaccgaagatttgcatatcaaattttcagcctccacaagcagctgaaaatacaagaagattagtgtataaagtacagcataagaaaaattatattttctccttagagaacacaaggctacttaacatggagattgtatttgtagttttctttacacaactgcagatggaaatgaagtagaaaaagttacagataagttatatgacagacagtaacacattaacgcatccttccaggtcagatttatattcagaatgatgtagctggacatgtaattgctgtagctaggaaatctcaatttcagctttgttattcggaacatgaaaaaaaattctctagtaacataagagaaaaataagaattttgtcgccataggcatcatttaacagcaaaaatctctaaaaacaggtaaaggggctccctatagaaccataggaaatatcttcctagatttggttaactgattatcctgcactgataggcaacatcctttcatctattattcatagaacaacaaacataaagaattatacaagcagaataaggggttctactgttctccctcaagataaggtaaaagtgttgatatggttggtaacagagaatgttctatagaattataataatgataaacagtgcagaaagttcacagcatattatgagatatcaaaattttttgtccagctagctagttttgctagcatatatcttttcctcacaacttaaaagaagacaaaatcgtataagggtagaaatataagtaaaaaacttgataatgtttaaatgaatgagtggaaaataaaaaattgaagaaaaacacgaagagaagatagcaaataccatcttatatgaccgaagcaagctaaaagttacatcggcgctactaaaaaaagccaacattccatatatgatacataaaaaactagatatattcatcataaacagaagttcagctaaaccaagaagcgattccttaccaacgcatccttttccatgccagcaaccccaggtagtgcaccacacagaataccaccatcaccttgtagacagcggaataatttcactccttctcgacttgaaatatcagataaatccatgcacccacttatggacgaaatggctaaaatataccttcttgccaattccggccaagtcaacttgttagctgttagcatgtcaaatttaaattcttttgctgaaatgagattctcagtgtctttctttcttccacgcctagtttttgattctttaggatcaatgtttggatctacaaaaattgcaaccttagataatagctcaccaaaaagaaccctaaagagtgtaaggtgaaccccaggcaacactacgccactgcatcttccaagcgtctgagctgccgatttatcttgagcagctttcttcatagaagaagtttcaacagggatgaacaaagatacaatctcttcattactggttagacccgattcaccatttgaatatgatgtagaaacatttgcaggggaattaatcggcgaagtgtgatccctgtgaatgtcatttgataacttctctttctgatctgcacaaattggccatgggtcaataagttcatcttctagctgctcatatgaaggaatttctttcaggccaattatttcagagaaacgtcccaggaattcccatatctacaagaagattgcaaggaatcagatgcaataattagtagatttggacaagtgtgtacaggtacattcgatcaaatagaagagaaatggaaaacatatgcatagagttatacctggagaacctctcctgccaactctggcggaagcttattgctaataggacgtcccagaggaagttcacggattctaaaacccactaggctgggtatgatcctgtagcccagtcaccacagacccatgtctgccatatgacatga

SEQ ID NO: 32539 - DNA, 10148 bp, Oryza sativa
cctcaaacgtaaactcgccaattttgtcagtcccagagtgtgacggtactgttggtaccgacctatttgaactatgcaaatcattgcaacctaaagaagtcattttgctctccatatcattgctaaaacatgataacaaatcttgattggtctcagaagagtctgataggagcattaagatattatcatctgtatcattagcagtatcttcaagcaaagtgttgttttcatttgtttctattgtctcagcctttcttgtactattttgagagagaattgttgatgcatctggaagagggaacactgaacatgatatccttctcaccttaaacaaaggcccaaaattccctccgtcacacacctcacactcgaacagtgaaccagtaattctgtcatgccagtaagacgtaaaaccaactggccatatctggtaggaattatggtagcttggccttttatcgatttctcccaaactggtgataaagaaatcactatattgaacaggtaggccaacctagagatacacaacaaagcaatattgtcaaattcagtataggagtcaacatataaatatgcaattccagaaactacaagtctgtgcctttggaaaataacatatgagaatagatttcccacatgtacatgtagatccatttaggctgagttctttccccaactttcccaactcacctccctcgttttccgcgcacacgcttttcaaactgctaaacggtgcgtttttttgcaaaaaaaatatatacgaaagttgcttttaaaaaaccatattaatccatttttaaaataataataataataaatgctccctccatctacttttgatagtcatatttcatcttgacacatagaccaaggataagtaattctacttatcatccatttaaacatgctactagttattcctcgcaaacaagcgattcgttaatatttacatttctcgatgcccatgtagctaatcttgtgtggaagaatagagagtcacgcattaaatccgagaaagtcattaagagaataggttgttggattgaaatatgcctatcaaaaataaatttttcagatttggaaatatgactatcaaaagtaaatggagggagtacttaattatttataagaaaatgagtcactccgttttgcgtgtgcgggaggcgaacacagcctgccatcaattaatcctcgaaaagtcaaaattgatcaaacctttcagaatttaaaccagccatcatgtcttctatacatttgtcatatactccctccgtcccctaatataagggattttgacattttgcttatactgtttgaccattcgtcttattcaaaaaattttggaattattattttttttacttactttattatccaaagtactttaagcacaacttttcattatttatatttgcacaaattttttgaataagacgagtgatcaaacaatgcaagtaaaatgtcaaaatcccttatattaggggactgagggagtaaatatttaggatggtagtatggtacatgtacatgtggttctgcaatttctaaagtggacagtggatagagaactatataaaatggacaataagatactcacagtacgatgatgtggtcgacggctactattttccccaagaaattttggaggctttgatgaacttttgttttctgtagaactagactctgttgcttttgtgtaaaaagatggatccataaagatattggcacttccaagctcgtggttctcagcaaacttgggtaatgatgatgtctgtggaagatcccttctctttctgcgcaaatgaattgacctttgcactatgtttccatcagccatgatatcacggtccatggaagtaaattgttgtctcatgctcagacaatgagcaagaccaaatgctggcataaactgattcccatctgcaacaagaaagtagtggagttgtcataagctgcaccaataatagtcacctttgaagccacacaggtataagatacacagcataaaacaccatgcaggagaattcaaatattggtaaggctcacaaatttctgggaattatcatgaagttgaagtttacagacaagcacgtgttatgcctaactgagcaaaacaacatacgatgaatttcttgagcaactatgcactgagtatagcagctagcaggatttgatgttgatggttatcacttaacacaaaaaaatgttcttaaaaaagttacagggctttgaaggcatagtaaatttccagccaaaagcttctacacatctctcttgcctagatatgattgttctctaatccttaccataaagagcagtgttctttaagtgaagcccctcaaaatgtggcagctgcacagcaaactcagtcaaatgcgctccatctgcagcatttgttctgcagatcaaaaggatatattaattagtgataatagtgttcgtatgacaaacatcattagaaaacttccaaaaacttcagataatgttagtcagagcagccaaaaacactctgggttacttgcagtttcattttgctttgcaacaaaccagaatttcaagagatcagaggtgttttcctttgtacagatttttcaagtgaatagtgatcaaaacaggtccacttgacaaaaaaaacacaaatatcattattcatgtgtaactatggaaggattgcagcacaatgaactatagagaatacagcacgctttcagtatagcacataaacaagattcaaacaataagaccatggttggaacacatggatcaggtaaatcattttattgtagctatgcaatcaacatagatttgaatcatcttcccaaaactcaaattcctagatttcaatcatctgatattattctccccctacttttctccactgataccaaacagcactacatgaaaaaaaaaacctaaaacaagcatattaaagcagatggttaaggccatgaacagaacagttccagagaaggatcaacatagcaagacacaaattccgatgttatgtcaaaaccagtaggcacgatgtgctgaaggtttagggctcctatggatcacaaggattttacacgattttcaccaaactaattcaacacccacaaaagtcctccaaaattcctatgttccaaagaaggccttaaacgcctcaaagaattgcagatctataattgttgataccctagatgcaaagcaccagatgaacagagcaacaaaccattaacccctccaaaatcctcacggaaccacctgtaccaccaacagaaaacgaaaaaaattagactcaggcctagatctatacctccagatggacagatttgcgaatcgctcgctgtcctatcagttcaagagagattcagcattgattgcaaaagagcgctgaagaagcaagttagagatgatctctccctcacccttcccccttccctctcttagatgatctcttcctaacccttcctcttttccacctattttttcaatacttcaattgaggagatggattgcaaggagtctaggatgataggccatatataaagggtaaggtctagggagtatagactaagtctaccaactccatgaaaaggcacgcgaaaattgtgacatcattaaaataaatatatatatatatatatatactaataaatttgatgtcataattccagcacatataatctgacaaaacatctcacttgccaattgaacaattctaaaaaaataaattgcagggatctagttgaacaattctaaaaaagccgttgtgcggagagctacaattctcacgtgccaaactccatacgcaaaacaagtaagaaaatactttcttcaatctgtccaatccgattttttactccaatcaagtagtggaaactttgctttacattccaatcattcatccgtatgtgttttacttcctgattttatgttattgtagctatctaaaatatggttcgacattgtttgtccatcaaggaaataaagattagctatttcaatatgtctaaatctatacgttcttcagtgatgtgagaaacgttttgtgtttgtggtatgttattgattaattctatatatggtcgtcttaccatcatttacaagtagagatatgcacgatcatctcttactaaatttacaactaaccacgattaatcgtgtggcttgctattcagtcaagtcgtggcactctagtcgtgtggcttgaccaactttacgactaatcgcgggacttggtaacaattggcaatatgttgcgctcaacatgacataaggcatgtcccattggccactgccaatgtcaacaccaagagaactcaagataagagtcttctttttctttgacaaggccagtgatggagccgaagacgatcgtttgagatggagttggcatgggtgtcagcacaactattaaaatgccacagaaaacaacataacccacttgaccaatgatgatataatatcatctaccatagacgcaatgttattgaaggtggttgttcatgttgtcaatggttgttgtgacgttaaaagtgtggattgtagaaagatagaattagggaaaactcttcacatatatggtgggtgttggaacaaagtccaaacagtgtattcaatgtgtattttgtactcaatctgtccctaactgtggacaatgcttacatatttatacatggggtacaagaggaagttacatctttaccctagctagataagatgtagagcggctggccggtgggccagccctagggcagtcggtaaaacccctagagacagggagggctgcgcccattaaggaagcgatgacgcttcccgagggtgatggctattatccaggtaaaggcatgcccccggataatagcggatgccatcttgcccttgttaggatgtcagaggtggttggcggatgcgtagtgcgtattaatggtgccccactacgctcgtgaaccatttctccacgctcgagtattttagctccccggacacttcgggccttcgatctgcttcggagccattggttagctccgaagccagtgattggctctagagtcattgattcgctctggagtcattgatctgctccagagttgttggtctgctccggagccgttggtctgctccgaagcctatggtaggcactggggcggttggtcagcttcggagttggtgatgtgcttcggagcccttggtcggctctgaagcctttagtcggactcgatcatcggggtagctgttgccttcggtcattctcccttggtggatggctccgggcagagtttccctactgacggaggccggctccgtcatccggagccattcccccaacagtgggggcggttgttatatatatagccaatataccggtagttacaagagatcctcgaaaagaggagatagaaacaaaaaaaaagttatacaatatacactttcctccaatacccgcccgcatttgcaacgggaggatcacaaacgcaaagactcgacctaaaatcagtaaataactaaataggtaggcttttggtcatgatgtacgcaaactggtgagaagacaggacatgtagcacatgaacctgccccaaagcaaccttctcagaaacaaagtgaatgtcaatctcgatatgcttcgcgcgacgatgaaccggattggttgtcatatagacagcactaacgttatcgtagtagacaatgatggccgaatatgaagtttcttaagtaattgccacaaccaacaacactcgacggcgacgtgggttgcagcatgatatttgcctcagcactagaaagggagacagtggtctggtgcttcgaagaccaagcaactagattatctccaaggaagatgtagtagcttgatgtggagcggcatgagttaggacaactagcccagtccacgtcggtgtaagcctggactttgtcggtgccaatgtgaaggccgatggagagagtgcccttcacgtagcggagaatccgcttgtcaaggatcatgcatgaagaggctcacctgttgaacgacatacaccagatccggttgagtcgacttgaggtagtgcaaagcatcggcgagactcctatatactccactgggttatcaagaggtggactgtctctgacatacagcttagcatgtgcatccgttggtgtcgcagtagagtagaactcgaccatgcctgctcgttgaagtagatccacggtgcattgtcattgagacaggaataggccgtcggaggagcacttgacggagatgcagaggaagaagtgatggaggtcgccaaggtctgtcatggcgaactcggagtgcagacatgtcgtcaacgtacagaaggtgtgcgagatcgcatggccaagaggacgcagcagcgctagggcaccggaaaaggtaagaactctgaatctaataccatgtagaaagatagaattagggaaaacggctcacacctgttgcagggttggggaggggggcagttgtgatatatatagccaactaggaccctagccaatataccggtacaagagatcatcaaaatgagatagaaacagaaaatgggtatacaatctacactctcctctaatatggatactcggtaatctgacttgagccttggctcataacatggtaagtactaggtggagatcatacaatattggcttgaaggagagaagcacatggggagagaaactatagactttgcgggagtactactttgttgattgttctatctcaaacatggggccctgatagaaaatacctcctaccaagagcttataagaggcagaaataactacaaaagatatcagtctacataagtacataacatggaaaaaggaaattagacatctaaaaaagcaacttttaatctttgggattgaccacctcggctgccacgataacctatgtcttccaattccttaatggtttccatgttcttataaacatttccccaacatctcctattccatgttcttatcaaacattttcccaacatctcctatacataaacagaagacatgtatctgttggcattcattcaagacaaatatgccaattatgattggttctaataggcccatatgcctacgagcccaacaacagtaacattttatcgtcaaatcactatcatgagatcattagactacaataataggaccaaagatggcctcccttagtaaattataaaaaaatatgaagtgctattccactcaaacacccatgtcaaaaaaaaaattaccaaattaaacacctgaatccaaattgaatcatgtccatttctaattagtaatatgcatgtttaattgccaaatcgaacacctaaatccaagtgttgatttctaacgaaggtgcccatgtccaagtagccttaaaagttaaaattaaatggtatgtactcttacataaaacctataagctacaaaattatgcagcaagccatactatgctgctatttgatcaaatgcacatgttggaagagcaaacaacatcctctctacatgatgttagccttccaaaacggaagtcttcgtacgcaaacaaaggacagtcactttcacatcatactatctaaaaagttggtggaaatgtagaaaaaaagatgcataaatctattatataaaaccaatagcatagagacaaagacaatcacactggctagtataggcataaaaggattcaccgaacaattgcaaaaaaaaaaaaggtggtgatgattgtaagcagcaatggtggcaacaattagcaagatggtgatgaaaagaagactaagatagtcaagtcacaacaaaggcaacaaatcagaagaaggctaaaaaaagaggactcaagtgaaaaactgaatcgatgataacaggccatgataaatgcggcagaagagtggagattgaactcggtccaagatggactgtgatcaacctaaaagaagaacgagcatggtacacatcattagatcagataagaatggcaagtgccaaaccaaggaaataatcaccaaatgttctaaatttggaatggcttcaaaaaaaaatagaaggccatgtaactttgattaaactaaaaaaatcctttaaacataaaaatccaaaggatgtagaataaggtcaatggagaaaagctgagaatgtgatatcatgagggaaagcaagtgatacaagtctgcccatgaaacagtaactcgacagcacaagatgcagcaaggaaacctgaatggtcattgcaatgaggctagaaacaccaacacaagataatgcaacgcaactggtatcgctttccatgtaggtccaaatggtgcgatagaggtcatcaatgcacaacagcgacaagatggtgcacgctttagatccaaaatggaggatgaaaaggtagccaaaagtggcattgcaattcaaacaccacagggagcttactaggtgtaagtgtgtcaattacatgggctctcccctgaaaaaccaaagcactgattcattctgatagcagcaacccccaaaaaaacaaaagcattgattcattccatgccaactacggattggtggagaagtacagagtttctttgatgccgtccatctcttgtaacatgctaggaaaatagggattcatgaggactcagtctagaccaaaagcaatatggtaacagaagggaactaatacaaactagtgctctagttctcttcccatgccttatttgtttgtggcaactggcaagagcaaattggtgaagccaactagaggttttcagaactatgctgtgttaccatgttagtagggagcatatgtagtcaagctaatgcattcatggatagaccagaagccaagtacacaaaacacacgaggacccatagtctagaccaaaaccaatatggactataagtaaactacaaattgactataatacatggacctgccaatatgccatgaagagaacatgtaggttcctacatgaatcaactgagaatgcaaattacaaatgacataggaaagatcctaagactacaacagaaaatcaatatggactataagtaaactacaaattgactacatggacctgccaatctgccatgaagagaacatgtaggttcctacttgaatcaactgagaatgcaaattacaaatgacataggcaagatcctaagacttcaacagaatataataccattgaccataccaagcaaagggtaaaagcatcaaatcatctgcacagtgcaatatatctggttcgtagcgtattgggaagaaaagagacaagcaacagtgtggcacctaaatttagtaatcactataacaagaagctataaaaagactaaggccactgccacatagtgctaactatagaattgaaacccagtcatttcggcatcaatcatgcaacaggactaagatccaaatgcatcaacagtcaaacagagcagataaacgtaacacacatattaagtctgtaaccatggcaaacaatgaattaaaacatcaaccataacaaaaaagggttcatagcgtcatcccacgctaacgggtgtggcttagtcccaccaagaataccatctgcagagcaccagcatttcatcgcaaggcggcatgaattttcagcactttttagaccaacggatcaagtcagccgtaagcaaaaggagttgaggaaatgagagctgagataactgcctggtgacgtctctggtggcgacggcgacggggtcctccgcgtccggggtgctcggcgggggcacgttgatgtcgagcggcacggggccgagcttccacctgttggtgcgggcgccacgcatctcgcactcggggcatatccagtcctcgttggcggtggcgcggggccgacgcgcgccggggggggccggcggcggcggcggcggcggcatgagcggcggccaacgcggacccaggcgaggtggaacccgcgctcgcaggagtcgcagacgatggtccccccggggttctcggggaggccgcacgccgcgcacgggggcggcgggttcccacgccctgcctcccccgggtgccgcgccgccggcggcccgaacggcggcgccctcgccgtcaccgactcgatcgcgctcgccgccgccaccctcagcgcctgcgcctgcgccaccgcgtcccgatggatccccatcgccacctcacgcgcctcgtaaggaagcatccccacctggctcaccacggcgcc

SEQ ID NO: 32540 - DNA, 32809 bp, Oryza sativa
tggggtgggggagcgtggacgcacgggttgcgcgtgccccggtggtggtggctgtgtccgtccgcgcggctgtttctggtggtgatgcgctggtgtgttttggctggtgtacccggctggtgtacacagagcagcagtaattttcctgtgcaaaactacatgaacttttttcatagaggtaattgtggaaagtattttgctgggtttttagtggctttaatgggggttattaatggagcagatatcagtttgaaccccagatatggaagcaattaatgcatgcttgctgtgaataactggtgtaatacaggtggctattagtgtgaatatgattttgcaagattatctggagtaattgtgttttctttatatggtttgtcataattcagatttttggtgtattagtggaaagtattaaattcagattttcttttagtgacactccctccgttctaaagatataagacatattagcattttacgtggttagcattgtggctaagggatccctcaattcaccggtttgcttaacatagaatgcaagccatcaaaactgtgtgggtgatgggcgagcatttctccggcctaggccaaaaatgaaccctttcggggaggtctatatgtccatcgcctgtctatgtatcaaagccataagaaatattgaacttatgagactctactagggtcaattggctcgggtcgaagtcgtgtctgcaaagctgctcggaggcagccgcttgtcccacgagttgttacatggggccaactagctagccacctaggaactaggttgtggcaatgtcttaagatagaggtcgtgactaaatactggtaggggaatgctatgcatggcttgaccgaaaatgagtcaaggtgagtagggtgggtcatcctctcctagggggccaccacatggtagcctctaggaaggagatggttttcgcactctagctgtcttactgcgataacccattagcatcccgggaaggagtacatgtgttctcatggtaagcaaaacgggttgatgtgtatctatcaatggcctatacccgacaacggtatttgtatagtatagggaacgctggtgctaaagtatacgcgagtttgcgataaagtagacaggagacaaggatttgcatactggttcaggccctcgggatgaataataaccctactccagtttctccactttatatgtatagttgttatccttcgagaaacccagacacttgctttgtatttcttgctcccaagcactcttgagcacatcaagttcacccagaacctctagtcaatcagagacttgtggtttcccacgtctattgaagcccatctctccgacatattatacgttgatcattagtttatttatagtatacaatcaacagctacaaaactaacattatgaaaaagtactttttgaacacaaatctaacgacatcacacacatcatgttgagcatgtactgtaatttaagtatcagctaaaagtaatatgaacacattatggtgatgcgctggtgttttttggctgggtgtactccggctggtgtacacagagcagcagtaattttcctgtgcaaaactccatgaactttttttcaaagaggtaattttggaaaatattttgctgggttattaatggctttaatgggggttattaatggagtagatatcagtatgaactcagatatggaaacaattaatgcatgcttgctgtgaataactggtgtaatacaggtgggtattagtgtgaatatgattttgcaagattatgtggagtaatggtgttttctttacatggttagtcataattcagatttttggtgtattagtggaaagtattaaattcagattttcttttaatgacactccctccattctaaagatatactagctccgtttcaggttataaaactttctagcattgcccacattcatatagatgttaataaatctaggcacacatatatgtctagattcattaatatatatatatatatatatatatgtatgtgggtaatgctagaaagtcttataatatgaaacggaggaagtaagacatattagcattttacgtgattagcatcgtggctaaggagtccctcacttcaccggtttgcttaacatggaatgcaagtcatcaaaactgtgtgggtggtgggtgagtgtttctccggcctaggccaaatacgaaccctggtggggaggtctatatgcccatcacctgtctaggtatcaaagtcttaagaaagattgaacttatgagactctactatggtcaattggctcgggtcgaagtcgtgtctgcaaagctgctcagaggcagccgcttgtcccatgagttgttacatggggccaactaggttgtggcattgtattaagatagaggtcatgactaaggactggtaggggaatgctaggcatggcttgaccaaaataagtcaaggtgagtaggtgggtcatcctctcctaggggccaccacatggtagcctctgggaaggggatggtttccgcactccagttgtcttaccgcgagaacccattagcaccccgggaaggggtatatgtgttctcatggtaagtaaaacgggttgatgtgtatctatcgatgagctataccgacaacggtattagtatagtatggggaacactagtgctaaggtatacgtgagtttgcgataaggtagacgggagacagggatttgtatactagttcagaccctcgggatgagtaataaccctactctagtttatatgtatagttgttatccttggggaaacccaaacacttgctttgcatttcttgctcccaagcactcttgagcagatcaagttcacctagagcctctagtcaatcacagacatgtggtttcccacgtctgtctaagcccatctttccgacatattatacgttgatcattagtttacttatagtatacaatcaacaactacgaaactaacattatgaaaaagtttttttaatacaaatctaacgacatcacatacattatgctaagcttgtcctgtaatttaagtatcagctaaaagtaatatgaacaccttatattttgggggaaaatagagtaatatcttagtgttaagtttagtgttaagtggtaactcaaaattgaaaatatctattatacgtaccattataatactacaaaaatacatagagaatgatttcattatgatcaaatactatggtttttggtgtgaaaatgttagcagtgactaacaatgaacaaaatataaagtggaggttcatgggaaggatgttagcccttgggggagaatcaccatcaccactatgttctcttaaagtagtataaattttcatattggtgttttcaattaacttctcaaaataatgggtctggagggaattaagaattggattggatttggtggggaatattcttaattatttaccttattaaaaaaccaaaaaaaaaagaaattcattgagttttgcaattatttgctataaacattttagaagtgctgtaatatgttttcccagttaaaaaaagttcaccacttgactatcatattattactctctccggtttttaatgtttgatgccattgacttttggaaatatatttaaccactttcttatttaaaaagtatgcaattatcatttatttgttgtgatttgttttatcatcaaagatattttaaggatgatttttttcatatgtataaaaaaattggatgagatgaatgatccataagttaatggcatcaaaccaaaaaaaatgctactgggatgcaaatactggaagcagggaacccggagaactggcacgctggttaaaatatctctacccctggtaagtaaaactgaaagactacaatatttgttttaaatataatatgaagattctatactatgaggatgagtggggccagcgacgtgggccatgtttggggaacccagccgatgcggtgaggcccacttgtcagtgaccgagagggacgagcgcggcgcacgggttgcacgtggtgtccgtccgcgcggctgtttctagggtggtgtatttcgctgggtgtactggctggtgtctacacatagagaagatatttcaggcaggttttaacttttccatgggaaattgtagcaagtgtttaatggggatatatttattgctatgcgattttcacagattacacggatttatgatctttgctgtatatgggttgtcatgattcagatttttggtgtattagtggaaggtaataaacccacatttatttagtgatactccttcggttctaaaatataatgttataaaatttagtcgatatagcggaatgacgaccaaccttcctaatcgcttctcattgatcacctaagacatgccatatgacgacataggacacatgatatttgctaacgaggttcacccaaacctacatccttgtgactatgattatggacgctgctccccaatcaacatagcaactatccgctacaagtctatggccacaccaccatcatctccccgtgtgactaaatcgtcatggttacattgtggtatccaactctaactcacggaaatatcatttatttattgtgatgtgttttatcatcaaatgtattttaagcgtgacttatgcaaaaaaaaaaaaaaatgacaaatggtccataagttaatgatgctaaatattagaaatcgaaaggagtactaattgtcatttctttactcagaatatccgagtggtaactgatgagtaaaaccgaaacactgcagtatttagtttaatataatatgaagattctatacaaatgtatttctcagaggttataattgtttttttttttcaatgaacatttctaatgtcaactatcctcatcacccaaaaaaaacaaagaacagtaaccaaatattactcgatgcatttgacatgaattattagcagtgattagtaatgaacaagaaactgaagatgtaacagaacaggcgagggcaagccgttgattggtggcatctgatgacctctaatgccccaacaatgcgtatttttgatatgatagtaaataatatttagaagaaatagttaaaatttcaggagtttaaatacaacctaaaacggttaaattgatgctaaacacgtatttgttacaagcatcaacctggtattatggtttaagaattaagagtaatatcgagatactattactcatccatgtcacggtttaagagtagtatcgagatattattactcatccaaagatttgcacagttcaacagaaataaaataacttatcttcggatgtcaaaatttacaaccatatggaggaagggagtgctggataacaacgtacaaaaaactccaatccttttcccagattctgcccaccacaaaaagttcaatctaaaagtaccggctagtgctaggcaaaccatacttggagctaaaaccaccgaataagattatgtttcacacgttatctgataaaagatacatgatggcattgcacaggttccactagaacgagttcataaaagggcaacaaaaggcacaacataatttacacttgagaacatatggcaagggttttatgctgcgatagggactttgcaggttgccttgttgtgcccataacccttacacctgctgcagcgcaccgcccttttgattgcgattcgaggatcagctggcttttcctttggtcttccaacctgcctccgggttagaatcggtgattgatgtaatgcctcgccttgtgatgggtcagttgatggagcagccacaacaatgtcaggtattggattgattgacatggcataggtcaagcggtagcactctgttgtgaaatacttggcacagaagtcaagtgggttatgatcagtgcgctcaaacaccgcaattgcatgtgagcatgggatcccagagacatgccactttctgcaggtgcagtcccatgtatcaatgttgacaacattgacagcgccatcgcatacctcaaacacattattgtttccgtcattgcctgttgagcaaacaacactgtgtgtaagagctttgcccatctcttcctgaattttctgattggttgatggagttagcggttccgtccatgaattcgaatattccctgcgcgtatacatcatctccatcaagttgcatctgattgtatcaaccaactgcactactgagagctcatatctactggggacccactgaagaattgtctcgggaacattgcaggtgtactggccaagtcgcgaccccttgaagaaggcatctgaccacttctcaggtttagtctccaaaagccattcagcaagcttatcagattcaactttgatgagttcaatacactggttgaattcatcaactttgcatgaatacatggctttcttaacatgctcaaccattgtatcttttagttcttcactccaactgtcatccaattgtgccttaaattcttcaataaaatagttgacatggtagccatgatagctatctggaaatataagagagacctcatccaacagaccacatttgccatttgatatgaatgttagttctccagacacaggcaatgaagcttttagctgttcaagaaaccaatgccaattttcttgactctcgtcgtccactacagagagtgcaactgggaacatatcgccttcaccatcaactgaggtagcagccaacagcttccaatgcttgttcggtttcacagatatcacatcaagaaagaggagaggtctgcagccatgcacaaaaccttgaatggaggcatgaaatgcaacaaagaagcggaattttgaatcttccaaggcctctactgttgccgcacttccagggtttgtctcgacaatcctttggcaaaaccaaggaagctggttgcatgcctcttcatgtgaactgtatagttctttctgggctattgatttgcctcgccaagcttgggagtaattcaggcttagcccatattcccgctgaagatcattagcaatatctcttggcctatagtttggactatcacgcaatttttccttaataacactggccacccacttttgagacgctagacgatgacttttgactgactctgattcacatgtatgacttccaaaaactttcttaatcatgaaatccttctttgcaggagacttggatgcatgtatacgccatggacatccttcagcggtacattccacagtgacacgagaagagtcattcttgacaaatctgtaatggaacctatgtgcaatggcatacttgtgtagtgcatcacggaattcctttggaccttcaaacacttgaccagctccagtaatcgcattctcccaacttgcacaaatcttttgcctcttagatccatctggagtagttgctgctacagcatgatctgcagaagcagcaggcaccacggcagatgtttttaccctgaaaaaaatgtctcatgtcatttttggatatccacttatgaagatgtttatgccagtcagaagggtacctgttgtcagccttcttcatgacataaatatatgttgtctctgactctgcatggaattcaaccatgcgttttaggtctttgtcattggaaattgaaatcaaagtcttgttattcctcggaaggaagtacttgaacacataggagtcaagtttgaggttattgagcgttgaagatatctcatgtttgaatgttttaaaagtccaatcacttttcacatgcatcgcgtgcgcctctccaccagaataggacatctgtccatcatcatcagttttgaattctccacctacttgaagaacagctactatctgtttgctccccatgacttacactttcctaagaagaggttcaatgaaagtgttaatgatttgcagaattaaggatgtatgctcagcaagttaatctacatgggaaagtacttattgtgcagccgatacttgtttaccagttaaaggcagtgcatcaagttcaagatattatcaggctaccatattgccgagtgaaaaacttaaagagttttgagagacacaagcagcaggccatccttaaacaaatggggcaggacataaaaacagcatccagcacatgaattatctagtctcactagaataatactactataatctataccactatattaacagagatacagacagaaaataataacagaacattttttttaccgagtttcctggtatcctaatccttttaaagaagctaccacttaactactcaggcaaatgagttttagacagccaatcgtagataaccataaaatatatattactctctgttcagtcagatgattaattttgcgtgcaacaatttactatttatgtaagtgtacttttggtactggaatgctgggaacgcacaggataccctaatttccatattactattacatatcccctccatacatataggtttcaaaacttttggacctaatttcaattagataagacttgaaggactttggcagaaactctaatctgcccatcactcccttacttttctctgcattgcttacaacagcttattattggtagagaaaatattcttcttaccccttatcctcccaacagtttaatttagttatataactcaaaacaaaaggtcccagtgcttaaattgaagaatatggaactgagggttctatctatatcacataaagtggaaaacttgaaactggagaaatgaccatccattagtttctggacacacttttcgccaccgtggtgagatgatgattactcatcagatcccaaacctacgcccaaaacgtcagtgatccaaccctaatcccgtctcctctccatcccccaggacagaaagatcacgggaaaccctcacaaaatccacaaattctacccacgaacagctcaatgtctaaacattcatcaaaagcaaagaaaccccccaactatttccacaaattctttcgataagccattatatttattacatacgaacgcacgaaatgaagccccccaattatttccacaaatattttcgatattccattatatttatttacatatgaacgcacggaatttttaccggccacggtgaagcttccacagctgcagttgccggagtcggggatgcagtagtcgcgcctccgctccctcaccacccacgccgccgccgccgccgccgccaggaacaccccccaaatcacggcctcacctcccagcccgcgagcaccggcggacggagcgccgccggccaccgtggcgcgcggcgggcgcgcgcgcgtgcggctaggctagggtttggagctcgcggggattgtgctcgtgctcgtgcagccgccgccgccggctagggtaagggaaggaagggggaggagaaaaaaaaatatagggaaaatactaataggtccctgcacaaatacagaaatacaatcctgtcctcctcaggtgggccggaattttacaatccggtccttctcgccccattcctgggctcgtgggctgaaatagcacgaaaatttcagtgagaaatccgaagccgtcttcctcctccccccacgccggcgacgacgaccaaccctagacccgccgcctcctccgccgccgccgccgccgccggccaccgcgagaggtaacgacctctcctcccgcatctccccctccctctccttcccaccatggggagcaaggggagggcgccgccgccttaccaccaccggggggcgcacaagatgatgcaccgggacccgtacgggggggcaccggggatgccggggccgttcccgtacgacatgctggcggcggcggcgccgccgccggagatcctggagcagaagctgatggcgcagcggggggagctgcagaagctggcggtggagaacgaccggctggcgatgagccacgactcgctgcggaaggagctcgccgcggcgcagcaggaggcgcagaggctgcaggcgcaggggcaggcggcgatggcggccgaggagcaggaggcgagggggatcctcgacaaggtcgccaagatggaggccgacctcaaggcccgcgaccccgtcaaggccgagctgcagcaggcgcacgccgaggcgcagggcctcgtcgtcgcgaggcagcagctggccgccgacacgcagaagctgagcaaggacctgcagaggaacctcggcgaggcgcagcagctccccgcgctcgtggccgagcgcgacgccgctaggcaggagtatcagcacctcaggtgccgcgcgatatgaaatgctccgcgtttgtgccttttagttatgaatttacttgatttatgactgacatcgatttctgcgtgcgcaccggtcgaaatctcagggctacgtatgagtacgaaaggaaactcaggatggatcactccgagtcgctgcaggtgatgaagaggaattatgacaccatggtcgctgagctagacaagcttcgtgctgagctgatgaacacggctaatattgacagaggaggcatgccgtttatctgttgttccattttttttaccacaatttttgggtagcatatatagaaaccacaccatgagacattttctatgtgtaggtatgctatacaatactaatactgctcaaaaggatgatggcgcgcctagtcttcctgttggacaaattgcttatgatagcggttatggagctgcgcaggtgagcatctttataactcctaaatagataaccagcatacggtggaacttattattttgtgaagcatgtttcatctggatgactatgtatatcatttcattgtcgttgcaactccactaggcaaacctcacttctccatagccttcagaatttatctgtcatggaagttgagcctttttgttgttataccttcatgggctagtctctatcatgaaagcacttctactatgatgtttatgcatataccttgaattaagttatgcacagtagcacaggtcaataaaccagtaaatagcaagagcacgaggatttggcctctgttagttccaatgtcactggtttaagtttttaattattattttgctaacttttgcggatattgttttgtttatttatacaattgccatcttattttcagtcccaaatattaaattcttattctatacttgtgtaattaaattgatttatttgcacaatcgggataccccttgccattagctagttttgcgcttttgcttggttttaaattttaagacttcaagttatggcactgagttatacaaaatacattgtaccagtttattcaaagatcattacacctactgtagaatgagttcataacaaagatacgattgaatcaaggatttggatcaaatcctaagctctcatgggcttccaatgcaatctcatcgaaagtacagaataccgtaaatgaaagcaggactaactagcttttttacttttgttcattgattcctttgtgcgtttcttttctgtcctgaagttaatggatgcttttcttgcggtgcacccttgatcataaagtaattacgatacctttttccttgtagcaatgacaatttcatattttgtcttctgcttttctaactggtgctggagcaatctttatgtattagtaacgatggtatttcaaatgttattgcagggaaggacaccacctgctggactgggagactctttaagcggaaacccagctggcacagctcctcggactggatttgatccatcaagaggcaatatgtatgacgcttctcgtattgctagcttcagttcttcaaaagctggaggacatgatgcatcaaggggtgccgcaggctacaattctttgaaaggtgctggatatgatccttctaaagcacctgcacttggaggacaggcaacagctgcagctgctcatgggagtagtgctgattactatggatcaaatcaggcaacaccaccttcatatgcttggggacaagctgcatccgcttatggatctgcacaagtgccacagtcacatgcatctggacctcctgttcaatcaacatcctacagtgcaacaacagcacgtaactttggctctgcccaggctttaccatcatatgcacatgcacaggagcaaccttcatatggacacgcacagctaccatcctcatatggattagcgcaagcatcatttccatttgccccagcgcaaggggtgtcaccctatgggtcaggtgcacagcctccgcagtatggagctgggcaagcagcaactaatcctggcagtgcttaccaagcacctcatggacgtaaataaatcggcaaaagttgtctactgatggattgttattggcaaaagagacaatgcgctgctttgtacaccagagttcagtttcctttccacagctaccaaatcttgtcgtttaactgatatgaggtgattcctgaatatagtctggagaagtaatgctctgcaagatgggaatgcttctgtaaagtgtaaacttgtcgtcggtgttttaactgcctttttttataccttcaagcctccaggttaggcaacccatggaagcatgaattctgacaagagctgtaactgttgattcttatttgatttgtcaaagttagtcgattgtttgttagttcaaactcaaatgctgcatgtatgatatgagatatacactgctagttctgggaggttaataatatgcccgtgctggagattctcaatgtttatcatgcatgcattcgttctgtttatcctgtaaatgcgcatgcccaggatgcatacatccgacattcccaatgacagcctcaatggcatatgttagaagctgaaaagtttggaaattttgtactggagttgcagcctcctgttgtgctctggttttcaaatatgttttcagatggacaatcacatagttttgaagcaatgctaacatttttttgacataatgatccaatttattgaaaaacaatcagcactagattggttgcattgtaaagacaaaaaacagtttattccttgatgatgttccatgcatctacctcgctaatcagcgataagctagaggaacagcagctagcaaaaggtacctacctggaacaatttcagtggcagagggcacaacgcgaacgcaagtaacagccacccgtttcactagttacagcagaatgacagattgaacagcacacatgaatccctatctgctgcaatataatgcactatgaatccagcttcttttttttttcttttacctcagtgcaccagtggaaaattctgaagaaaattcgattgaaacgtctcgcgaaccgcgcaattcaatggccatggatgcacagaaaattttgccaggacaagtcaaaattccagctagagttcttggtgccggcactagtatatctatggctcatataagcttcttgctgaacttgagcagaataaattcatacacactttatagaaaaagcagaggagaaaagactgaaatttgttctaactctacacacaggggaatatgatagggcctatactgcctcaagtttaaactcagtattatcaggaatcatgatcaggaggggataacaatgaaaagaaaagaagctttttacagggcagttaggactgtacaagtgaaactctgaatttaattggctgataaaaaaaaagggtatcactgcctaactctcttctctggactctggaagtgctttattcataatattcataaaggcaaaatcttcttgcaacagacaatggttgataaggtataatgttactgtgcaatttattcaacttgtgtcaaatcgctcgtatagttcgtttgatagcgcgatagctttaggaaaggtgatccattaaaccacttgatgatgtatctatttgaaaattgatttctttgtaatctcgttatattgcttttgcgatgatgccagtcaacatctattatgtctgtctagaaaatatagctgccatttagaaacataatagatgcactgttaataattttgtcaaataactcttgtagcaatattgtttgggcaacagtgcaatgttgcataattaataaaaaaaaatcagaatatactaaattcggcagttggttaatattttctttatcaaaacaggtcattgctttagttcttttaataaaaaaaccaccctaacctcttaccggttgttttttttcttctcagaattgcatatcggaacctcataaactaagtgagatatttcatactctccatgttactctagtgatgatgcttgctttatactttctaggttttgtaagtagtaaccaccatttgtaagattctattgttcttcatttgttcggcacgtacaaaaggaaaggaggcgataaattattgctagtttgatcaaaaggggtaaacactttgtcatatgaaaacaattctcagttttaaaggtgagaaatatcttaaattaatcccctctttgttctctttggttgctatctttctttggaagccatgaactcactctcctatgccaagattcatctctagctgcggcttccaatgccatctggacacaaagacatacagatggagatggttctgcattattgcattgagaatccaaattaattaatctaacagagattatgacatgaacatatctaatatctttacatctaaatttgtagctctcgcctaacaactccggacctcttctcatcattaggattctgcctaaaatttgttatgcatgatcatcccaacattgcgattacagcaagaacgcattacatgtacggcgaggactaaattaaataatgaaccaaaggcctaaaagcaaagagatcttgcagtttgcagcttgtcttctgatacaactaggcaaaaatttatctgtagaaggtacttgggagactgcaagactggagctgtatgcagcaaagcttctactgcaatatgctgtatgatatcttctttgggtggttagaatcatttacatggcagaattccctttttgactggtctttctcagtgatcactgatcagtagtaaactggtataatctatactatactgaattacagattagtatagagaattatacgcggtatatagctaaagggagcaggaataatttgctctaaaactttttgcctgtctacttgttaggcaccgaacatggtactgaatttggggtaatgtgaatgcttctttttaagtgttttttttagagttttgattaggatgtaagatcacggaattgcatgctaatcaagatttgttcctcttgttctcctaaacaggaggtattggtccctgacttgttagtactgaaggtaaagaggtaggccaaatcttggccatgtctggttattaaaatggccctgaaatgactaaacatgttagtgaccctaagatgctggcttatcgtcataaactgccttatctaaacagtttgttctcgcttcccttatctgaatttactttaatcagtgccctaatggatgatgcaaagagtcactgcatgctgtggattgtggaagctcaactgggatattgctcctatgattagcagttaaatattcatgtcatttctaatccgagaggagtgaattgctgcacagctagattgttcagagaacaactcctgaagtctgaatgatccttttggcaattttttattttgactttttttggaaactgtaattgtacagtgtactttcagcatcagggaagaatgcatccttgcattgctgcacagctagatttgttcagagaacaacttgtccttttggcaatagttattttttattttgattttttttggcaattctaattttacaatctactgtgagcatcagagaggaaagcattgctgcacagctagatttttcagagaacaattccagaagtctgaatgatccttttgacagttgtgatttttacaatgtactgtgagagcatcacattcagctgcacattactagtactaagaaaatgattaatttttcttgcaacccaagatcaaaagagtacctactacacctaattgtccggtcaaagaaagagggtggctgaggttgattagaggtaaaattatgcctaactagtagtagcatgcatgccagataatttgctttctaggacttccatcaggaacttctcttcttgattagcgaaagagagaacttaccattcactgatctccccaacaaaaatcacatttgaatcagaagttggaagcagtttttattggtaacgcttgctatatgaaacgctaaatataaacaccatatttatactaatccaaaattccaaatcatactggagcatgcaaactttgaagatccgatgacaagtaactgcaacaatgcatttcagaaatttcttctgtgactgtaacttcagaaaaatttcatttgaacagaattcagaagctcacctgaatttgactcctaaaaatgctatccagaatgcacctttttgttctatagggaatagttagtttgtcatcatgttgtttgctgatttttttaaaaaaagaaatgcatttaactgtagtctgtagccacagtattccgtactagtaggccataatcactgtagcagaagatctaggccattcttttcgcagtccaatccaacggttggaatttatcccaagacaggtgccttcttattctctacgtacggtaggcaatcttcgtctaccgccgtagttacatttggtatattagcttaatgatttttattagggcctattttgtcctagcgtctaattgagtgattttacggctattaagaatatatcgactgtcaagcagcataattttaatcttatggtacctcagtactttggaaggtactaggaattatccttttctttacaaaataaacctccttctggtattttgccattttttttataaaggaagcttttattaatctcatacgattacatcaagttggctattttgccaatgcccatgagaatcgtttgatttagatatcgacatggtctccaagatacaactttaacatttaatttctattataatatattttacaaacccgataaaaacaagatatatcgatacatacaacctccatgcatccactattaagatgaacatttttctagacaggctaaaagtattttcatagatgtgccttgtggtcatttctaagcaaaaggctgtacaaacaatcgtgtacataggcggccacttaacatagccgcctgtgagaattattaatacatgtagctatttttaagtgacctccttaagagccccgacaacttactccactgtctttgataatatattttaaacacagtgaattatggaaatggtcctatttagatagacggtccacttaaattgtttctagtaacagacaatgtggacctcacctggcgttctccacatttgtctcctttcatggaatgcccatggagtttttcttgggggtagggaggagagagcacggggaaaatttcatagtagtgatccaatctttttttttctattttcaatatgattgaatttaatgttggagtcgaaaatatccaaaactgacattttcatgaaggtggtatagtgtaatccatcaagtccaaatgctcaatcaccaaatcatttgtcaggtcctacagaccaagaatccattgatgattgatccatatttaatctatacgtcatacatatatactccttgtgaactatagcaatatttcatggcaataatgcaggctcttgcagatccaggtccatcaagataaagaacggctgcaaagttgcagcaacttgtgtgtggtcatgtacatctatcgatcagtatataatcagctactcatcactccgttccaaattaaactgataataaatttaaataagtacgtattcacatttgttgttaaagtttattctttttagagagcgtatctagatagctcatcgatcctctatcaaagggattgagaaacgtacagtcaattcccaccatcgaaactgctgatgtacatcgatcttatgctagatcgatcagtaatcaactactctctccgtccaaaaaaaaaatgctaaatgaacttagataagtacgtgttcagatttacttttttattttttttaagacggagagtgtagccagctagttagctcatggaacctcctgcagatcaccaatctcaagggtgaaggggtcgagaaacgtgtgatcaaatccccaccgtcgaaaccgcgcaatagcagctaacgcgcgcagctgcaacttgcgcgggaataatcccccccgttcgcgcgtattccgcgtgcgcttcttctccaccatcctctcttcccacctccacacctcgatcagcgcggcgcctataaattcaccacctcccatggcgaaagctaagcaaattaactaagcccaaccaaccactgctatagctagctagctagctcgatcgagtagctataaactgcttgcaaatgggagggtgctgctcgtcgaggtcgtcgtcgaccgagctggacggcggcggcgggtacaggccgcagcagcggcgggtgcggccgagcgacgaggacggcgagtggccgctcgccgggcggcggacggtggacctcgaggcggccgtctacatcgccaagttccaccagtaccagtccaactgctgcgccgagcacgccgccatggcgccgcccacgccgcgggctcctcctccggcggcggcgcacccgcctccggcctgagctccggccgccgccgccatgcgatgcgagagagagatcgatgcagagattgggttgttgttcttcggctaagtcttaaggatgaagctactaatgaataattaatttaagaggtgtgtgtgttaattaattatactggtataattgttagtactagctagccaataatactagtgtatgcatgcagcttaattaattatgtaaatttattgaagaatataagtggttttggatgggaatgaaaatatgaaataattatcactctctggttgatgttgtgacagtgctacaaatgtatacaatcagttttaattaatctcttaggtcataacaagtgaacacttcgcacaaatacatgtgtatggttgaggagaaacaaacagcgtgttcgcaaaaaataaatataaataaataaataaatcatatatataactgtgatttgaattatatcagcatgcatgacgggaacaagcagtggcagagctagcattaccgtcgagtccatatgactaatagcgttttttttttttggtgatcaactgatttttacaggtaacgacatttgtcaatagtgaagatggtagctgcaaagtccaggcgactgtctgacctgcctaatagttctctctcactacaaacaagccaatatatagataggggtagtgaaccctccacttatactcgggttaaaatcttaagaatgaagttctaatattaatttagaatggagaatttgaacccgggtgaattatagcacactaagtgtgctaccagtgctagttatttggttatgagatcagtaaaaaatcataaatttttcttagaatgcgattatgcacatgtatatgagtatatccttcctcagtgaacgctagagcttattgtcttctttagaaaagaagaagaggaggaggttcatgcgagtacgtgacggaatattgaaactatggctagatatatactacctttgtttttaaatgtaggatgctgtttattttaatatgacatttgatttaaccattcaatttaattaaatattaggcttgtattctttttatatttacactaaacttttaataacacaggtaacaaaacattacatataaaactaacaaaatcacacattaaaatgatggagggagtagaagtttaaatcgaccggacgtaaccggtatcctatatacatacttatatagttcatcaccactaagtgtagttaatgttatttctctcttctcttattaagccacatcactccaattatttctaacctttggatgatagatctatggttcaaattgtctcttctttcttctctcttaaaaacatgcaatctcaattatttttaggctcaaaattgtatcaaattgttttagttttgataatcaaattacatcttatttgtacatattatgcaacttaattttccgcagcaatgtgatggagtattcatctagttaaccagattggccggtaatagtattgatatataaatatacgatcgtgcatgtttatatttgtatttgccctgctccggagaaattatgattagagaacgagcatatatttaacttgttaggtttttatggttgaatttattgattaggttcaaattctagatttaacagcctatgtttacagttaattattaggttcagtgtgcgtatgcgtattgatagcggtgagtgtgcacgcatatatgcgtggatgcttgtgcttgtaccgtgtttgtagaaaaaaagagtaaaagtcatgtttgaacttagaattagtgttttgttcaagatgcgttttggatcaggtgcgtgcattgtatttactaatttgatccaaattttattttcttcgtgcatcttctggcggtattttacttctgagatttgatcgatcgcgcgctggcattctcatgtagcttattattattatttttaactatgtagcttatggtagaaataccagtgatttacttcgttaggtctaactcagtaaaattcagtttatacatgccaacccgatcgcgattaatttccacgagaagcacggcttattccacctgagtaaataaagtgcaaattgtgaggaatttacagataaaggaaaacaaaagagggcaccgaaggtgttccacgatataaatccaggagcccaggtgttttgggaaataaaaaaatatcttccctggaaattccggtgattaattaatttataatttacttttactcatagctggtttggttctgggggagcataacaaatgtaagaatattggcatatttactgtcccattgtttgctcatattccctgataagccaaagcgacttattagaaaataaaaataaatttataggtgaaagttttatatatagcttcttggtgacttgaaagttaatgttgaaaaataaactacattgagaatatgttaaaattagtctcaaaattaagtttaaaagttctaattttcgctttatctttgactgattagggcatccgatgggatccttactcactttcttctttagtgaccttgagagcttttgtcaagttttttctggtccgataagtttttcttttcactaatctctctgttatacaaccttcgtcatttaaaaatatctgccatttaggataaaataaggtcaagtttttaaaattccaaccatcaacaatttctttaatgcttaatttaaaccaaaacaaatgatagacatagatttgcctccaaaagtattattataatctatactgctgtagaagaacagcgatgaatgttgtagttctatacattacaccttaaaaagctttttagtattaaaaatcaatcaaatctagatggatagccacatatataaaatcaaattaagtgaatatttcctatgccaaaatgatatataacatattttatgaggaattattttaaaatttattttaggtattataatatattgttttatctatagcaaaagcacaaacatttggctagtatcataaatttattagatttggtaaatttatttctaacataaaattagttttcggaatttattccacccaaataaataaagtgcaaattgtgcagagtttacacaaaaaggaaaacaaaaaggagaagaaatcaatcagaacgaatttagagaatgccgaccaattctgttccactacataaatgcaggagcgcaggtgctttcggaaataaaaaaactttctacaaattccggtgattaattaatttatgatttatttttactcattgctgttttggttctcggggagcatatcaatggtagtaatttgtaagattgtcataattccccactttcttctttagtgaactcgagagcttttgttatcaagtttttctggcctgataagtttttctttttgctgatctctctgttatactccatttgatgaaaatatgtttaccgtttaggaaaatatttggtcaaacctttaaaatttcagccattaataattttcaaatgctttgtttaaaaccaaaacaaactatatacataaatttcactgaaaagtgtaccattataatatcacaaacttatcatattttgtaaatttattcggacacaaacttagttgctggaatttctttaatcaaatttgtcctaaacaacaaatatttttgaccggaggaattaataatttatattttgctcacaggcgtcagcagccagctcggttccatcacctcttcctgttaggtctcttagcctcttagggcttgcttagttcgtgaaaagaaaagttttgggtatcatatcagatgtttgaccggatgttggaaggggttttcggacatgaatgaaaaaaaactaatttcataacttgcttggaaaccgctagacgaatattttgagcctaattaagccgtcattagtacatgtgggctactgtagcacttatggctattcatggactaattagagcaggtacaatagcaggctataagctagctataaacatattttaaggagataatagaggagagagaggagcagcgggctacagatttgtagccagctgtagcacggactccaagacacaatatgtgtatgacaggtgggaccagatattaatagtgtagtatgtaactattgtatgaattggctattaagttgactataggtgatttggagcgagtagttggctatactattaaacttgctcttaggctcaaaagattcgtctcgcgatttccatgcaaactgtgcaattagtttttgtttttatctataattaatgctccatacatgtgtccaaagattcgatgtgatgtttttgggaaaaaaatttgggaactaaaccatgccttagtaacgcaggaattctacttaaatttcacatgaatcactctagttccctgggaaattctcacaaaattcctctattctaaagaataccttaggccctgtttgtttcagcttaggattattataatctggattattaggagtaagctgaaacaaacagatagcttattgtgatagattattataatctgtaagccagattactataatatagtaatccactctaaaggtgcttttttagattattgggttgctaacagctaacaagcatctaataatctagagaaacaaacagctaacaatttattctatgccgacttattataatccagcttataataatctggctcaataatcttaagttgaaacaaacaggccttagttcataacaacttttatagtggtctcttttaaaagtagtactctacaatttgttaaaaaagacagaatttttatcgaccatttttttttctttttgagaaaaagggacacatgcagtctgttcttaccttatccatcaatcagggccaattccaaggtccaatcttgtgcgtacgtacgtaaatacgtgcaaaagccaaagtgtcatttcttgtttttctggccgatcttttgctgttctcaagccagtttaattatgcttatgccatgccactgaagtttcactagtggaacatcatgattccgttactcatgtctgatgataagcaccctagacgacgctagaggcatatgtatgtctcctggtacttgaatttgatctgtggaaagtatttttaccatttgttactacaattatgttgaattaatcaaagctactgaatttactgaagtttagtcacaattaatctactgaattccagtgaatcgaactatcgaattgaagctactgaatttcaaaaatactacctttggtttttgttttcgacaatattactcggtgtcaagaacacaagtatgattttagttttgaaataaagagttgatgttaaattcttgccatgtcgttttcatggtaagaaacatgttcaagcaagatcatttgaaacctatcctccctagaatcataggattcacattttcccggcaaactacagggatcgcatgaactacttgtctctgaactctcatcctctctttctccttgagctcccaaagaaaaaggaattcccttagaggtaggggcatcaaatccttcctcccggcaaatgagccttccctctcatctcttttttccttcatggcaattgtcacttttgatagataagaacaagccaatataatgatgcctgacaatccattggacctggtggctttcgatcgatctttcgaaagatcgatcgtcgctttgccgccaattgctcggaatcatcagttgcttttcactgctcagattcttgatctgcaaaatgccatagcttcagctagctcacagcagtacagcactcagtagtggcagcatctatgtatctgatgttcttagttgatcactgttcatggtttttttttgactgtccaatccacagattttaccaaagtagtgagaatgccggtgaatctctgaatgttccctgaaaaatggccgaaatgccatccatggaagaaaagcaaaatgttcccctggcatatgcttgtcactttcatcgtcccttgtgctgtgctacatgcaagaaaccgcagatttttttttcgataatggaattctgcaatccagcaagcaagcaacatagatattttgtatgaaagttgcaatctcaagcctctgaaaaatgtctgaagaacacagtaacacctacagagatggaattatgtcagagattttgcagatcatgtgtaccgattccgtcaaccttaccactaatccatcgaaaacaatgtcctcctgcacaagatactctcttgatgaaacttaaccaaaaaaataattccatcctatctctcctattcctatttgcaaattgcaacggcatcatctccttctcctgcatgtggaatgcacaaaaaaaaaatcctccaaatgcaagaaagctcacgagttcacacgcacttgcatctttgccattttctccaagagcttgatttcctagtaacttcgactaatcagagactttgcttaaggaatttgtcgagctaattaattagattactcatcaccactgatcagatgctcgtcgtcgttccccagtagctcaagaatctcacgaggttaattagcatttgcagcgttgctgcttgcagctggggcccggatcgcgcgacacattttccaagagacgctgcgacgtcgttctttccgggagtggagctggatcgagcgaggagaggatggaattgtgttgatgcttttgacaacaatttggaccatttggacggaggagagccgtctgaaaactgttgcagaagtgtgaaggattgaagatctctgaactgaatgatcacagctcactcatccatccatccaagcaggagtatataggactgaactttttctgtacctggaaagtacaggttgtgctctcttccttttgctcatgaaaaagctcaccatggacaaaacattcttgtgatcagtagtattagtagtatgtacaacctgtttcagtgacagcctagaataagaagagagtagaaaattctgtctgactgtaattgtaagtactagtcttgatttcatatttagaattacaggccgaactgaattccagaatcgtattgctcagttcattgaatttttgaaatcaatggacacaagttgtgctcttttctgtacctggaaagtacaagactacaagttgggctccttttcttttgcccatgcaaaagctcaccatggacaacattcttgtgatcagtagtacaacctgtctcagtgacagcctagaagagtagaaattctgtctcacagtactaatcttggttttatatttaccacggttcccgcccgaattacggagctaaccaaattccataacatatttactagtaattaaaattttgaaattaatcacagagtacaagaaattgactactcttgggatttgaagcaaatagtggaagactgccttttggaacacaacaattcagccttgaggtcaatttgggacaatcttgagaaggaagatgtccaatactaccaacgaatggattgcttgacaggaagcttcagtgtagtaggcagcaacctagacctgcagtgatctcaagctgttatccacagaatcaagaagcttggcagaaaggtgtgtgaccaactagaccagtcgatggacagaccaagcgagcgcaactgatcgtctgatcctgtactgaaaaattcagagcatggcgtcgccatgcatggacagtagtacagattgcagaacagaacatgttcttagttttgaagtcaattcaggcatgcaatgcaatgcaatttcaaatgcagacggcctcacgagctgggaaaattcagtgagcatcagcatcgatgcccttgcaaactgctaactctgtctcactgtctcactgtctgaactttatctgatctttcatgtggtagctaggccttttatctgaactttccctgcttcttctagctcttgttgctggatgagcagattgatcagaacgtccaaatacgctgacatggtagcatattcgtacgagttggtacatatgcatggataaggctagaaagatgtataggtctcaagtgttgtctttcagagaaaaaacacacacacaaggatatatagggatttcatcttatctgtatgactgtattgtagaatggacacatgagacgacactaggttgatcaattattctcctgtgtacaagaaatttgttatcctgtccaagaaagcgtagtcacctcgatcggttttatccgatgaaattgacacaaaacgaattaacttgatgaggttgaataagtagttgatcttatctaggatgaagaagaagaaacaattgcatgtatggtatcaatatcctcgtacgtgcgaagatatataagaatagttttgcttgcatgccggcagcaaacaggtcatttcaattggaaaaaggtaagaaaagatactgaaatactcctgtttggcatatattgtttcattggacaagattttaatcaacaattgctctaattttataaaaaattgtgtcaaaatattagtatattcttacatagtacttgttggtaaaagctctgtcataacaaaataaaatatacatcttatatattttaaaatggaggaagtacttgtgtaaagaagcatacgttaatattttttttttgcacacacacacatatatataggcatggataattaaatcacgaatatctatcaatttaaacaggagggagaaagatttaattttcaccaaagtaaaaactatatactgtcgaaaaaggaaaaaacagtctaaaaatcaactctacaaccacatcatttcgcttatagaaatgtagggatgcaaagcaagattcttttaccagcttatcctacttttagtgtatttttttaaaaaaaatatgtactattatataagaaataaattagcaaatatatttttgtacgggttgtgagatcgcccacttacgtccctagcaaaatggcttactagcgactacaaaatagtttatatgtaggtaaactttttttatatacatgtttttaacgatttaaaaacaaatactgaaaatatactacggtgaaaaaaagccataaaatcaaatctaaaattaagtttaaatttcaaattttcatttatgcttataactaatgagtcgaaaactaaacgatggggcaactaatgtataagcatcctaagtaaagtaaaatccagacacggacgcggaagaatttactatttaccattctcctaaaatgcacaatactctaaaattaaaccgtgttcttcggatagacgagagtcgtcgcgagaccagcaggctgacctaagtaattaaacaaggaccaacaaagtaataatacacatatactttcggctcgatcgatgatgaatgcaggcgtgcgtacgtacgtatgcgtatcatatgctatgcgagtgaagcgaatcagccgaccaggggttgacgactgagactcgctctcctctcggctgcttcccaatcggtttccttggccggcaccggctccctccctcccgtgcgggcatctcgatcgtggacctgcttccataccgcccgtctccggtctccctagctcatcttgacatcgagttttgaatcgtatctttgaaacgtaatgctatatataacgacatgtccttttaacttgtaatcctttcttattataaagataaagctaatactcactaaacatctaaagctaaacatacaaacataatatttagtagcactttcaaaacctacatgcaagcatgcgacgttaacccattaagcatacaaagcttaatatacaagcatattttaattatattacaatttattacattctaaaactttctattcaaatcatttcatcatttctccaatatctaacatatatgccgcaacaaacatctagcactaaattatcattctcaaatcattttcataatatttcaattcaaatcattcaatcatttctccaagcccaggtcgtggctccttcgtcgaggtgtcaccacctttgcatgacctggcgagccgtgccacccttcgactccgctccgcgtagcctccatgtcgaccatcgaaccgtcgccacctttgcatgacctggcgcgagccgtgccacccttgcgactccgctccgcgtggccttcacgtccaccatcgaacctggctcgacgccacatttgcatgacctagtgagccgtgccacctttgcgactccgctccgcgtggcctccacgtccaccatcgaacttgatcacacgacttcgttgttgcctccgacaaggccttttgcgccttccttgcacacatcgggcccaacaatctcacccgtcacctcaacccatatgactgtgaaaacttgttacctggccccaacaatctcccccgtcacctcaacccatatgaccgtgaaaacttgttacctggcctccctaccatgtgacccaaggtaattgttccggcttccaaacctaggctctgataccactttgttagagtgtgcagcctggcccaccaaccatgggccacctaggtcacattgggcctgctccaccacaagcccaaccggagtcacaactttaggtcctgggcctacataacccaaaagactagtatgagagataaggactgtcctcaccttttaagtcatgctcccccatcatcaattatcgatgtgggactaaacccaacacgacgccgctctcctcgctgatgcactgctccgggcgccaccatcgctccattgtgggggaagatagagaaacaggaagagggggggggggggagaagatgatttcaaacacagccccacagtaagctacgttgactcagcaaagcagaccacggtcaaagcgtcacgtcagacgaaacaaggagctatactgtcttgataccctgtttaacctgatcttgcaatattagagacacattttatctgctactccctacattccaaaatataaggtttaatcacccctaacctaaagaccaagaaaataattattatcatcttatagtttggatcatgctaataaatataatgcatgcatccaatagaattagagaatatgagagtggagaatttaaaaaagtaataatttaatggagaagaggtcatagttaattgcctacatacatccatgctttatattatggaacatctagaaaaaggttgtgttttatattatggaatggagggagtattatcgttcaaggaaggttttcaaacccgccctcaagatgagggaccaaaagtgaacttactaccacaaccaccccgaagcggcccatggattctcaccgagaggcttggcggcagctactaggccgcgctgctgctcgtgacccggccttctacctaacgggccgcaacatgcatctatttcagtttttctttctttctttctttctttcttttttttttttgctcgcaaaaacgtcccggacgaaggatgcctcgctgctgttggagagcgccgacgactccatgtcagcaatggtggttttcgtcgggagtaaaaaaaaaaaggaaacaaggaagatacaagggatttgttttgcaattcaatctacaagatgcaaaacaaatcttcaagtttcttatccttttctactttcatctccagtagagcttcgcgttgataatgtattatacaaccccggctacaaagtagtctaatgaggttgtataatctaagaagagaagtggagacacaaagtatacaaatgactagccaccttttttttatatagtgcaatcccaaatatagaaggtttgtgccaaataagtgtatttgggccaggtcttcatgggccaagctcaaagttcctcaacatcgataacaaggaagacactggtttggcgaatttgaggatggcaagagctgatgccccaaatttagaaggttcaggcctcttcatagctccagaaatccaggcatagatcaggagcgtcccaaattcattgggattctaattgatacacaaaatttgtactatttgttgagcaattttacggttcttgagaaggtaccatgaggtaccattttttctattgtaaatttggtacctcttggtacctagatactatgaggtaccaaattttacactaaacttttgatatctcatggtacctcctcaagtaccgtagaattgctctatttgttatggcaaccggatatcatgcactatagaaaaaggagatctgaattctgttgattatcactgaatatgttcggtccattctagggatgtgcctgtgccaacccgtggacacgtttataggcaaaatttagcgggtaactcgtgatttggctcgcggattacctactaagttaacctataaatatgtttataggttgatccacttataatagatgtgccaagctagatcctgacgtgaaaatccatggatgattacttatttgacttataagtgagttcatgagtcagcccgcttgcatcctgagtccatgggttgttgataagtaaatgaagtcatcaatgccgttttgaccgtttgtaacgcaaaaatggaattacttaaaaaaagggaacgtcagtattttctcctcaaaactttcaaattcatgatattggaattaatagatgggctaaggcccattcgaagattaattctttggaaaatcacaaaagcccacctcatgggatggcatgcatatggggtttagtactaccttgcttattctaggagaggggatctccttaaaagggaggatgccctcctagccacttgaagcatgtgtggtggagagaagaggggaaacacacgcgcgagctcgctcgcctggcctggcaggcggcgcgcgtgcacgacgtacgcgtcgaatggtccgcaaaattggctcctcacccttacgcagatgcagcctccttttgcagttttgttttgctgcgggaaattcgaatttgttttgttttggaaacactccaaaaaatccggtgcgtgaaaacggcatggagtccggataggttacgcgcgacttatccggttcggtttacgcgggcgccctgatcaggcgatctatctctatataaaccgagccgccaccttcacgcaacacacgcgaaatcaatctagggtttgcctcctactctgtgctgcgccatcgctcgtagactactccatcccgctcaccggcgtgcaccggcgatcggtagagcaagtctccggaacctctgccttcgacgtcctgcaccgggagaaggcggcaataaggtttttgggaagcgctttgcgcgactgctccctgttcgtccgcgacggctcgccttcctctccgctcgcgtgcttcgcgccttcgtcgacgctcgcaaccgcgagtagttcctgccgagcaaccggtctttccgccaccttggtacgtgttcgacatgttgcgcatatttgatctgttcatgttttactgcttagtttatatgtgtagatctaatgatgtgttcaatctagtttacatctgcaatgtcatgatttatttatggaataaattaaatcattatgtgcttataatttcaacaatccaaaaaccttattataggcgctgtgattttactatggctggttttgccgatgcactgaggttggataaattcaccggtgtgcactttaagagatggcagatcagggtcactctgtggctgacggctatgaaatgcttctgggtgagtaatggcaaacctgaaggaattcttactgctgatcagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaacgaactcgaactccttaagtgtgtcttacccgataaatttgtggccgggtgcattattgcgaaactacctccatcatggagaagtttcggtactgcactcaaacacaagagaccggaatactccgttgaggggttgatagcgtctcttgatgttgaggagaaagctcgggaaaaagacgccgcgtctcagggcgatggtgggcagtccagtgccaatgttgtgcacaaggcccagaacaagagcaaggggaaataca

SEQ ID NO: 32541 - DNA, 1362 bp, Oryza sativa
cgtgtagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattttcaaaggttctaagtgccatagttgtgtgcaatcgaagcaacctcgcatgcctcacaaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaatggcttaagtctgatcgtggtggagagtttttctcaaatgagtttgacttattctatgaggaacatggcatcatacatgagaggacgcctccctattctcccgagtctaatgggattgctgaaaggaagaaccgcacattgactgacttggtgaatgccatgttggacacggcgggactacctaaggcatggtggggggaggcattgttgacttcgaatcatgtgttaaacagagttcctaacagaaataaggacaaaacaccatatgagatatggattgggagaaaaccatcactttcttatttgcgcacatgggggtgcttggcgaaagtcaatgtaccaataacgaagaagcgcaaacttggacctaagactgtggactgtgtctttctgggatatgctcatcacagcattgcctatagatttttaatagttaaatccgaggtacctgacatgcatgttggtacaattatggagtctcgtgatgctaccttctttgagagctttttcccaatgaaggatacacatagtagttcgagccaaccctctgaagtaattcccagttcaatcacaccaccagaacaaactgaacatacacatgaacatgtcactgaggaggatgtcagtgaagctcctcgaaggagtaagagacaaagaacggctaagtcctttggtgatgatttcactatgtacctcgtggatgacactcctaagtcaatttcagaagcatatgcatctcctgatgcagactactagaa

SEQ ID NO: 32542 - DNA, 14508 bp, Oryza sativa
atggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagacatgatatggatgagtcaaaagcaggtgggaggactttacgctgcatcaagtgtgatctgcgcggccatacttacaagaaatgcccgaagaatgcagaagttccaagcggcgcagatgctagtccatctggataggcaagtgatggtaggcgaccacctggtgaaggaacaacaagcaggcgcgcaaggccaaggcgtcgtccgcagcaggcgattccatggtgtaacaatgctttcgatttaggaaataaaatgctgttgtgatgtaatgagtgtttggactaaatacttctatcgtgtaatttcaattcaatgttgttgtaatgagtacctccgactattgttgtactagtagtattgcgaattattcggtgttgtatcataatgttatcgtgatgagtgttcggagtaaacacttttgtttgtttgtactcttgtttaatatgtgttagtaattcgcttagttcaacatttattacttatgttgaactaattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagatcggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattctacaccctgacgctgatgattactcggtccgacgctcccttgaggcgtacctgttgtggttgttcgggtgggtgatgttcactagcacccacgggcacgctgtggacttccggctggtccactacgcacggtgcatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctatggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgctgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcctagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcacacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggtcgcctgcaaaattccatgccccctcgccgcccatttgcaggcggccccccgcacagtacaaaatcgccctcgccgagggcggcaagggggccgcctgcaaaattccatgcctcccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatagaaaattatttttgtaaaacttttaataaaaaaaattaaaaataaaaaaaattcaactccatcagagtcaaacggggaaaactgggctggattttcataggcccaacccgaatcaccaaggcaggccgaacaatcctgtttcggcccaacaaaaataggcccgacactgtagtcctgggccgtcgctaccagacccgtgggccggctctgcctcgcctaatccagcgcaacaccacgccgtccacccgttccttccgcctcgccatcaccaccccaccaaccaaatcccactatttcctatctctcgcgtcgcgccgcgcactcccaaaccaaatcccaacagagaagcatttcctcgaacacatcgccgtcgccgccctccatggccgctcccaccgcagcagctctctccaccctctccaccgccagcgtcacctccggcaagcgcttcatcacctcctccttctccctctccttctcctcccgccccctcgcaacaggcgtccgcgccgcgggggcgagagcggcgcggaggtcggcggcgtcggcgtccaccgtggtggcgaccatcgccgtcggagacaagctccccgacgcgacgctgtcctacttcgacccggcggacggcgagctgaagacggtgacggtggcggagctgacggcgggcaggaaggcggtgctgttcgcggtgcccggcgcgttcacgccgacgtgctcgcagaagcacctcccggggttcatcgagaaggccggggagctccacgccaagggggtggacgccattgcctgcgtgtcggtgaacgacgcgttcgtgatgcgcgcgtggaaggagagcctgggcctcggcgacgccgacgtgctcctcctctccgacggcaacctggagctcacgcgcgcgctcggcgtcgagatggacctctccgacaagcccatggggctcggcgtcaggtcgcgccgctacgcgctcctcgccgacgacggcgtcgtcaaggtgctcaacctcgaggagggcggcgccttcaccaccagcagcgccgaggagatgctcaaggcgctctgaagatggaatccgagctctcgtaggtggcaacaatggcaggatcagcccgttgctctcgcgcgttggtgagtagcgtcgtcgttgtgaagaggaaattttgtgtgtgttttttttcggttgaatgttgcatgccatgtgcttgacgaaatgacggaataacaaaagaaaaaaaactacttttatttttttgttgaaatttgcaaaccatgtgtttgacgaaatgtcgagatatgaaagctgtgaaatcgcttacgtcacgtgcaccagaaaattgggaaattaagctaggccatgtttgaaatgtggagaaaatttatggttttttactgaatttgtactagcacaacaacgacggcctatggtttttggaaagtaccctctccgttttttttttggatggagggagtatattgtcaaacatagttgtataggccatgtttagaggagcagctatagcttcttcttaaatctccaactcttccaaataatgctgattttcacctagattcttaaaatctttagttataaaatctagaacttagactagaacgtataaactgaaaaacccagttctttcttttacattctcaaaatctagctatcaacaagttagttcttagattttgagaagttacttctgctgtatcagtatggaggtcaactggcccaacctgttttgtgggccatccaccgacaagactcactactgtttcttagagcccagggccgaagagactacagtgaggcccattattagtttgttgaattggccactaacaaaattcttcaatatttttatcaaaatcattcatcatgcatatgttatgccacttacactgcctacagacatacagtggccccatctcacatgtacctaaaaacaaatcttacttttaagaatcattttcaggaaagagaaatatgccgtataatgcccttgtgcatcactcctctcgctctctggtcgcaatatttcccactaccattaggtttaatttatgtatccccttttcttctcgaaccaaacaccccctaagaatatactagaatatgtacaacaacaattaacttgtattttgactccatatttatattgagcttaaatcgactcttaaggctgataaaaagaattttgctacgtgagggtgggtaaaaggaaggacagttgattaataattattttggaggctaaatggttagaggttttgattgtcttgtatgatgactactccatccgtcccaaaataagtgcagttttgcactattcacgtttaacgtttgaccgttcgtcttatttgaatttttttataattagtatttttattgctattagatgataaacatgaatagtactttatatgtgactaaatattttcaattttttcataaattttttaaataagacggacggttaaacattgggcacggatatccacgactgtacttattttgggacggaggtagtatgtctctagatgaagtgtattgcctatgagcctagtagccatacaatacgattcttaagcctaagattttaaaaaattctttgtgatgtgggcaaaaggaaggacaaataattaaaattattttggtggtttaatatttagagcctttgattgtcacagctgttatatgaatgagtctctagataacacgtattgtctactctctcagtcccataatataacaatctaggatcggatgcgacatttcatattacaacaaatctggacatgcatctgtccagattcgttgtaatataaaatgtctcgtccagtactagattactatattatgggatggagggagtatgagactatactaggctcgtacaaatacgactaagcctaagataaaagaaaaaattgttacttgtgggtgggtaaaaggaagtgcgaataatgaaaaattattttggtgacttaatagttaaagcttttaatacctcaattgttctatgaacgtgtctttagatgacgtacgtgtattacctataagcttacatgccccaggcttaactattgtgcttgcttaacacagcagtgtcacctgcgaagtgatgcgaaagcacccaacacgaatatgccataagtggccccttggccatttccctctttgcgagaggggcctatctttgcaaattcaggtttttgagaaggttgtatccgcaaaaatccggcgagaaaaaagggtgaccaaaaagctcatagtagtgctcatgcatatctcctcgctttgcgcatggcatctggcatttccggggcctgtgcttccatgtgccatgattccttctcttcctcctcctgatgcgtccactctaattaacctagaagaagctgattacatatgtattaattgtagcccacactgtttgggtccaacaccatgtcatccatcaccatcatcatcatcatcaggggcggagccagaaaatcagaaaatcttcagtagcagggctcaacttgcttatacaccttgtgtttttaaaatctccgccaagttttgataaattttagtaggagttttggagacaaacctaggggtcaggctctaggcttatgtctgctactggtaatcataatttggtctacacttgataaattgtgaaaaaaacaaacaaataaaatttacatatatatatttttatcgacttaaatgtaatattgaaaaataaattgtgattaaaaatattaaaatcaactttaaaatccaaattttagctgtgactgaagccaataagcaaacggtggagctgggtctccaaggtacatattcagaagctgcagaacaatagctacatatatacatacagttcaggaccactcctgcatagcataccctgtacaggttcttgcttgtacaatgctgtagctcaggtgctcaggtgaaagtaatatctgcatatgcaaatgtttactgcctcgtcagagtttctttacgagctacagttgatcgtatttaccgttagttataacttagtagaacattgcacgtgatttttagcagtgacagtactaggttggtctgagttcttgttctttcatgtggaaagaataaagctctttgatcttttctgaactttccttgtcccatctttcactgcatctttgatctgcaatccagcattatctctcacatcctaccattcatgattttcccctgaaagtctgaagattagcagcaccaagtatatgtgacaccgagcctttcagagtttcaggattaaaaaaacagtgtttttttttactagctgtttgacctgcaagaacaagaacaagatggtcagctttgtgccgtgctgcctgcctgattaaatgagcgattaaattccggcaattagcaggcaactgtttcttggtcctggaattttgcaggcagcgcacaaagtggggctgtgtaaatacagtacgtactcatccccactatcatcatcatcatcatcacactcactgctgtcagagcacactttggttcttgcaaatctagccaaagactctgacagtgatgatccaaagcgaagaaccagcagcagcagtacagcctcgtgactcggtgaaatcgatcgagatgcagagatatataccctgtacagcgaatcgtcgtgtaaaccggtgtcacctttcgcaggtcgtgttcatctctgcttgtcttctttagatcgatcccttttcgacagagaaacgccgtgtcgatcactgcatcggaggaagaacaatgccaagcatcgatctctgaagatttgaacgttttgttcgtcattttttgtcttgtcggttcaagttttccgggataaccgaactggttggtgcatacaactcaatattcttttcgatgccgtcgtaccgtttaatcgctttctttgacttacattaatcttcagctaaagaattgttcaagatcacatgtttcggagctcgacgtcagagagcttcctgttctgctgctgtaatactgcaattggggtcaactgatacttatcataacttatttacattgggctagaacatgcttagagcacccgagatagaattttcttttcgacaatacgcaagagggctatgtatcttataatttacagagaagatcagaagattcgaatacagcttaattaggtacactctcgcagagaagtattctgcagttcagtagttcatgtctgcatttatatgtagccaagtagtagtagaagccgattcgtcagctcagatcgatcaagcaacctccttgcctgtttttccttctcgatcgccaatagttttgccggattgctgcagtttctgtcattaataacaaaaaatacggttaccattgtttcaacttggaacttataaacgatgttgtacggtacagtgaagtcattagtacgtacaagcaaaacagcatagcccaccgaaaacggctctaggaataagcgaaatagcatatttacaaataaaaaacaatttgtgaataaaatttttatatatgtgttcttagcgacctaaaaacaaaaactgaaaaataaatttcgatgaaagaaaccctaaaatcaactttaaatttaatgttgaaaatttaaattttagctaataagtataagcataagaaaaagatgaggctgtgaccgtcggtctcttcttgcttccatgaactgaacaattaattctcatacataactttgggaaaaaaataggagtgaaatgtcaactgcatcattcatcagatcagatcatctagctagctagtacctccaagtagttaattttactgcaaattggtggcatgggagtacatctgtcaaaacataaattaattactgggtgccaagatagagagatacctatggagagtaaattactgacagggaagttgctgtagaagggaatattccacatcaacccgtggtgtttccataaattgcacaacacattggctgaatttgcatttgcagttgacttgggcgaccgacggtttcttgctggccggatcagatctaaagagagagcatgaacagtgatgtcagcatctaggaggagatgctacgtagggtttttacaaggcggagacaaagagaaagagtagagaaaacgatgcgagtgatactagtggcggagttagttgtgacgtcgtcgaccctagggcgacgaagagtgtttcccggtcgccgtttacatttcatgatatcttaaaccatcctttcactctcgggatggttgggtggccggaaaacgataccgttgtacaatcatcatagttagtacgtatttgggtttctaatatcggttatcctattagtctacatcggacggtttatcctattaaaaatctaatttcacgaatctaataaaaataaacaaactataattacacaaattatcatatcgtatatctaaataccgtatatatacaaagtttatacggagaacagtcctctagaccattaattattcatgttcatgttttgcattgtgtcggttgcaagcaagaaagctggcgtttctcccaaacgagatctcgatcgatcgatcaccatgtggctacacaatccccagtaggtctcacaaaccccattcatttttcatgcattagggttaggcagcggggatcatggcgtggttaccgtcaaaacacccggtttttgctgccatgtaccaacaaagaagaagggagaaagaaagaaaaaagccgatttgttaatcggcgccgtcaccaatggtgggggtttcatcaacgaattaattaatcaccaataatcaatctagtcttcgttgaatcgcattgtactttagtaaagccaatttaggatcattcaactatattaattaattgatttagtgatcactttggaaggtttattagtgagtgaagtagtgtaaagctgcgcatgttgtggcgcggcaagaggagccgaaattaagctgcatgtggccgggtcggaggaagcactgtcttctcctcccttaatgccttgtcttgtggactatgtatgtgtgtgtgtaggccatgtccaaaagagagataataaagttgttagctttgtgccttaataaatgtttgtgtgggcatggtgtaaggtacttgtagaaatggatttttatatggtctaaatatatagtcgagtgaattttagggaaaaaaaagatgatttaaggttccatcatttgccctagaaagagccaaacccttgccaaaatttaaattgtaaaacttaattttaaagtatttttaacgtgttcttttcattggcttttaagtcgctaagggtgcacacgtatataaaaattttacacataaatttttgtttttctctaataagctattctgacatgcaattggttgttggctaaccgacggtgctattagattattgtactatcacatatttttcgaaaaatatgtgacacaaattatttatgttattcattttatatggtatttttttataattatttaaaccacatcgagaaacggtgatacatacgctcgagtaataatgagctcgaaaatatttttggagcccaagcaaaacccactatgacgactaaccctgacatcctaccatatactgacgagcccagacggttatccaatattgttagtcctagttcatccgatgctcttaagagctagaagtagctcccttatgcaagatagcacatatattagttaaagacccctatgtggaactcgtgattttgcaaagaaaaaatatgcatccaatgatcaaaaacagggcctagctagactaggcaaactggtactgtgaaggctccaagtacatgtcccaaaccatttgctaccaaaccattattcagaaatatctcctgcgcttgcaataatgccttggtcaacatgtaaacccagccattgatttctcatcaaccaaaaaaatttatcagcttgctcattttttttctccttttttttcttttttttttcatgaaactggtgtcgtggcacgtgataagcgctggcacatgatgcgacggttttggcgggagtcgtctagctttccctccgtatatctctctgcagatggtggctgattttgcacaaaagcccatgaactgtaaataaattccgttgctttgtctctttcttcccccaactgtgagcctgtgacagtactgaatgaagaacatgaggcctgttcagttcagtgtgcatttcattttgttatttgagattgggtcagaagaaccagcaaacaaaaccacatgggatgcatggctgcaacacaagctcacaatgtgttgtaggatgtcagatcccatcctcccattgtgaatatgctcttcccttgttgttctttgttcatgtctacgtcagctgtgttgtctcaactcgtagtaaaatgtgtaacgctaagcattggatttgctaaaagaagagctcgaacgtaaccattccgatactcagaagtttggagacctggatgacatacacccgtgcgagttcccgcacaaaagaacaatgccgaattcgacccttgtagtacactcatctatttacagctctttccacactgttagagtaacagaaagctccccaatttgctgcatgatatgcccttttggctaaagccaaaggaaccctaaaaatgtggcatgcagcagccataagcaacccaaccccaagattgattgatcatcactagtaaccactcaacccctccacacaagaaacctcacacacaccccttgattaaactgactgacctccagttggttttgtttaatgcacaccctcctcaccaccgacaccctcactgtgggccccactcgacagccatggcctccccccttcaacacactttgcaatgttattaccacattaccacccaatcatgtatcatgtgatttttttttctcctttttcccttgcactgtggagcgtctcctggagcccaactttcacatgcataattatttcttgctggataggttcatggttttgccaaaattgaaacaaagtggtaaatttagaccattggatgattctatgacctactcaaaaccaataaattttcacagaaatcagtctatttctacttcttaccgatttgtactctctgtgtaaatttagtcgtttcgactgtcacaggacatatttagaaccgagaaaccatacataaataatcaatctatttctatttgtgtaacttaagtcgtttcgaccatcgtatgtcggcatatttagtaccgagggaaacttcacataaaccattccgttttccatcgacctaaaaagataaatattttttattggaaaaaagagtagagtagattttggaggggatttttttttaatcttggtgagtgcacagagagagagatagagagagagagagtgacacaaaaccctactagtacatgtgcgtgggatcattttataaaacccccgctctctcccacgctctcccaccactccactctccaatcccattaattgcgcctcctccgctcgctcctccgcctcgtctcgtcgtcgtccgcgccggcgcggagagggagggagaccgactagcggcggcgaggaggaatggaggtgaaccgcggcggggcggcggggctgcccgaggcgtggtctcaggtgagggcgccggtgatcgtgccgctgctgaagctggcggtggcggtgtg

SEQ ID NO: 32543 - DNA, 907 bp, Oryza sativa
catccagatccccatgttaaacgagcgcgaggtaccctctccctcccgccgccattgccgccaccttcccttgcttgctttgctttctctctctctttttttttgagttcttttgcttcgagatgtggaggggtttacttactcacgatgagattatacggaattattattcattattattattatactttttggtttacttactcatgatagttattaaattatatatatttttgttttacttactcacgatggaattataatgattatattttagtgtttttcggtttacttactcattctgatttacttactcttcataagtattaattattttttggtttacttactcacgatgggaatattgtaatcgtggtaatattaatcagttaattactgtgtgttgtgtacgtgttggggggtgtaggtgtaccagctgtcgatcggggcggtgtgcgggctatcgtggccgtcggatcggctggtggtgcaggtgctcgacgactccactgaccccgtcatcaaggtacgtactaaaaacacactcctcctaataattcactcctctgtaattaaattactaatctactcctgtcctactatacacttaattactgaaaggcctagcctacatagcagcagcgtaattaatctcaaccccatcgccatgtgtacctgtcggtgaggaagactgaagaaaaagaaaaaaaaaaacctcttgctgtcggtgagtgagagtcaaatcgtcaatggagtgaggctgtctctttttgctcttttggtgaaaaggaagggaggaagggcaaaaaaaagccgtgaagctggggcactctgccgctgtagcctccgaccaactttctctctttcctcctctcgccacgctaccattacagtggtatgcaagcga

SEQ ID NO: 32544 - DNA, 1756 bp, Oryza sativa
  unsure (1)..(1756): unsure at all n locations
gggcctcatacacaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccacctanctctctctgcaaggaaactgcccaatgcttcaccgcctccttcctctcatccttatgagcatatcttgcaccctcaattacctcattctccttatactcccagggtacatgatcaccctctgatataacaagtccagagaagtcctcatttgcccaatcagtggccattacatcaccttcctcatcggatgaccgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaa

SEQ ID NO: 32545 - DNA, 27852 bp, Oryza sativa
aaaccgttaacgcgtgatttaatttagttttatttattttaaacttcaaaaattgtttgaaaaacattttcgcactaaatatactgcctaacagtttgaaaaatatgttaatgaaaatcgagaaaaaatatttatcttaatttgaaaagaataggaccgatggtcacctggtcatgtgagtagctgacacaagttcgcaaaacagatgttaaccgctcagttttctgtgttatcaattggatacgcattggtaaattttggcaaaattctgcaaactttgaataaaattcgagtagttatttatgaaccgccaaaacccgattacccaccaggtcaccacggatcaatttcgtatactttgacgatggcgacatctccaataactttatcagaaacagagataaatgaatggacacaaataagtacggaaagactagtgagcgaacattcgctcagcaggaatcttgtgaatggatatggacgaagaggactagaggacgcgccacgaggagtagaggatgcgcgaggaagctgtattgttctgttcccaattttccgtttttctcttttcacgtgatcctcctatatacgtatcaacatttttttgtttctttcacttttttttcatatttgtttttttgttagtctctttctagttttattaacggaactttttaatatgaatttttttgggactttctacatatatgaactttatatatatgaagcccaatatatagactttgcatatataaaatttttatgtagactttatatataaaaactttcaatatataaattttatatataaaaaagtttctatgtagactttatgtatataaactttctatagaatttatatttgcaattattagataatttagtgtattaactttaatataagagtaaagtgcattggcgatccttaatcttgtagagttgtgtcatataaatctctaaactctcaaaatgtatatccaggtcccagaacttgtcaaagtgtatcatctaggtcccaaatcgacacatcccctctaggatactatgtggcgctgatatggcatgccacatggatgtgacgtgttcttttctttttttttcttctttctttttctttttctttttcgttttcttcttattcttctttttttcctttcttctgctcaaggtcacaaagaaaaagataataaagggaaaaaagagaagaaaaaagaaaaaataaaaaaattaaatggatcctatttgtcagtcaaaataatcccacgtcatgtccgtgtggcatgccacatcaacgccgcataggatcctgaagtggttctggcgatttaggacccatatgacacactataacaagttctgggatttggatatacattttgaaagtttagggacctaaatgatacacccttataagtttaagggctgcccgtacactttaatcttaatataaataaaaaatgatgatcatgccacaccggatattttcccgaaaaaaatataatccaatcaaacaaatctcgtaagtacaaatagtggcggcatggatttggttattaacagaagaaacaaatactaatcacgtaattaggcaggaagagattgttatgccatgaaaaccgttcgtgaaatccgctcatctcgaacgttcgtgagctagaccagccccaaagtatgctcgagtgcttggttgaccgattagcacttcactaacatatttgctgtgactgaaaggaacttcactaatctattacttatcttttcgcttatacttatacttatctgctaaaatttaaatttttaattttaaaattagagttgattttgagggttttttcatcgaagtttatttttcagtttttgcttttagctcgctaagaacacatacataaaaattttatccataaattatttttagtttgcaaatatgctggcccataatgttccacccgacgtgatgactaaaacgtggacgaattgtcctcggactaacatacttcatctttcaaaatataagggtcccgttcgggtgcacgattgtagtcattgcaatgcagccatacaactgttacgctgacacacattactgtgaaagatagctgcaccgcagctcaaggagtgcagcaaaacacacccaagaaattttagaggaatgtgacatatacatactattaggatgtgtctagatttatggtatgtgtttaaattcatattactaaaatgtgtttagatttatagtacgtatcatatctctttaaaatttattatatttcaggatagagagaatattagcaaccatcttcatttaagtctaacagtcagacaaaggaacgaatccagcatggtccgcggttgcgcttgcgcgtcccgtgaagcaacctgaattcgctcggaaaaaatgggcgatgaccgagtttagttccaaatttcctctttcaacttttaacttttctatcacactaaaacttttctacacacataaacttcgaacttttctatcacatcgtttcaattttaatcaaacctttaattttagcgtgaactaaacacacacgacgtgactggactggagtggcctgtggaaacccatcatccccgtgttgctgcgtgtcccactgataacgggacggtctttgtgttgaccatttcccccgtactactcgctagcccttcggttctttgaccatttcccatgtactatgggctcgcccatttggtcttgtgttgctttgcgaagttgcagtgacaaatggaacccacagtgataaagttccacgggtttatttccaaacaagttttactactcggctaataatgacctgacgacgcgtaatttaaaaaacagaaaataatttgaaatatacaattcctatgtcctaaaatatggccttttaaaacttttacacgattttcgagatactactttgatgaaccatccttgtgtaaggataaggataaagatactttttacctgatcaatcttttttatattttttttgttattaatagttaattttaaaatgtctaatttagcactatctaaaaatatagttacattttgtgatagtgggggtatgatttatcatttatgtacttttattcttacctaaatgagaattaaaaagaaagacaaaaaaaatcctttaaatcaacttctaaaactatgccggttattactagctcacgacgtaccggatgcgacacgtttaggcaagtactcatcgatttcatgactaataggagtactccgcgtggtaaaatttatgaaaagtttatcaaagatccgtcgctgcatccccacatagaaaaatgtgccactagtttgactcgtcaccgttgacccaacttgtctccagctaaaccagcggaggacagcagccaacaaccacttaattacaaggcctcgccggagacggagacggagaccaatccgcccccgacctcgccgatggcggaaactccacgccgaatccgccgcggcggcgccgggctctcgctcgtcgtcgtcgccctcctcctcgccgtcgcggcgagggcgcagcaggagtacgaggcgaaccagcagaacgcctgctacgccaccaacgcgagctccaccctcggctacacctgcaacgccacctccgcctccgccgccgccgcggcgccctgcgacgcgtacctggtgttccgctcctccccgcccctctacgcctccgctgtctccatctcctacctcctcaacgtcgccgccgccgccgtcgccgactccaacgccgtcgacccggtcgcccccgtcgccgccgaccgcctcgtgctcgcgcccgtgccgtgcggctgctccccgggcggctactaccagcacaacgcctcccacaccatccgcgacaccggcgtcgagacctacttcatcatcgccaacctcacctaccagggcctctcgacgtgccaggctctcatcgcgcagaatcccctccacgacagccgcggcctcgtcgccggcgacaacctcaccgtcccgctccgctgcgcctgcccctcgccgccgcaggccgccgcgggcgtcaagcacatggtcacctacctcgtcacctggggcgacaccgtctccgccatcgccgcgcggttccgcgtcgacgcgcaggaggtgctcgacgccaacacgctcaccgagagctccatcatataccccttcaccacgctgctggtcccgctcaagaacgcgcccacgccggacatgctcgcgccgccggcccaggcgccgccgccccccgcgcccgcgccgccgcgggcgcagccgccgcctggtgggtcgggcagcgggaagggagtcgccgttggggtaggcgtcggttgcggcgttcttgcgttggcgggtgtctttggcttgctgttcttctgtctccggcggcgacgcggcgttggggaagaaagtgttcgtccggggaaggtggtcggcgacgtgtcctcttcggcggagtacggcgccctggcatcggggaagcagacgacgacggcaacctcgatgtcgtcgctgtccgcggcgaggtcgctgatggcgagcgaagtgcgcgaggcgttggagtcgctaacggtgtacaagtactcggagctggagaaggccacggcggggttctcggaggagcggagggtgcccggcaccgccgtgtaccgcggcgtgttcaacggcgatgcggcggcggtgaagcgtgtttccggcgacgtgagcggcgaggtcggcatcctgaagcgcgtgaaccactgcagcctgatccgcctctccggcctctgcgtccaccgcggcgacacctacctcgtcttcgagtacgccgagaacggcgcgctcagcgactggctccacggcggcgacgccgccaccggcgtcctggggtggaggcagcgcgtgcaggtggcgttcgacgtcgccgacgggctcaactacctccaccactacaccaacccgccatgtgtgcacaagaacatcaagagcagcaacatcctcctcgacgccgacctccacggcaagatgtccagcttcgggctagcccgcgcgctccccgcgggcgacggcgccgccgccgccgccgcgcagctgacgcgccacgtcgtgggcacccagggctacctctccccggagtacctcgagcacggcctcatcacgcccaagctcgacgtgttcgccttcggcgtcgtcctcctcgagctcctctccggcaaggaggcggcgtcctccggcgacggcgagaacggcgaggcgctgctgctgtgggagtccgcggcggaggcgctcgtcgacggcggcggcgaggacgcggggagcaacgtgcgcgcgttcatggacccgcggcttggcggcgactacccgctcgacctggccatggccgtggcgtcgctggcggcgcggtgcgtggcgaggcagcccgccgcgcggccggccatggacgaggtgttcgtctcgctcgcggcggtgtacggctccacggtggactggaacccctcggatcacggcaactccgggtcgtcgctgattgggaggtagcaaaacgaaccaaatcggtggcaaattcgattcaaatcgatgcgaaaagatcggaatttttcaaattgagttttgaatttgtagctgaaaatagtatttgtgttgcaattgatggtgcgaataaaaactgtcctcgagcagcagcgacaacttgacatgcttgactgagaaggagtacgatcgaattgtataagttttgagtcattataggtggttttgactgattctgtataagttttcgcaaatttggggacaaatatgattgcctataccatcgaattgctcatccctgttctctagagatgggccagtgcgtgggcttttataccaaacaaggcttacaatttacaagccgacctactactccgtctaaaaacaaatcctatctacgaacctgcacacgccctatctacgaacctgcatacgcatatatccagatctgtagttaggattagattatttttgagactagtactagtacttctttgattctttcgtttgaatttacggaatggattcaaatctcttgagggaattttcactcgtgtatattttgtttttttaaaagtttaatataaatacttatacaaatattttaaaaaatgataatgtatagtatagtgactatgcattgggaaaaaagagaaagacaaatctagatatgaatagtaccattattgttcatctgctgaatttgattcctttatacctcagcgtgtgggttgaatttgttttttttttaatatctccgtgatgttgtataatcgaaagcaatgcattttaagatagcacaatcaggggaaaagaacacttgatagggtgatttagcgggttagactaaatgattcccccaccaagattcagctaactaactctggttattgttgattgaaccacatgcttacttagcttaatctcttcccaaataatactcccgagatgggccgggatatgggtttcatcaaactacaaggccttacaaagtttgttccaaaccgcttccgtttacatttgcgttgcaatgttgactttcgtcattttaacgttgagccttaatagtccttaaatggttagactactataggagaaactttcacggttaagggtgtgttttcagctaagcttttctaacttctaatctactactccgtactatttttcacgcacatgcgccttcctaaactgaaaaactctacttcttttaataaaaataaaaatatagaggaaaattgctttgaaaaatcatattaattcattgtttaacttttttagctaataattaattaattatgtgctaatgagttatcatgttttgttgttttatgtgcgcaggagaaaggtttgaacaagcctatgatgcaagccaagtatggaacaagcctaagatgcaacatgcttgataatatatcatcattttgaggacttatgatcccctaaaaatcatgagtgattcgagatgaatcgtacttcagtgtcaagtatatgcaaacggagagaggatttcctttgagctaaggaattcattcatctttgggtctgtttagttcacgtcaaaattagaagtttggttgaaattgaaacgatgtgatggaaaagttaaaaatttatgtgtgtagtaaagttttaatgtgatagaaaaattgaaagtttaaagaaaaagtttggaactaaacaaggcctagtttacttcaaaattcgtcctgtttcttcctctcttttttttttgtttgtgagtacaaccaaacttgaggatgatatactggttcattctactttgcgcaaaacaagaaacggattcctactactacttcctactgcctcactactatgcctcctcttctactaagctcaacgccctcttcagcggagacctcgccgccgccgccgccgccggcgcggcgcctctcgccggactcaggaacacggcgaacacgccgagcgtctgctcgttcagcttctcgttgaacacgccgtcgacgtcgccgtcgccgtcgtctctgctttgcgcttgcgccggcatgacgtgcaccttcttcttctgcttcttgccgccgccttgccggtgtcgccgccgccgctgtggcctctcgccgacgagcgccaggctcgcgcggacggcgagcctgcccatgtcggcgctggacagcggccggccgagcatcgccctgggcagcacgaagtagagctcccccggccggagcggctcgccgggggacagcgccggcgggcggtcgtcgaagtagagcgcgtcggagttgcacacgaagaaggacgccgcgtcgtcgccgccgccgagcacgtcggagaccaccgcgacgcagggagaggccggcagctccctcagcgagccgtcggccgcgatcaccctcgccggcggcggcggcggcgccggagcttccgactcgacgacgatgtcactctccggccggtagatgcacgaaagcttcgatcccattgaaattttcgtgtgcttttgtgtgtgtttttgatgagattaaggagagttgagtctgaattttttattttgcaggtggattaaggatgaagaagatgtatttatagagtggcaaaagcaaagggttggaccgggtgtctttccattattcaaaacaaaatagatgatgcataattaattaattaaggatttgccgggactgatagggcactgatgaattttcattgaggatatttttttctttattaattgacacatctggattaaaaaaccttattgtagctaaatcactttttctagtaagaattggtgtggctaaacctctatatgtctataggcgtatagacatggtaaatgtgcgttaccaatttttttataactttaatactaaatgtgctagttttggttgaggtcaaccaattcgtagtgcccatattttatttggttcattctagaagtttattcaccacaatattaaatttggctttatattggtcacaatccaaacatacattagataactttaccttaccaattctttagtagtgccatagtttaccctgattttggcagtactaataatttcgtagggcagagaactaatatgctgatagttttaattttacgcctttgaaagaaaaaaaaaggaaaggagatgacttaatgcagaggaaatagccataccccatacctaggcatttattaatttggactcattaatgacaacccatgcaattagaaaatcattttatcttgagaaaataaatttgattgtgaattcatgtctgtatgacttcgtccgttatggtttcatattatacgtgttggtacatttttagtataaatttaataaaatgaaggatttacagcagcctctgtctctttaaacatagtttagaaatcatacttatgtccataggcgtgtggcctatttacgttataatgtgtgtgcatgtgcattcgtcttccctgaaatcaaagggaaaaaaacaagaagaaaatcctgtatcttataacaccttttgcattgtctaacatttggattcatttcaacaatgggtcacttctcatttcacaccccgttggttgttgggcaacttgggcaaagtgacttagagcatgctaattccatttccataccaacagtgcttaactactactcccatggcttatctaatcaacttgtatctgatcaacttgtataatcaactttgtgtaaaatcatgcttttcaattcaagaagcaagactatcacgtttgcttcgacaggtaagtcgacggatcacgcgtacgtatccatgatgtgtgcatacagattaatcttctaatctttcgtgtgtatacagattttcagacagcatcagtcctaactgaaatttttaaagaacttttgctaattgatgcaggcatgtcttcacaagttttggtcagtctgatggtcctactctttgtacctgagaacacttgattttagagtatctctcatcttaattatgaacaagctacatcttaatctagattaattaactacatgacacactgaccaattggctaagagcaagttcaatagtatagctaactactagctccaattcatctagagccaatctaatagctcatttatataatagttacataccacactattaatatatagtcccacctgtcatagacatactgcgacttggagtccgtgctacagctagctacaaatctgtagcccgctacttttctctctcctgatttatctccttaaaatatatttgcagctggctctaattacgagtctctgattgcaggtacacaagcgcgtatgcttgtttattcccacacttgatgctgaatttttccagtattctcccgagtcagtggtaagtctatctccttttctctttatcctttcctcttcctttaatcattttccccttattcatgaaactttataacttatcatttctttcaatgaaatgactattagataggctctaccttcttatattaaaaaaaatgtcagtggtcagtcatgcaaccatttcctatttcagagtgttgggtgcagaaaaatgctgataagttgagaagatcaccaaccaaacaccaccaatccaagctttcatactctccttttgtccgtctctctattttcactcatttgctacctgcttagttttaatcatgcaatctacagaggacaaaagaggagacaaactgaattagttaaggttcagaagctgatcagtgccactatttttctccacaggatcatccatgtcgtcgacctacctcgatgcacatttggaattaggacacataattgcagctggtagttgtcataatcaatcaagaaattgcttaacacagaagattaaagtaggtgtatagccattagttagccacatgaggcaggccgagatgaagccttcatcagtgcaaagctctgatctaatcattgacgccatcagtctttcagtcgtcgcatgcatgcatcgttagtcatcaagtaaagcaaggatttcatacaataatcaccaaaacagttgattgcaacacgatctgggggcatagctaactgacgaactttgactgatcagtggataaaacggccactgattgccaaattaattcgtcatttgttaatgctttcactgaccatgacttcttcctatctgcttctaattttgacgtttctggcatcatctcaattagcatcgctccttggagatcagtacaataaattaatctttttgtgttgattaccgtacttaggggtcgttaattactacccgagattggcacttcccttagcaagaccagagtggcttgaaatttccaagaaactctctttctggtgaatattttgaccgattcttttacttatctcgtcgggaaatagagagcaccgatgcatacggcatctgaaaaggagtagaatataatcttctagtgcatttttcttccctggagaatgtaaaaaatgcaaggataataaaattaaaagggagttgagaccaaactgtccttatcaaactgatggacctatcgttatactggagattctcatgaggtggtaacctggtaaaatactgtgttattttcacccacatctgcaaaaacgtattctaacacttgcgcaaagagacagaagctaatgtcaaattcatgacctcgctaaattcctattaatagcataaccgggtgtgcttaatattatgtgtacctggatttaaatcttgatggttggagtatctactacatttgataatatttaaggtcattatttactgcatgatcatagtatcatattatgcagtaaatcatgaaaattgtgtgtgtaaatgactaaattgcaaaattattgcaaaaagaaaataaaaacctgttcaatttgcccattgtaaatgagtccgagccagttaatttataactgcaacatgagtaaattgcttacatttttcctagtaccttaggctatatttggtttaggattttaagggctggattggaggatttttttttcgaacgcgcaaaatagttatacatcaatatgttagaataaaaagagtttttgttacacaacgcaattggccacacaggcctatgttgggggtgaagaaagaaaaaaaccaaaaggtaaaaggaaaggaaaaaactattgcgaaacaaaggctactccaaacaaacgagaggtaggacggagccacactacactcctagcaaaccctcaaaagctgtaatgcctgcggaaaaccacagacaaccttccgagtggatagactctataaacacagaaaccgaggaaagggccgagtcgaaaaccctagagtttcgttacttccacagctgccaagagatcagtaggactagggagtcgaagcatgcgcgaagatgcttaggtaagcaagtcctaccagacgaccaccagtccttaagcaaattgccaccggagaggagggcagtccagccctcaggtgacaaaacatggtgttaggtctgtcaagggaacacacagtcgaggagaatgtggttcgccgtctcaaactcctgagcgcaaaagggacagacatagtggctatcaataccacgcttttgaaaaagatcagctgtccagcaacgctgctgatatgcaaaccgaagaaagaatttgcatttggcatggcctttcgcgtgccagagcaggttggcacaggcaaatgagtgctagccaaagaagaatgcctgttatgctgagcgcgccaagtaacactgatcactcgtccaacaccaaacgaaacgatcctcaacgcccgataagagctaggtaggaagcaccgcatcccaaactagaagcaactgagagatgaccgtaggtgttaatatgcataggattggaggattaatatgctaagcatgtcagtaggtgttaattaccctgtttaatcccctttttgcagtggaattgaagtttgagtttcttattgggtagactgaaaagttagtagcagcatttcgatcgtcagtgttttactgattgcacgattattgcagtgcgtcaggagattgaaagtttccattaactgcaatctatagcagctgggaaatgtacataaaaatacaaaatcaacttttatatattcttgtaggtttgtatgattgtatctacagattgaagtagtatttacaaggggtgatcatgcatggatctcttctccccgggtatttttttcccttctaaatctagtctagtattgaacaaattaattaaagctttaaacttgtgttaagctctaagcttctgaaaaaaaatacgaaaaaattgtttcccctaaaaagaagggggacaaaaagctgaatcttcatctatcttcactcggcgtcctcttggatgatgctcagcacgcgcttcagccgcgaacgcgccgccgcggcgagcttctcgccgccgctcttcggcgggctccacgacgccgggaactcacccagcgtccgctcgttgagcttctcgtggagcaggacgtcgccgccgtcgagccgctcgtcccgcagcggcgtgacgcgcaccgtcttcctcttcctgtcgccgccgccgcggcgaacccctcggcgtcgcggcgccttggcggccgcggccgcgagcgcggcgctcgcgcgcaccgccagcgcggccatgtcggcggtggatagcggctgcccgagcatcgccgccgggagaacgaagtaaatctgccccggccggagcgcctcccccggcgccagcgccggcggctgctcgttgaagtagagcgcgtcggagttgcacacgaagaaggaccggccctcgccctcgccgcggagcacgtcggcgacggcggaagagacggccagctccttgagtgagccgtcggcggtgatgaccctggccggcgccggcgccggctggtgcgacgacgagcgtcgccggcagctgatgcaggaaagcttcaatcccatgaaatcttggcgaaaatgttggaattttctattgctggtttggaggttggatgcgtagactgaaaatggatggtgtatatatagagtgcgaaatgggggaagtgatgagtttgtttcgtttaagcccctttcctcttgggaaattatatgaacaaaataagtttcttactttttttaaaaaaaacataatttcttactttttgcctttttggtcaagtattgtggttagtagactgaatgatgcagatgtaagtaaggttatgagataactgaatataataagttactccctccgtcccataatataagggattttgagtttttgtttgcattgtttgacccctcgtcttattcaaaaaacttgtgcaaatataaaaaacgaaaagttgtgcttaaattactttggataataaagtaagtcacaaaaaaataaataataattccaaaattttttgaataagacgagtgatcaaacaatgcaagcaaaaactcaaaattctttatattatgagacgaagggagtatgctactatcatgagtgttgatatgaataattcttaattacaacttggaaaccagtataaattaaattaagatatctgctatatttgtcggatgctctaatagatagacccgctcacggaacaagatgagcttgtttggattgaaacaatttttaccctaaatagatagaactactgaatttgaactattatagataaaatttggtatcaaaaccaaacatgcatttgacactattgaagttaccaaaaattttagtagcagaaaaaattagcatcaacctaaactagcccaatgatatagtgattagtgatggattactagtccatactctctaaaataactttattttaactctactttttctcccaaaataaattcacatttatcttctacttattatcgatccacaaatcagattaccttcaatatactttacggccgggcaccttatatacttgctttaccagtactactttcttattaatgataagcactttgattctttttaaaattttatcttgtttaaaacacacaagagtaaaaatgttatcctgcgatggaaggagtatactatagttatactccctccgtccctaaatgtttgacgctgttgactgttttaaacatgtttgatcatttgtcttattaaaaaaaagtaattattaattctttttctatcatttgattcattgttaaatatatttttatgtatacatataattttacatatttcataaaagtttttgaataaaacaaatggtcaaatatgtttaaaaaaatcaacaacgtcaaatatttaggtactgagggagtatatactttcatcatcaaaagataacgccggtaaagaatagaaacaaactatatagtactatacactaccacagggcattgagatcctttgcagtcgactgcaccgtgcctttatcactgacgtatgggcccgacgacacatcggacccacatgtcagtgacaaaggcacggtgcagtgacggcaaaggatgttgatccttctacagggtggttcgtctgcctgtcacggtatcatagctagtaatgtgttcgaccctgtagatgcttgttgctaggcatccatatgaggctgggttagtttgttcacttttccaacttcagcttactctttttcacacatttttcaaaccgctaaataattttttttaaaaaatatatatacgaaagttgctttaaaaaccatattaatctatttttaaaaataaaatagataatactccgtatttaattaatcatatacgtgagttacgttgttttgcaagtgagagattagttcccaactgcgttgttgtactgtgtaatttattttttttaaaaaaaagaactgagcactagtcctacggaactgcccaactggttctactccagaagcaattgagaaaaagcacatccggtccagtccagcaccagcaggcaaaaaaaaaaaatgtcacttgtgaagggaccagtaggcaaaaaaaaaaaaaggggatacaggtcaacagaaaccgccaccgatcgagtggcgtcaggtgtgagcgctgacggacgattccgcggggcaacaaacctgaagacggcagcgcccagcagcagcggccacacgctcccctcccacagaatgcgaatccgaacccagtggtgtgtggggggattcggcacggcgcgcgaggcccacctgtcagttgttcgccgcctccctactggggcccacctgtcagcgacgcgatcctctctgccttcccgtccgtacagcgcgtgcgctcgctacttcgttgttcgttcctgcctgcctcgtccgttcaaaattagatgttcaaacttgggacgaaattagatgttcaaaattgggtactttctccactgaccccatatatgtacgtccttgttatattttggaatgaatgagtaataactgttttttttctaagagcaagctagctattactactagtagttagtatttaatttgagtattagaagtatggtagttctgcttttgtttcacaatcttaattgctcaagggaattagatattttgggtagttgtacctccttaaaatatttcataataggacactgtatatgttctgaaggattggcaatctatcaattccacatctcaatagatcattatcaagaggttcagatttttcaacatacgtaagaggaacagacattctttgaacttgcttgttgtcacttaagggtgttccaactttaccgtgaaactaattcttccaaacccttcaatataatccgaatcatgttcgtggagaaaagaactatcgaaactaagctctatttaagtgctctactgctcttacatgaaagattattctaggtttcatattcgcgaaattttattttattttataggtttcttcattgtacctacttacgtctccatcgcctatattcctattccctccgtccaaaaaaaagccaacataggagagatctccttccagtacaacgaatctgccttttatccatattcattgtattaggagggatcatatcttctcagaggttggtttttgacggagggagtagctttcaactcgttgccttcgcccctccgacacacattcggatgcagcttgttatacagttctacagacaaatcacatcttgtaaaatatctttttcttttagctagaattactcctatcttggaaaagatcaaactaagttctatccagagcgccggccttttggactaatccactatagtgtacagtactgattaccgatcatgcaggaaattgaccttgttgtgagtgagtatagtactgtagtactaatcaataacctgattacttggccggccggtcgatcagtcatgatcatatcagttagtgatggagaccgatcgagtaatgctgcaacatcctgcgtatctttttcgtcgctgactgaaatagctgcctttctattcaagtacacagtcaaacaagtgctacttcccgagcttatctagggacaaattaactgcttgacttcttaatggaaaaattgtccctacaaagtaggagtattgaggaatggtttaccatagttacaaaaatcttaatcaaatttgtttaccatagttacagcaatcttaatcaaacgtttgcctaataaaatatgatacgcctaatattccgtgctgcatactgtgacaacgaaaacatactgataattaatctagtgtatatttcagcctgacaagtggggaatttggtagcactgtccaaatcaattgtcatcgtctagaattcaatcaattcttcggcatgaagcaagccataatattctctcagtttcaaaatacacttgtccaaacatataactagaaatgcttgcgtatattttagaacaggtagttactccctccgccccataatattttaatgagagagataaagaggtgaagaaaccatttcttatgcaagaaaccatctctacacaagtataaagaatgaaaacaagagaatatgtggataaaagaagagagaagggagatgattggatgagaattttattttaagaaaccatccattatatatatatagtttctatgtataatatctatatgatatggcaaatatgaaaactaattaatagtttctgggttgggaattgtctaacgagtggagtggattggagtaaaaggcagactggaaatttggtaagaacatttcgattatcaaggggttcacttatttcacaattattgcaaatgatgtcaggataatacaaagttcgactgtgatcgcgaggaaaatgacactaactggcaccatgtagcttctgttctacacagcctgaattaattccttaattctccatctttctatgtaaccagcagaaaatcagagtctgggaaatgtacatcaggaaaaattgtacaaagatcaactttttttttacatttttgtagttttgcaactacagattgaagtcgtatatacaagagggtgattcatccatgaatctttttccccagtattcttttctttctaaatctactaattaaacatactccatccgtttcaaaatgtttgactccgttgactttttagcacatgtttgaccgtttgtcttattcaaaataatttgtaaaatatgttatctaatatatgtacatgaatatatatttaacaatgaatcaaatgatatgaaaagaataaataatttacttaaatttttttaataagccgaatggtcaaacacgtaataaaaagtctaacggtgtcaaacattctgaaacattctgaaacagagcaagtattaattaaagctttaagcatgtattgggcttcgagcttctgaaaaaaaattgtttccccaaaaaagaagtggaaaaaattgaatatttatgcatcctcttggatgatgctcagcacgcgcttcaaccgcgaccgcgccgccgcggcgagcttctcgccgccgctcttcggcgggctccacgacgccgggaactcacccagagtccgctcgttgagcttctcgtggagcaggacgtcgccgccgtcgaggccctcgtcccgcagcggcgtgacgcgcaccgtcttcatcttcctgtcgccgccgcggcgagcccctcggcggcgcggcgccttgacggcagcgagcgcggcgctcgcgcgcaccgccagcgcggccatgtcggcggtggacagcggctgcccgagcatcgccgccgggagcacgaagtatatctgccccggccggagcgcctcccccggcgccatcgccggcggctgctcgttgaagtagagcgtgtcggagttgcacacgaagaaggactcgccctcgccgcggagcacgtcggcgacggcgggagaggcggccgcatggagctccttgagcgagccgtcggcggcgatgaccctggccggcgccggcaccggcgagccgcgtcgccggctgatgcaagaaagcttcaatcccatgggaattaatgttggcgaaaatgttggaattttctattgctagttcggaggttggatgcgtagactgaaaatggatggatggtgtatatatagagtgcgaaatggggaaagtgatgagtttgtttcgtttaagccccttgattcttgggaaattatggagaaaataattttctttacttttttggtcaagtattgtggttagtcgactggatgatgtagatgtaagttatgagactaatagccctgctcatggaacgagacgatattttttaagagtgattagtgatggattactagtccatactctctaaaataacttcgttttttgaactctaacttttcttaaaaatatgttcacatttatctcatatctacccttatctgcaaatcagattatcttcaatatactttacatgtgattttttttcttttaccttgttttaaacaaacgagactaaaaaaagttattttgagatggaaaaagtacgtaactattaatatagagcactatacacttagggttcttcactttgatgtctaaatcaaccgcaccaaatttaaattttggtaatgctgaattttggcattgttaatatttgttaaggttgaaaggtgtaaattaagtttggtttgttatcattgccaaatttgcgtgagaggaagattctaaaattaccagaatttggtaatggagataaattaatttatcaatgttagattgttaccttgtcaaatttggatagaaaccaaaacttggtaggattaattttgataacaagatgaacatcttcttaacttgctattagttaatgtactccaacactactacacggctgctcgactgcctgtattagctacagtgtcacagctactactatcatgtgttcgatacggacatggatcctatgcagtactgcagctgcggtagaagccgctaacatatgggtccggttctacctatcagccacgactactgtagctatattactgtagacaattttcactgattcgatatcgcagatgcgcgttgcttggcagccatatctgagccgtacgggacagccccactgcttctagaagcaattgaggaaagaaaagcaccagcagtttgaccttcttgtttggtgtctggctccacaaaatggcacttgtgaagggaccagaaggcaaaaaaacgtgagacaagtcaacacaaaagccgtggactcgtttgtgtcaggtcaggtgtgacggtgtgagcgcctgagctctgacgattccgcggctaaaaaaaaaaaaaaacatacgaagacggcagcagcagcagcggcgaccacacgctcggacgctcccctcccacagaatgcgaacccgccttctagtgaagtaacggcggggcccacctgccagtagctcgcggggccgctccccgcctctactgggggcccacctggcagtgactctgtccgtcccgcgtggcgactggcgatgcagccctgcgggcgtcagcgcgggcgctaggctggtttgctgttgcgggcggcccaagcgagagagtggggtggggtgaccggacttttcctgcgccaacggcgcgtcgcgtcggaactcggaacttgttctaccgtgtcgcgttcgctgccgcgttcttgcctcgtccgttcgctaattttgaaaagcccggacgaaattagaaattaggttttcaacattagaaccttctgcactgacctacatatatatggatacttcctttgtactatcaaaataaatcgcgtgttcatgtttattcataggattgatttatttgggacataagacgtatgtcttattaggttgctatatttttaaacgaaagagtaactactattagcttttttcttaagagtaagctattagtttattagttagtttcagtattactctctccatttcaggttataagatattttaactttggttaaagtcaaattgtttcaaatttgactaaatttatagccaaatataataatatttataatactaaattagtttcatcaaatcaataattaaatatatttttatagtaaatttgtcttgggttgaaaatgttactacttttttctataaatttaattatacttaaagcaatttgactttgatcaaagtcaaaacgttttataacctgaaacggagggagtacaagtcaggtagttctaattctgtttcacggtcttaattgctaaaaggaattagatctttttagagtagttgtacctccttaaaatcttccataataggaagatatatactctgaaaaggataccattctcttaatttcatatctcaatagatttatcaagagactcgaagttttaaatgtcaagagaaccatatgtaccttccttgagcgtgcttgttgtcactcaagggtgttccaactttagcacgaaactaattcttccaatcccctacaatataatccgaatcttgttcgtggagaaaagaattatccaagctactgctccgtaaaaaaaaaacaaattcatacctacgatcgaacttggacacacatgtgtgtaggattgtaggtatgattttatcttttttttttacggaggggtaagctctaaataacgctcctacacgaaagattattctgggttccgtgttcgcgatttttttttttttttgggtttcttcctcgtacctacttcctcgtaatcctagctttcaattcgttgccgtcgcccctccgacacagtacattcgcatgcagcttgttatacagttctacagacaaatcacatcctggaaaagatctttttcttttagctagaattactcctatcttggaaaagatcaaactaagttctatccagagcgccggccttttggactaatccactatagtgtacagtactgattaccgatcatgcatgcaggaaattgaccttttagtttcagctggctgatcagaacctaaacagctactgtaattaattaataacctgattacttggccggtcatccagtcatgatcatatcagttagtgatggagaccgatcgagtaatgctgcaacatcatgcgtatctttttcgttgctgactgaaatagctgcctttctatatattcaagtaagtaaacatggtcaaacaagtgctacttaccgagcttatctagggacaaacttaactgcttgacttcttaatggaaaaaatatcactacaaagcagaactattgaggagtggtttaccatagttacaacaatcttaggggttgtttagttggttgccacactttgccacgccaaactttagccatgccacaattttttaggcatgtatttgtttcgctgccgcaattgtatatattataccacactttcttaactttggaatccacacgtcatgttctcaaatttagagctaagcataccgtacttgtgacaaattatttctaaaccacgcttattccaccatgccacagctagtctaaacttagttatatcaaggttaggcatcaaccaaacatcctcttaatcaaaggtgtttaccatagttacagcaatcttaatcaaacgttttgcctaataaaatattatgcgcctaatattccgtgttgcaaactgtgacagcgaacaaatactgataattaatctggtgtatatttcagcctgggcaagtgggcatatgctactgcatgcgtacgtgcggacgtgcctcccagggaatttggtagcactgtccaaatcaattgtgtcatcgtctagaattcaataaattcttcggcatgaagcaagccctactattctctccgttataaaatacaggtacataactagaaatgcttgtgtatattttcaaatagaagagtgtgtatctaagtagaaggtggcttttcttctgctctactcccttcggtttcattttaattaacgctttggacaatgacacgctctacaagatatatctttgaccttatttttctattatctctactacttaaaaaataagaggtacctccatcgtccgtcaaaaaaaccgggtgaaaaccgggcagaaaaaaccaggtttgtccgataaataaaccggacaaaaaaaagaagtccggtccagaaaataagggcgaaaaaaaacaaaaaaaacggatggaaaaaaccaggtttatccgataaaaaaaccgggcaaaaaaaaagtgcgaaaaaaagaagtccgatccagaaaaaaggcaaaaaaaaaaccaaagttatccataaaaaaagggacaaaaaaaaggaagtccgatccaaaaaaaaagggcaaaaaaaaccaaaaaaaccagaagtccgatcagaaaaaagggaaaaaaaaccaaaagttatccgatcaaaaaaaaattccatcgacgcggtaaaagaaaaaaatttgtccgattccacaaaaataggaaacaaactcccatccgttttcgtttgggctgattagcgaaaaaaataaaataaaaagtccgactcctatatccgattccctctcataaaccaaaaaaaaagttcgactctagattggtgaaaaaattgatgtgccggattgaagatctgtttgcaaaaatgaaacctacaagtcgagatcattccatttttatatgattttaatttttgggtttgtactttttgcatttgagtccctgtaatttttatatttacatttgagtccctaatatcttgcaataaggtacttgaggtcatttttattaaaaaaataataaaagagagataacaaaggcagaaaggtgcataaaaagaaaaaggctcagtctttcagatgtgctcatagcggtagggtgtgcgtgtgtgcgttcataggggtgagtgtgcgcacgttgtgagcgcctgcgtacgtactgtgtttctcaaaaaaaaagaaaaaagaaaaaggaaagccttaaaaaaagaaaataaagaaaaacaacaagaataaaagtatttttcccctaagtggcgaaaaaaactgtagatccgaatggaaaaaaaattgattcatagaaaaggcaaaaaaaaaaagtggtgaaaaaaagctagatacaattcctttaaaaacgaaaaaaaaatgaaaaaacatctaaaaaaagttcgtccgatttcctaagaaagtggcgaaaaaaatggttcgtataaaataaaaaatacacacaagaaaaaaatggaaagggtgaaacaaaatccgagttctaaccagtatatatctcttctctatctctaatctaatcgaactatttaaaaagaaaaaatgaatgagaaaataaaaacggttcaaaaaacccgtgaggcaaaagtcagaaaaaaagcgtaaaaaacacgctaaaaaggtcttccatcttcaataaaaaaatgcgcgagaaaaattatttccatcatcggtaaaaatattttaaaaacaacatgcgaggaaaaaaaactgctagaaaaaacgtgccatttctaaaagtttggttttaaaaaaccgcgcgaaaaaaacaccgtctactaaaaaataaatcgctctgaaaaaactgttagaaaaaagctaaattgatagacacttgagtcggataggatccatcaattttttgccatctactacatggctttatttcgtcatacattctactgtattggaaaaaaaagtaaaaaagaacattcgaaaataacaagaaaaaaaacgtgcgagaaaataggcaaaaaaacatacgagaaaagaaaagcataaaagggagaaaaatatggttttctttgtcagtaaaataagcaaaaataaaacatgctaggaaaaatttgttataaagaaatgcgccatttctgaaaaatggattgagaaaatcgcgcaagaaaaaaaaacaatgtttataaaaaaagccgctcattaaaatagaaacattgtcattgacatgattatgcatgaaaaacatatattatcaataaaaaattttacccgttgcaacgcacgggcatttttgctagtaatatatacaataaataaatgcatgtttacttttattatagtgttttgaaagacaaatctatatatgtttttctagtttctttaaattagatatttttaaagttattgatggtcaaagttataaaagtttaacctcaaccttatccaaaacgtcaattattatagaaccagagggagtatttaataaaaggcacaatcttgtgttgttttttcttaggaaacaaaaggtagatggtggcttgtagctagctgcttaattaggaagaatagattctttcttttgcccaactaatactataggtctatagcatgcaatcaagcagaaaaaaaattatatgcatataggaaatcaagaaatttgactacactgcacaacatacctagagccgttatcttaaaaaaaagaagtattttgaattatccccacgagacagaactatcacatcatcgtatctatccattatattactacataatagatttagcaaattttggggaaaaaaaatactaacactattcccccttcaaccaaaacggtttagtgtttttggtttctacaaatgaatatggaacacatgtacttttaatgtagagacaaaaacagagttgtgcaacaaatacaattccgctctaagatatacataacatagcacagtcacacgggaaattcaaattctcgaggataaatgtcatcaaaatgtctagattcttacccaccattaatcaaaatgtagctagcatacatgcatgcaagcgaatttcaccacagaaaatttaaccaaccaagttcccattctctgtaaaaaaaattaaaataaaaatcgggtgattcagacctcgcatgcagctaccaccaccaccagcatgcaacgacgacgacgacgacgacgacggcgagcatctcctccgccaccgccatcgtcatcagaagaacggcgaccgctccggcgcgcggtgcgcgcccttcctagcgcgccgccggtagctgttggggtcggcggcggaggcggccggcaccgaccgcgccgcggcggcggcgaaggcgaggatgttggcggcggcctcctgatcctcttccttgtcgcctctagccacccggcgtcctcctctcctaggtcgcgacgacgacgcggacggcggcggcggcggccggcagccgccgccgcccgcggccttgctctgagcagcgttcgccttggttgggtagaacggctcgtcttcttcgtcgtcgtcttcttcctcgtcttcctgtggccctgaaatctgtggctctgggatgttgttgggatcgatggtgaatgtcagggtaggatccgattccatgcatttcagctgacatcaacaggagatagataagattattcagtagtatggattagagtggtgattcagttagttaatcagaagtgatcagaattaataatcttttttcatgaacgcataaatgaattgcacgtcaatagaagaaaaaagagtttttcttatacaatacaatcggccaggtatgcctatgtaggggaaggacaaaaaaaaagcaaaacaaaaacttcagctaggaaactactacgacggctaaacgcaacttcgatggtgtgttgataatcagaaaagtatatggaaattcgagtttcaatgttggagatgctttcatttgatggaagaaatctctttcactagagagtagagaaagatatgagttcgatggtgtgttgaattgattagcactagcttcatggttttgttgagtatgcctgaatgaaaaatggaaaaaagagagaggaaaatctaaatacccctacacccctacaatttaattttgtacaaaattaaatactccctacaagttcatttttctctttcaacctccatcaacactttctccacactccgtgggctttcattgaccattgtggtatgttaagttgttctttgccaccaaaggtgtgtgtccctcggtctccctccaccttccactttttcatgcatgtttaaattaaacagcttgtgtgacgataaaacacgacaaatgacaatcgatcacataatatatgaaaaaggtatattaaatcccattcccaataagagaagacattgagaaacttttttttaaggaagacattgagaaacttcgctcaccatgctcaagattcacaggatgtgagaaatctctaaacatgacgaagaatcaacgtaaactagacagaggtgagaaaacttaaagagaattgtttagaacatcaccaacagattatctataatctccccaaaaaattatttttgggtttcctaaaataaaaataggaagtgaaaaaacttaaaagtggacccttctgaaactacgaacagaaaattctgtttttttccacgtgcagaaagatcgctatctctcacacgctggaacggtaggagagaggcgggagtgtgagattgggagcgactttcacgagaccgcgcgcctgtatataaacggagcgagaaatcgggaaaagggaactccaaaacaaactcgtaggagagtaagagatctgttggagctgttttttgaactaaattcctttaaaatcaattttgggaatcagataggtatagactgttggtgatgctctatatagggagcatactgcgtggaagtaaattgaaaagggagatttgaatttttcccaaaaaaaaaaagagagagctgctaatttcctaattgggctgagtaggcccatgcaagactgaccggcccagcatacggacgttcccatttcttcctcacgtctagatctatctggggccgttggttcccaatccaacggtccagatgaagcgcaaaacccactgatgatacgagacgcgtctcctcggacgaggcccaaaaacggcaaagacggtggcggagacggccggaaaaggaaaggagcgtggccggcggccggcggccggagctctgaccttgcagccgagggagcagaagcggaaggcgacgttgaggaggccgcggccgcacgcctcgcaggcggcgcacgccacgg

SEQ ID NO: 32546 - DNA, 5134 bp, Oryza sativa
cgcaggtgaggcagtactggttgcactcgttcctgctcatgccgcggtgcgccgcgcacgcctcgaagaaccgcgcgccgagcagcgaccgcagccacgccgggtcccggtccgccaacccagcagccatcgccgggtccgcggcgccgccgccattaccgacctccaaaacgaaaaaaaatgcagctccaaatcaacaccgcatcgccggagacgaagacgaagacgaagacaagaacaagcaatgccggacaaaccattgctcgatcttgctgccaagcgactacaaacacataccttcggttaccactgcttgctcgtcggagaatcgatcgatcgggagagtgaggatctgtgccagattcgattcaagattgctccatatttttttttcttcttcttgatgagattgggggaggagggggggattgaaagggaaatgaaatgataaacacgggaggacagtggctggcggctgggtttacacacactacggacgcgagcgttttagcataatgcgattgtttctatagacggatggcacgagatgcaggagggaggggtagcctctctctctctctctctctctctctctccgtgtgtttctcgatttttatgtatccatttttgtactggaattcatcaatgtgaccctaatcactaggcaaagagattaagagaggtaccaccagggttaattgtcaaaactagccatggcacaacccacacaaaccacaagggccatcaaaatcaaatcatagatgaaggaaaccactcaccactgaactgaacacatatgtgtaccttgcatcttcctgtgatcacaaagaattaaaattaaaccatacaaaaaaatatgttgaaacttagaagtatagataaacatatacgacacacggaaccaactgcaggatctcttaaatcaccatcctcaacccgataatatggaatcagatgagatgttgccattcggcaaagttttctagggaagacaaaattcaacaaacagacacccctaacctgtaaaaaacatacctcataagcgttgcgccgagtagtaagccaggattatataatgattagaagagacttttcgtcccatggggatcggtccagtaccaccgccgccgccaccaccaccacgggatatctcatgaatctatccgctataacaagacgcgcttagggggattagccctcttctcttgtgcgacacgatgaggagtacaccaaagaagagagaggagccaccatcaaggttggtggcgttggcaacatagtagactagttatgcgttcgagtcttccgtatgcggcaaatgctttagatcacatgcatatatataggcgcacacagaaccgactgatctaagtactgggccagtgtaacctatattgggccgcatataaaagtttacggcgtggatcgatgcgtatcatttaattagatgttggggcgcatccttgtacgtctatttttttaatttttataattttgtcgaatactatattggaaagcaatggtcgaaaaccatcatagaggacaaatatggttgcccttttgtggagagaacaccatgttatatagttcttttcatgcgtagtcttaccttttggtgatcaattatcaatcatataactctattgaattttggtaaaaaaacaactttatttgaatttcaatcatgttactaaaacaaagaaaaatatagctctatgcttaaaaaaatatcaatgcaatagaccaatagtacaggctacagggcatttgtgtcattttgcaagaaggcatattaattaaattaaatcaaacactatataaatgcactattttattcctcaacagtttgatgttagccataaattcttgagcctgtatcttcatatagccatacgtttcattcattactgagtagatatattcatccacccctttgaaaacccaagcaaaaaccgtgtttcatcgcaaaaaaccaaaacaaaattactccagtaggagcaaaaaagaaaaaacaaaattactccagcaggaagcatgaggtttgccgttttgtccctttctgttactttttttatttttttagaagggtacaactcagaacgcatacacacgctagaaatgagattgcactcataccacgacacacgcacacacgcacgctaggaatgagattgcactcataccacgacacacgcacacacgtgtccctaacacacgctaggaatgagattgggcctcagtatatgggaaacgtgcagtccacgacacatgcacacacttgtccctaacacacgctcacgctaggaatgagattgggcctctgggcctcagtgcacgggaaacgtgcagtccacgacacacgcacatacgtgtccagtcccactaaacgtgcacgcgtgtatacccccggggaaacggagaaaaacccctgtgagacacgtgagttgcgatcccaggatcgaacccgagcgggctgctcgctcacctggcgacgcttgctcggttctctccttttctgttactaggtggaatgaatgatcgctagagtaagagcgcccaaccgttgactcggcccggcccgataaggccttgtgaggccccaatccgaagcggattggattacgtgcggcccacgcgatctctcggcccatcaagcactccacctctcaccaccgcaagtccgtaaccaactggagctcctcctcgtcgtcgtcatcgtcctcctctccggctcgatctcccaccgcggcggcgactccagatcggcggcgaagcccaggatctccggcgagggcaggagaatgtcgagataaaggtggagtagtcgagtatcgcgtaaaagaaagagaaatctctccccgtctcgttgtctcctccgctcctcgcgccgccgccaagacgagtcgcgggggaggggcggcgatcgagcagagcaggggaggggaggggatcctggtgagtatccatccgcatcctctttctgattcatctctctctcccaccccaccgggactacttatgtctggaattttgcttgcgttcgttaaccctagtagcttctcttctagatctggaaggagctcttctcctcctccttaatttgagagccctaaacctctcttaatacaactagtagtaacagtttgggggttcaattcaactcaacccccatgtcccaagttggatccacccctgttgctattagggttacggagttggcaaagataatatggtggcatatgtttgcgctagagtcgaatccctttcgcaatgtgcactagcatcgaactccatgaccaggagcaagaaccaagtcattatcttgaatggggataatatcttacattctgaaaaaaatagtttgtgtgtttgcacactctgataattagatttgcttgaggagcaccttaagtagtagtattccacatagtgctaagtgctgatctatcctattgaattgcctgctatattgttttgagaatgaattatatgtttatgattatgctttagtaaaatttctcacttgagttgcattgttcagggaggagtgaccggagggaatgcaagacccaagaggtatgccacgagatgaattcgcaaccccgaagacgcacaagagaaaggtcgtttcccgccccttgcctcccagccaaataaaagctgaacctgagctgctgcggagggaggttccactcacatccggcaagaccaagaaagcccctaagataaccttcaagaatgaacctcgccattcggctccgcaatctgattggggaacccccgattcggtgccagagttcggtccagctgatgaatacagagcgttacggaagaagtacctgctgctggaggatgagaacggtgagctggacaagcaattgagccaggctgaagaggaagccagcgttctcgaggatgaaaagtttgcgctgctggatcagcttgttgtgttggaaggccttgtggatccttcacagatgcagccaccgagaaggctgtgagattctatgcgtgttcgttgcctgttcatagtccaattaagttacctgttactgcttcctgctagatatgtaaccaattgtaatggaagagcaaagacatattatatcgtttattatggaagtttgaacatttagagcacttgtttggagttctttttgtgcaatatgaaagagtgctatcagtttaactgaaatttaatcgtggcaaaacagaaagttcagcaagcatgaagctttgcgcctttgcctcaagtttgagttatgcttttaagaactacgcaactggtcttggggaaaaaagctgaacaatttgtgtttcatgtgatttaagaaactaaatctgttcatgtgaagatcaactgatcatcacaaacttctgcgtaatgtttgcacaaacacatatactccagcattaacataaaaaaaacaaaactcattcatcacggcgaattgacgggccacaattttaacagtatgatttctcaaaaatctttctacaatagcattgtttcgataaccttttctaaccaaataattaattaacttcataatctacagtatattgaattaatctatgaatttatcggctaattagctgacaagctgaacagggctgagactgaatttcttcatagtgactctgccgtgtgagtgctgacgcaatcaagatccaacaattttaggcccacataaactttccaagcccaactcatgaaaagcccaattctttttcaccttatataaaccggaccagcagcagcatccgcctcagctcaacggtcaaaaatctcttccaatttgaatatctctcctcccaaacggtcggctccggagcggcgcccggacgaacacatggcggcggcgatggcgacgacggcggcggcggcggcggaagaggcggtggtggcgctcgacaaggagactctgatgctgatggggtgcggcgacgccccgccggctgcgccgtgcgcggagtgggagacgttcaagagaacgtgcggccgctgaagcgcggccgcaacgtgggcctcctcaaccgcgccctcaaggcgcacgccgaccccgcccagcgcgccgccctcctcgccgcccggaggtaccgccgccgctcccgtcacccgcgtctctcggtt

SEQ ID NO: 32547 - DNA, 5922 bp, Oryza sativa
  unsure (1)..(5922): unsure at all n locations
cctcaaagtgtggttggaatatgtgagtttcatgaattcaggattggttctgaggtggattggttggattggattggattggtttggtttccttttgacatccagtttggcttgatcttaatctgtatgcaggcggggaattgtgctgattccgaggtgatattcaggttcctggaggccaaccagattggtcagagccataccaattactacttgtcctatgcgtcggtaatggagtccaagaacaagctaaagaaagctaatgagatttttaaccttggtattgccaggtgagaattttatgggggattggtagtttagtttcttcagatatgagaaaggttgcggattttcttcagtgctagtctgctagtagattattttttagtgataatagataagttccttctaaatttccatatagcctttgacaaagaattcctgttctagatttgaagtctgttttcttcggatttttagtcaacaaacatatagtcttacatatccccatttactgttttagttctatgaattatagtaactaaaatgcattaaactaatttggagtaagcttatgaaccgttgtagctgaaaacttttaccttctctatttgtttttggagggatatgacttttcttgccactctacctataccttaatacctaaagcatacgatttatgcatttgtttgactgcaaggtgtatagtcttccatattcccactcaccattttagctctatgtattataactaaaatgcattaaactgattgtggagtaagcttatgaactgttctagattaaaacatgtattcctgacttctctattttttgttggagggatatgatataatttctcaattttctgctctacctacaccttaatacctaaagcatactatttatgaattttgtttgatggaatggtgcatattaaaccgtaaaattctttggcttttttttttttggtcaggaaagcaaagcctgtggagaagttggaaactacatacagggcatttcttcagagatcatccaaaaagaaggcacatcctgaggtgtacataggctgatttagtaccctatttttaatctatattccactgcccactgaatgaattctattatctgttgaaacaggatgacacaactactgatgatcatccagtacgcaactttgggactgtcttgaaccgtggtgaaatcagtaagtttgctgtgatggtatgattaacatcaatttcaagtgcctggctgggtgaactaatgttgcattttgatgtggcaggaggccagcatgcagaaaactctcacctggtgaaaactctgcaaaggttattacttgttatacgcatgcaatcagtataaagaaatctagatgaacctggaatttttttactggtgttgatactgttgcaaatttgcagagttgatgtcaataggccacttgcagtttacacagatgagaattcgttacctagtcatggccttgctagaaccaggagcaacaacacggcctggcagacccttggatcacaagcagatcggaacaaagaaaataacatgaggcctgctaaatggacatcacacaaggttttttttttctcccctaagccactagaattcttcaaaaggtccctttttgcgacatgtctcgaggtttatcggttcagtaatgatcaatgaactgatgatagtattgcactgaacaacagattcctcagaaggttggatcgagggcagcagttcagccgactcgtgtaagctccattgaagtcttcgtagatgacgaatgcgccgagtatgctactgtgcccttaagttaacagttttgaatagttctttaaaaagagtaactgtaaaaacgtataatttttatataccttcctttgattatttcagggaaccagttccccaagtgccaaagagtacaaaaccatctattctgaagcttaggcaagcaacaagcagaaacctcaagcagtaagaatagttcagcttatattatgtttccagaggttctgttcctttctcatttttttttaatgtacacttgcttttttttaacagggaaactgaactgcttatggagaatcctctgcggaatttccctctaaccagccttagataatcaatatttatgtggtgtaatgctgtatttcgatcttcttttaccaatttattgtttgagtgtttgtgacattatgctgaaataagctttagcctctaaagcttaggcaggcaaagagcctttttaggctatccatgagtgttgtaatattgcacaataatttgattgataaatcctcgacgagggttgggggtgcttaatttggttggatgctgataaacataagtgatgctaatttttaatggtgctctgtttttttttcttttttgggctgaacaaactgaggctggaattgagtaaaccttccgggaaattatttcctttcaaataaaaatcataatgcattagattctccaaataattcactataaccccatcaggtcacaaacaccaaaacgtgattgaaaactgtcatgcaagtggatccatgacagtgtatacacaagatcaggtgtgacaacttgtttgcagacacagacatggcaaaaaacatgtttgccatggatagatctccaatgctatttttttttctcaggtcttatcaaaggtccccattgccagcataaattacggaactttaaggctgtgttcggaatcggacattcccagcgtgtaagtacggaaaacggagcggaaatgagaagagaagattagatatgaaccaaagcagggaaaaaaaagtgagagtagatgaaatattactccacttgatctaatccagcatagcaaaaatgatcacctcccagaacctcaaaagttgatgaccctattggctaatagcactcacaacttcaagctgcaagctgagagtatagtagtgacaacacactgggtggtaataagtgagagagagagagagagagaaaaaaatgaggttttgattatttgatatcctggcccactgtcacacacttggatggtcccatatgttattgtcacatgtgttaatataatcaaagtgataacggataaagcatcaaatcatcaaagtttacaacaataaatatcatattgcccgtacgttgcaatgggatttgaattaaagaaaattatcgctaacccattattactatcattttatgcatatatttgttaccaacatgtaggccctttagcttcacattatccattttcttctactagtcacaggccccatgcgttgcaaagggatgagatatcaacatggttctattttttcctcttacaataagggtttgtttagtttgttgccaaaattaaccttaccaaaattcacaagatttggcggaaatttgatttgcacctgtaaatcacaaatttctagctaattcacttaattgctaaaataaaccttaccaaacatttgccattgccaagttttagtaagataacaaacttaacattattttaccattgcaaccttaccaaactctaccaaaattgggcaattgtagaacattccactcacaaaaccataccaaaatttggtaaggtaccaaactaaacaacatcttaccaaaatattagccacaaatggtaaggtttgttttggttaggtgcgcatttgcttgtgtggtaattttatcttcttatcgaagagttaattacgtgctgaggaaccctcttgtggctgcagttgaagccaatctacaactctacaaggcgaccatactatactatggatggattccgagagtgaaccagacaaatgaagaacaaccagctgccagtccaaacacacaagattcataagattcatgttatctagacccgctttaatttgctttcgaataattaagaggaaagcgtccgatcaagtacatgggatacgaaaccacttaattaactagcgagttctcaatatatcatattccttacatttatattctttaagtgtgttctttgctgttgcaaaaaaaaaaaattctagttatgaacctgaatattaactcgggtatgtcaaagtttgtagttagagatggagtgaatacataataacaatccattttcctcacatgtatattttattttcataaagaaagctgccctatgtatgtgcttattcgtttgtatgattagaatagcgtaaaaagttttggaaaaaaagcgaaagctggtgttctttacttagtactctctcaatcggagaaaaaaaaatcaaattctagttatgaacctgaatattaactcgggtatgtcaaagtttgtagttagagatggagtgaatccataataacaatccattttcctcacatgtatattttattttttaaagaaagcggtcctatgtatatgcttattcgtttgtatgattagaatagcgtaaaaagttgtggggaaaaaaagcgaaaggatgaaaaacaaaaacaattccgttgccgggactcgaacccgggtctctcgggtgagagccgagtatcctaaccagctagactacaacggattttgctcaggcagggcttcattatatgactaattttagttgaccgaaaacacacaaaaatcaggatttgttagtttattgctaagtgtggggtgattgggtatactactacggtaaattccctcgcttttttttctggtaaggaaagcaaacctagggttaaaatgcaaaaaggctattattttttacccactaacattttttttagataatggttttaccgactaacatgtaatcgatatatataaaaaaatagaaatctatatgaacctggaggttcttgactgtggtgatactgatgcaaaaattctagaattgatgttgaaatttatataaacacctgccatatatacccttggaacacaagcatatcggaagaaagttactaagtgaggcctcctaaatggacatcacttgagattttttttttcgttcaaggacttgttaatgattttgaatagttttttttttaaaaaataactttataacgtactccctccgtttcaaattatagtgaaactgtttcaagtttaactaagtttgtagaaaaaaaagagtaacatttttaacccaagagaaatatattatgaaaatatatttaactatagatttaatggaactaatttggtgttatagatattaccatatttatctacaaatttagttaaaattgaagtggtttgactttgaccaaaattaaaattactaatagtttgaaacggagggagcacgactttcaatataccttcctttttcgttaattttagggaaccagctccccaagtgccaaagagttcaaaaccatctatcctaaagcttaggaaagcaacacgcagaaaccccacgcagtaagaatactttaacttattatgttaccacaggttctgtttctttgtcagtttttttttaatcacacttttttttttaacagggaagctgaactgctaatggaaaaatccgctgcacaacttcccttttaagcagcctttgttaagcagtattcatatggtgcaatgctgcatttcttttactgacttgtttgaacgatgcgacattttgccaaaataagctttaaacctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32548 - DNA, 706 bp, Oryza sativa
ctgccttttacccaaccagcatgcatgaagtacagctacagaaagctttacgatccttccactcaatggttaaaggaccggctgtccaagtattctccaagaagctaaaagatgaatgccaagcaatatgggaatctggaaggcagcaatgcgatgctgtcagtcttactggcagaccatgtaagcaccagagacacggtaaatcctctccatcagatgcagcgttacagcattctagtggatatgttttcctccatgcatgtgcctgtggccggtcacgccgtcttagggatgacccttttgattttgaggcagcgaacatgacctttaactgcttctctaattgtgaagatctgttacctactcttgtgcttccaagagagaccaatgctggtgcatttccagtatcctcttggcgtttggtgcggcttggaggagcaagatattacaaaccaacaaaaggattgctccaagcaggtttttgctccaaggaaaaatatcttttaaggtggtcgatttctcttgggaaaggacaagggaaacatggcactcatgctaccaataaacctttctccacggcatctaatgcagatcctcaggctccccctattgttgctggagaagtaaaatcggccgtgacccaagtcacagcagaaattaaatctatgaaacttgaaaattctagaaaacaacctgaagtcgagtc

SEQ ID NO: 32549 - DNA, 12803 bp, Oryza sativa
gaatcaagtttgagatcaatttttgtccagaaattattaaagtttggccgccacttggagtgtgatcgatcgagagtgtgcgagcacgagtgagtggtggaaagttgtctgaaaatgtgacgaaaaaaagaagatggtggcaatgcaattcgttgccattcttctcatggaaattaagaagggagtgggtgcaatgtaatggccggctacggactattcaactattcctttctctctctttttttattttaaaaaaattgatctgtatcctagcttagttagctagctagcttaatcacttaatcacttctgttcagtggcagtgtttgcaaaaattaaatatccctgtacatataaagcatgatctgtttatatacttttgatgcaatattattccctttcggacactgcactgcaaacatcacttccaattagttaatttatctcgggggagaaattaaattttgattaacgcctgctgtttgttcttaatacgtgttggtacgttaattgtatttattaatttggtaagtttcaagtagtggtgtacattagtacatacgtttccttttgggctttgctatagtagctagctgccttgctgcaataaagatagagatagtgaagtaggcaaagttgccaagggagttgagagggttgcaagcaaaagacaattggaagctagccaacaatgcaagctgctactagctagcagtatcagtatgagtgagagttgggcaaattaattaatataattggcatatatatatatatatatttgatgagcaagagtgagttgtttcagtttgttgcctagcttcactactggcctgtcttgctcaattagttgcttgcccttggatatatgtgtgtgtatgtatgctttattagttggtttctccagcatcaagtaagtaaattaatcacaggggcatatgcatatcagcatatgcaatgaaagatgcaaattaggccggatcaggtgcttttcctgcaggggagcttgttttgtttgcaagctagcctgcagccacagccagctgcagtgtgcatgcatgctgtgatcctcttcagctctgcactagcatatatacatgagcaacaagttaaggagataataacatatactatatgattaatcaattaattagtcgatctctgaagtggatctcatgcatgcatcttcaattaccactaaagttaattaatatattagtgttgatcgatgaaaatcattttttttcgtacttaaacctaaagtcagaattttcatgatcccctgcatgtgtgtgtacttgtgaatatctatctattgagtgctgatattttccctcttatgcaagaagtcacttgatattccaaattgggcaatttggatcactgcatgtccaactatacacactgttcatgtcatcagcatcccagccgtccccttattaatgtagtgtacatatccacaagctgcactattaattgttgattgcaaaaattaagctgaactaacaaaatttcaattctgaattaacgtccactccatatagctaggtgtttaatttgcaaattaattaaaaattaatccgtggtttgcattaggcaccaagtgtttccaagtggccaatcgctgcacctgcaaaggtaaggtagctgaagtgaaaaggcaggcaggcaggcgatactttccgtgacatgtacttacttttattaatttgacagcaagacgaacatataggcccgccagatgagctgagctgagctagctatagatcatggatcatggatggatggaatatatacttacctgcagaatgcatgcatgcatgcatatgatccatatgcatatagattgttggtcgatcatatctctctatatatatctatactatacggcatggcatctcatcactcatgtctaatcttctcctctatgtacgtactttggcctgcctgcctgctgaataaatatgcgttgaattaataattaagctaagctagatagatatgcaagcagtatgcaagtcgaccgatagatcgatctgtcgcaaattaaattaagacgcgtatatatttgcatgcagtacaccatgaatttctccttgtatatatgtcactactgatcagtaccactactctcgagttaatgaaaatccttatctaaaaagattagactgatatttatgttatcagtgatcgatttttattctgatttctgaattatactcgtattaattaattagcaagctagagagtgtatcttgcagctagtcttgaacgtaccagagtagtacgtcttgaatattcttggtacacgtaggtacatatatgactggatcaaagagctaattaagctagctattactgacttttttatttataatttaaccaaccggccggtaccatcttgcagcaacgatcgatcgatcaatgatattctgcagtaagatgatatatatgccattggtgaagtgcacgtcttgtatatatgcagtactagctagctattttgctgtgtactcttagtttgcgtaagtagaccaaaaattcagccttaatttctgtcctcgcaaaaaagaaaaaaaaatgtgtctttctgcaacagaagaaaagtaaactgcgaagaaaactagaaattaattaaagagatttatctttttgaataaaaagatctatctggggttggagttgacattattgccacatggctttgagttcttgcggttgcccaaataaagcttcttcgttctgatggctagcttaattgatcatcagttggtatactctgaagctaatagggctagctagtacatgatttgtatggcttaatctgttgcataaagaaacaccgttagttagctggtgtcatctgattactagctatatatacagttcttcagctattagctcgtcgtgtgggttgatttcgacctgacttaatcacgggagctccatgattaatctggtgagttgtactgactaaccagtaaggtagctagctaattaagcagggtatgatcgagtcaagtggatcgagtagctagcagtgcacttttttttaattaattatgagatgtactagtagtccaatagtgctagctactagtgtaattagcttatggagtatatggtttttgttagttgcctttgcaagcttccaatgtgggccccaccccattggtaggcaagaggaacatcaatcaaacatgtgctgatatattggtacagtagagcaataagagtagcagtagcagtagagcagccggccatgccatttgctacatcaccaatacactgaaagtgcactatagattggtggcatcatatatatatattcttgtactatacagctcccaatttccaactccaactgccgtccttgcatatctagctgcaattgtctatggctttcacattctttcaatttcctcctctaaaatcacatgcaagatttctggcatcatccaagaaatatgtatacatgtatcaattaatttgtacttatatttccttcttttatatactctgttttgattctctctcacacacaaattttccaacaagtcttctgaaactcttcagagagaagaagcaaacctaattcacactatttttaaatgcatatttttggtacttgatgcaccttgagagagagagagagagagagagagatagagagattacgtatgtgttatggagatgtccctgtcttgaaagcaggtaagattagcaaagtgctttaatttattgagtattggttccactttctccttttcagcttgccaagatgaggcttatcaagttgccacagacatattagtactctgttgggttctctttctcctacgcatagacacatcgatgcctaaagtcgaaaatgtgcatgttctttttcatagctatgtgatgcttgtcattagcctgtcaggaataattgtattgttgtgtgcttgctaggcaaagataatcttctttaacattctttataacattaacagtcacatcatttggagtagagctgctcatatattacactgagtcacatcatttgggcagagctaattttctgacttggtttattttcagccgttaattaacagcagggtattcagacaaaaaacacatgagcccatcaagcataactgaacaaattgagtggttgcaaattactaatagttcctgcaaaagaaagcaagggctctctcaatcaaagctgctgtttgcatttacttcgactttggtcgattaggcaggagagtgttcatgtccaggtcagttatcgaccaagaaaatattaggcagcacatctgcttgtcaaagcagttgatccttcagtgacgactagacgatggagtgggaaaaaaaacacaaccaggactgacaaaacagtataggagttgccatagttaagataactaacgtgtcaagccaggaacagtgagtgacaataagtagcattctggaatgaatgattcttcagatcacgtggaaacggttgttttgcaggtgaagaaaaagcaggcatcgtcgcacaggcttggctcaactgtgatcttgtcactttctttctggcctttacacttgtcaaacaggactggttcatgcgtttccttccagtttcaacattctccaacctccaggctacaagaaggggctgctgccatgccaacctgaagcgttcatctctccaataaaggctgcaaaatgaccaagttgagtttccgggttttagttttcgcttcttgaagttgatcccctgaattcctcagcaagaaattctgtaggacatatgactagtcaagaaaactttaaacaagaattttctacagcatgtcattcagtgatcatttcttgctttacaaagacagtgtaaaatttattattatgcccaacagtacagcagcatttagactgactaaaagcctaaaccattacatgctaaaacggactaactcatgggactaaaattctgagacaaaggcgaattgtcgtggaacatctattaatatacaacagtgaaattttacctgacacctattaatgtacatgtccagttccctgcatcaataacaaacatcgggttcactggatataccaatcccatctcgtgtactacagtgaaagtttagaactgacattgcgtacctgcatcaccagctcactccaatgcatccattgtgcatcattcatcttgtcaagagagctcctgtttctcaatgcaaaaggaagctagagttgtatcaatagcatagcatcgtaaatccagcaggagaggcgagacctccatgtaaacatcatgagccattacacttgccggaatcctgaaattcaatgctggaacctgaaaaatgaatgaagtagataatatccatataagttgactaaagatgggtaatgaccaaagtacaatatcagtgcatcatcttaccaattgcccatcactgaatgcaaaaataggatacaccaaaacgaataaatcttaagagcccacgtttcgcacttcacagtggtgcttctttctcattagtatgccctactgatacaatctgcaaagctgtgcctccaacaagccaagctgtgagttctggttgttcctcaaggtatttcaggggagctgtatttccatctcttgtctcaacaccatagacaaatggaagtctcatggtaagaaagctctcaggtggaaggacaactcgacaaccaagactgaacgatccttgttgatcatggtcagaagcatttgaaggcaaacatgaggcctgatgccagtgagataaaacgaaacttaactcgcataatatttaagaaatgcatgtcgtaaaaaaaaattgcatcccatgatcccagtttacaagtgagaatttcatttgttcgatactaaaatatcaagaagagattcatttgcttgatactagaacattgagaagataaaacgactacatgagtagggatgattgtacttgcctcaaactgtacaactgggcagcttgccagcagaacagggaaatcaggtgtgaccttcaccaaaaagagtagccgtatcagtgaaaagacaatattaaagaacagataaatactacaaggttcaaaaggagagcagcttacaataaaaatccgttgaagttgtgacacagcagcagcaacctttgcatcttgatttcccttcctatctgagctcttgcaatgtgggcagtgcatatatatgggcagatttctgtttagaagtgaaaatgcttctccaccatcatcaagtgtaacataatgaagagaaagctctccctttctttcattctgtggatctgaaagccagtgagaaggctgcaaggtctcagcgtcaaccctgggcttaagcaattgctgctggctgtttctccctgatgaatccattggcctattgagcttccctccgctggtcacatccattgttgctgctaatctagatgcattttggggcaacttttgtgaaccatgtttgctttctgcttcattatttagattagatctttcaaactgcaaataagacgaatcaatctccttgagatgtttctctgacagtaagaaacgatgaccataggaacactcgtgctcaaatccgacatataccatgaactgctgtatagattgattaacttctttagtctcttttccgacaaccattggcactatattgctccctatctgtagaaatggctttccgccagcacttccattactcttatctctgctcactttctcagattcattgtcagctataggtccttgactaagagctggatgaccacggccattagtttggtctgctccactcacttgccgctcatctttccagttgccaggttttaatggcctcttctgttggagagcaggaaactcagaatcccttgctgtgtggccagcaacaacttcagcaaaaggcttcttcatagtaaagtttggaagacctttaccaaaattaatacttgaattgttcattgactcgacttcaggttgttttctagaattttcaagtttcatagatttaatttctgctgtgacttgggtcacggccgattttacttctccagcaacaatagggggagcctgaggatctgcattagatgccgtggagaaaggtttattggtagcatgagtgccatgtttcccttgtcctttcccaagagaaatcgtccaccttaaaagatatttttccttggagcaaaaacctgcttggagcaatccttttgttggtttgtaatatcttgctcctccaagccgcaccaaacgccaagaggatactggaaatgcaccagcattggtctctcttggaagcacaagagtaggtaacagatcttcacaattagagaagcagttaaaggtcatgttcgctgcctcaaaatcaaaagggtcatccctaagacggcgtgaccggccacaggcacatgcatggaggaaaacatatccactagaaaactgtaacgctgcatctgatggagaggatttaccgtgtctctggtgcttacatgttctgccagtaagactgccagcatgccatgttgcctttcagatttccgaaatttaattggcttggccattattttttaggttcttggaaaaaaattggacaaccggtccttttacccttgagtggaagggattgtaaaaccttctggaagtggacctcatgcatgctggttgggtaaaaggcaggccaattttttccaaacccctccttaagaggtggaaggaatccttgggccccatgatgaagaaaatttcacattaagccccttattgccttccaagcaagataaagcagtttgaattgcgttggatcctgctgaaggaagttgatcgttctttggaaatgaacttgtatgagtaggtgatgccttcatgttttgggaactacttaacccatcttccccactaaacagtgcagacaaaatagatgaacttatagacaaccatgtatcgaaagtagggagatcaggagcactcatttgcttcccggatgctgctgatgctgcagcagcagctgctgctgctgccaccattccaacaccagaaacaggaccagcagttgtattgcttgagtgtccccctcttcctctcagcccatctgattgtcgaaatataaaatccttgatgaactgaacatcttcatgggttgctggatggcaattgttctccagcgaagaaacatccaatgatgatttggatgtcaaagagtcttcaaacagtcctgcaatgatatccaatggctcacgtttcttactaattgaccgatccaacagtgcaacgacccttgatgtatcaagtgagaacagaggtaggtggctcacattactgacacccctcgaaacaatatgccctggctctagacccacaagtgtccgacacttctttagcaagaaacgtatctgaccttctacagaggaatgcagcttcttgctgaaagtaccatcagatctgattgctggcctagcaagcataaccactgaactagaaccttttgaagtcatgttaggttttggcaagccatcagtgttagaagcttgatttgatgatgtgtcgttcgtatcatccggacttgtcggagcacctggagcatcagtgatatcatcctcaaagacaaacagaacaacagggatgcatagccctggcagcatacaaggatgtgagccagttcctgacatcaacgagattgctgagggatgacgacctccacggcgtgcaggaggagagatggatgaggccctgtgagtaggctttgttggagtattagagcgagcaacttttgatggcactgcaggagctactagtgacttcacaaacggtgcaatagcatgctttgaggattgcaacagacggaatttcttcaaaatctgtgtgtcgaaccggaagccttcttggagaaatattattacatggcaaacctggcaacgtatagaaaataaaagcaaatcaaaatcaacattaccaaacaactgaatcctaaatttccattagctaaagtttgacggtaacttctaggatcagagcaccaatcaaatgttactgacaaatttgaatcgcacgaggatttgcaagcaaggtaggaaaaccacaacaaataggttaatttaattgctacaactggataaacaaacttaaaagtgtcatcttaaatttttctccctggcaaatcaagttaggaaacaagtgcatttatcagctaaccacagattttttttttagtttattttgcattcccacggtccaggtaacagctggataaatgatgcccctatctcccacaacatcgccacttcaaaactaaccgatcgtagttgtcaaagttatccagttaggcatgagaaagattgaacccagccactaaattactgtaccaagttctgtagtttgcattggctgctacacagcgtgacaatttagaggtagatgacctaatacaaatgtagagaccgcgctatgatagcttcatatcatatcagggcaaaacaaaagctgagacctccttcacagctagaatcaccatctcatgatctacatcgaaacgattataaacactcacggagaacatgaagagcagctcccgtagatcgcccgccccctccagaggtgtcggcggcgacggagcgaggtgcaggaacaccaccctcttctccccgtcgcggtggtacctgactccgcccgcgagggtcctggcggagccaccaggggagaacacatgggcgtccaggatccggtcggcgaggcgggcagtgcccccgccgccgacgaagccgacggcgacgacgccgtcgtgggagggcggggtggcggcggggggcggcggggagggggaggaggaggcgggtggcgggggcgtgcgggagaggacgcggacggccggggaggggcccgcctgaggcggcggctccatcgccggcggcgaggtgggggtgggtggcgccgccgcagtagcagcaacctctgtctgtgtattgcgagacgccaactaattgttaaatgggcttctacctgggatttcacgagggcttagtgggctttctatctatatgggccggtaatgttaaataggcttttgttagagttgggcccgttgtatgggctgctgagctccgtttcgtcggttagttggttttctgatatctcaaatgggggaaagaaaaaaaaataaagataagaaattgtgtcggtttcggctgttccacaatgttgggttgttcaatgaaccaaacaagaagaaaaaaaatcactgtgagtaataaatgggcatgcagtgtagtgttgtccgcggttagatcagtcatgctcgctcaccgaccatcgatcctagctaattaagctagcaaatgatcatgagcgagacatatcacaaagatcacagtgtgcatatattgcacaagctttaatatatttctctgttcatcatccttaagggaaaaaagattaatgatttaggtaattaagcacacattgcataattaagccggccgagctacttagcttatttatatataggagatatgctaccacccacaaacttgcacgagctagcattatattcgccctgaacaaattaagctagcaactcctccggtttgtaagatcgatcaatggctatcattggtcggaggcagcagcagggtgtcgcggcggcggcggcgacgttggtggcgttgatggcggtggtggtggcggcggcggcggaagcgcagccgtcgccgggggtgtacccgagcaggatgttccgagcgcgggagttcgggcgcgacttccggagcctgtggggggcggagcaccagcagcaggaggcggcggcgccggagacgggggtgacggtgtggctggaccggcggtcggggagcgggttcaagtcgcggcgggcttaccggagcgggtacttcggggcgtgggtgcggctgcagcgcgggtacacggcgggggtgatcaccgccttctacctgtccaacggcgaggcgcacccggggtggcacgacgaggtggacatggagttcctcggcaccacccccgggaagccctacacgctgcagaccaacgtcttctccctcggctccggcgacccgccccggtccctcggccgcgagatcaagttccacctctggttcgaccccaccgccgacttccaccactacgccatcctctggacatccgaccacatcatgtcagttccatcatttcttaatttacagcttaatgatcaaccgttacgttaaattcaattatattatctactcactccgtttaaggtttcaagattttttaattttagtcaatattaaattgcttcaaatttaaccaaatttatagaaaaaatattaatattatcgatcaatataaatttattataacaatatatttaattattaattacataaaagtaatttagtaatgtaaatattactatatttatttataaacttgatcaaattagatacagtttgactttaactaaaattaaaacatcttatatcctaaaatagagaaagtacttaaaaacagagtaagcagtgttcatcactttcttgattgcttaattgggctaaacgaaaatgtccgatgatggatcttgatgtttccttgtcggtggctatagcctatggtagcaagaaagatttatgtcgatattatattagcgcaaattaagtaggagtaggagtatcaagcatggacaagccgtacggcaaaactgcagggtgccgtaccaacgctttaaacacttgtggcagcggcgacactgacacgtagtacgattgcagcagtacagtacagtgcttgatttggcatgtagctagcgatcatcaatatcttaggccgccgacaccgactccctgtcgtcgttcgtcccagcatctgcataaatgtagtgctagtatatgatcacatatgttcaattaatttcataaatactcactccttctctaaatatttaacgtcattgactttttaaatatatttaactgtttatcttattaaaaaaatttaagtaattattaattcttttcctatcatttaattcattgttaaatatactactactactcaagtttttgaataatattcatacaagtttttaaataagacaaacggtcaaacatgtttaaaaagccaacggcgttaaatattttgttacagagggagtataatgttaatactagcatggatgcatgaataatgtatttgtgttatgatggatcgatcagcttcttggtggacgacgtgccgatccggcggtacgggcggcggagcgcggggggcgcggcggggttcccggcgaggccgatgtgggtatacggctccatctgggacgcgtcgtcgtgggcgacggaggacggcaggtacagggcggactacagttaccagccgttcgtcgcgcgcttctcggccttcctcctccggggatgctcgccgcacgcgccccgcacctgcgccgcccccgtcgccggcgacctcaccgccgcccagctcgccgccatgcgctgggcgcagcgcttccacatggtctacaactactgctacgaccccaagcgggatcattccctcaccccggaatgccgcacccacctgcacccatcgtcctcatcctccaactcctcctcgtcgtcgtaccacggctagctaactactgcttaattatctaatacgccgccatgtatactccatctaatacgctcctccgatcctcaattaagctatctttgtcgtctaattaattatattgtgcccctgtttgtcaattaatcgtttgtttatatatatactactgcaatggatgaatgggcatgctgtttaattaaagttgaatg

SEQ ID NO: 32550 - DNA, 2765 bp, Oryza sativa
  unsure (1)..(2765): unsure at all n locations
gttttataatgtaagactttttagcattgtctaaatttatttagattcattaacatctatatatatatgtgggtaatggtagaaagtcttacattatgaaatagagggagtacctccaaatcgtgtcaagacagtgcatactctggctgatatgataaccggtcgctgctgctgttgcgttgttggttggtgtctcaccaataagtacggacgtgcatattcatgcatgcatgcatcaaaaaataaagaagagatgaagcatcgattcgatgcgatcaccgacgaggcgacgacacagtagcagcgccaacacgcgctttcctgtctgccgcacgtccattaatgggccgcgccttcatagcaatacagttcggcacgataacaaacaggcccatgacatggctgtcgcaacacccttccggcccatttatagttgggccgttggtcgctcaactcaatccccttccggcccaaagcattgcccccgtcccctcggagagatttgcacttgcttccttccttccttcctccaaatctccaattccccattcgcgattcagaagaagagttctcctagttccagcttccaagtcaagggcaaggcgagcagccagccatcccgcgaaggcgactcgatccggcgacatggtgcgtattccccgtgttctaatccagcaacttttgctctgatctgattattattatgtctgctcccccctcttgtactgattactgatgaaacatcgtgattcgatttgtgctccatgtacaggtttgcctcgcgtgcttgcttcccctcttcttgatccccgtcgtcaacgccctccccttgctcttccacctcatcctcgtaacgccccaatccctttcccctctctctctctctctctctctctctctctctctctctctctctctctctctctctctttttgttcaatcagatcttctcacgaatggttatttcatggttgtttctttactagcgagcgtataattcaaccatcttaggttagcctgatctgttagcttgattgactagcaacaaacaggaaggaactatctataactgcacattttggtttaaccacggttatcgaatactgcaagtaattggcaactatagtcctcgcttgccagtctgtgccttatccactaggattcctaaaggaatcttgataattgttgtgtgctttccccaaaaaggagacgattatttgccgttctttgtaaccatgttcccatagttatgctcattggacagctgaaatatcatacttcctccgtttcacaatgtaagactttctagtattgcctacattcatttagatgttgatgaatctagacatatgtatgtgtttagatccattaacatctatatgtatgtgagcaatgctagaaagtcttacattgtgaaacggagggactataatagttacactcctcgtagagccgaaagatatagcataaatagtaactgaaaggcaaaaggctacataaggttccccttcttgacttgacaataaataatgctgaaagatgttttgctattcatattactctggataacaaataactaaggccctgtttctctcagctttggattattataatctagattattgagtcagattactataagctagattgttataatatgtagtagaataagcggttagttgtttctttcctaaattattagagcctagattattgggtttgcaagtctaaagagagagtggggtggcatggtgggtaatttttcaccaaataatctggaaaaagctcacctaaatgagcttatcagattataataagctgggctccagattataataagctacttaaataagttgtctgtttctttccgcttactctcaataatctggattataataatcccaagctgaaagaaataaaataatgttctgtagctgctgagtgttttctatttgagggcagcaaaggcgtcaaatgttggaacaaatgaagaattttgtccatgtttcaaacatgccctgaactatgccaatctcttttcttaatgaaaacttgatgtacgcggtctagtttagcgctgcctgaagtagccttattggtgttttagcacgcaatgtgcatatgtttctaggttctcctgttatctgtattctgaaaattgattcatgttctgaatgacattccagagcaagatttatcgactatttggatgggaatacaggaggcctgaaagagccccgcctgcttgcccgtttaagcctgcggcaaagaacaatgaagtaagcttccatgctagtatttgctatacttatttctgccttaagtcgaccatttcattatgcaagatattaacacttagcatgcccccactgataatttacaaactctatagagacagctagcttttatgcatggtactgcatcatactagagccagtagggaattnnnnnnnnnnnnnnnnnnnnnnnggccattctgatgtgattggtttactccttttgctgtacagggtgcaagtgaataaaacctctagttgaaccccaaagcgctagtactactactaccccagcagaagataagaaagaggtttaaggtggtgaagcacgggggaaggtttcaaacaccagggttaatgttggggccggaagttattaagaaataatggtaataggaaggaatatactccccacaaaggtttggccagtgatggttgattcccccttccatcaggtaccaaaacgttggtggtagtgggcacactgct

SEQ ID NO: 32551 - DNA, 12002 bp, Oryza sativa
  unsure (1)..(12002): unsure at all n locations
gccttgtggcagttgctcaggatccccgtgcactcctcgttcgtccatgtcgtcagaacccactgcatacgtatgccgtataaaaacgaactagcagggttgttttaattcatgtacatacgtaattcacggcaaaaaaaaaaacaaaatgggaattaatgagccattcgctgcatgttttaatttttggacagaattttgtgcagaaaaaaaaattannngngggggggggggggtatactattacttaccttcatgaagatggcatcaccggaggggatggacttgaacatgtccccgccaacatgcctcactcctgaattttaatggtcactaattagagcatgtacaatagcgaactataagctaactataaacacattttgagaaaataaaagataagagcggatataagagcaagtttaatagtatagcccactactagctccaattcattcttagctaatctaatagtcaattcatacaatagttgtttattatactattaatatatgatcatatatgtcatacacacattgtgtattgaaggtccgcactgcagctggctacaaatctgtagcccactgcttttctctcttatgttttatcttattaaaatatgtttgcaggtggttaatagtctgctattgtacctgctctaatagcagactataagctagctatgaacatattttaaggagataaaaaagaagagcaacggactacagatttgtagccagctgtagcatggactccaagacataatgtgtgtatgacacgtggaaccaggtattaatagtgtggtaagcaactattatatgaattggctattaaattggctatagatgatttggagatatagttggctatcctattaaacttgctctaagagagaagagtagtgggctacagatttgtagtcggctgcagtacggacttcaagatatatgtgtatatgacaggtggaaccagatattaattatgtaatatatgtttataggtaaatattgtataaattagctattaaattgactatatatgatttagagttagtagttggctatactattaaacttgctcttagcatcaggaacacaacaaaatgaccctgagccccatgcatattttagcgaaaaacaaatagtcccctacattgatcgacgtgtacaactcgtgcttcacttgcatgatgtacggtagtatacttgtattattgtgtggcgtctcgtgatccgttatgtcaaacatcacacgtgaagtagctgcaaaccaacgtactactcctgtattattattaggcgtacgtatcgtttcccaggcgcttcttgtttgtagtttgtaaccactgtttcatctctaacaacacaaatactctctccgtttcaaaatatttaataccgttgactttttagcatatgtttgaccgttcgtcttattaaaaaatttatgaaatatgtaaaaccatatgtgtatatgaaagtatatttaacaatgaatcaaatgatatgaaaagaataaataattatttaaattttttgaataagatgaatggtcaaacattttaaaattttgaaaccgagggagtacttcactatcgtttgtttcctgaaactcgtggtaggtagtgatgaaggaaacgatcgagtccttgtggatgaatcgacgtcacgtgaagcaagccaaccagccatggagagacaaacgtgagccacagtggatatgctgggatgacgtcactcatactcaccgggaatgggcggcgccgccgcgacgacgtcgggcaggtcgaagttgacgccgtcccggatggtgcggacccgccgcatgatcatctccaggcacgcgccggagctgcctcccacgtccaccagcgtgctcaccccctcgaacccgccgtcgccgtagccctccagcagcgcctccatgaacggctccgacacccccgtcatcgcccggagcatcacctcgttcgcctccctgcaattgcaagtccgaatccgatggagattagattggagaggaagcagctagcagattataattaattggttgatctaattctaatctacctgtccttgccgtagtaggcgtaggcggggacgccggcgttggcgcgggcgaagggctcggggccggaggggtcgaggacggcctcgtggaggaggggccaggcgcggacgagcgcatcctggtggtgctgcagaacgtagtcggcgtaggacgcgccggagccggaggggctaccgccgccgccggggacgagggtgcggccgacggcggtgagcgagaagcggcgcggggagggggaggatgatccggtgtgctcggagaagacgccgcgggaggcgaggaggcggaggaggcgctcgaggacggaggggtccgggtggcccgcggggaggaggtcggcggcggcgagcggggcgttggcgcctcccgcccagagcttggcggggacgccgaggcggatgacggcggtgagcgccatggggacggagatcatgttggcgagctccatcatcgccagcctggcctccgccggggacagttcgccgtctcctccgccgccattttccaaactcttactcactcagatgtgatgaatctcaagtcaacactactcaactcaactgacgagacgagacaactgctgcggttgagttgtttccttcttctatctatctatatactgtatatgtactcgctgacatgtgggcccagattctatcgttggccaagatcgaatgccacatgggctctagcgataattggtcaacaattcaaatctttgtttaaatttcttttcaatgcgatgggttctttttgggtcctgatggttagataagctcgattaccgtgtataaccagcagcaaggagaaccggcaaatctcctctctcctctggttggttccagcttgcttaaaaaatagtagcgcgagatcggatggtgcatgctaccggggactaatgcgtaattagctgaaagcgcgaggaatgctttgcaaaacgtcgctgacgccacggggtttagagaggttaatacgacgttacattcttttactactccctcactctctaaatatttatcatcgttgacttttttttaaatatatttgaccgtttattttatttacaacctagactagggataagttcatgttttcacttaacaccatatatgttgacaagctttttcactttggactggagtgaagggtttgagctgccaccgtggctctgtccatggcatgcaatgcaagcaggaggtggtggactccactcgtctccacctccgttctgcattgccatcttccctgggatcgatctagtaaatcgacagttctaattaattaaaaagtctacagtaaaaataatgtcaagcaactctgtggtcaacattagtcactagggcggcggtagacaggtcatcgaaaccctcaccggcttcatcaggcagtgtgactttgtcagtttcatcaatggagaacatctcgcatgatgctaggattgaaaagaggacggagtcacgggtactttatttatggtttcttagggagattgttaattttgggttaaacttgattgattttgtgcaaatttagctactgctccgttgcgattgctgcgttagttattggtataagtgaagtaatttatgtgcacttggagaagcaacatagcagtctaaaccattgacctggtgcaaaatgcaaaagcttgcaaatatatatggtgttaagtgaaaacatagttatatctctagtccatgttgcaattattttcctatcatttgatttattgttaaatatacttttatgtatacatatagttttatatattttataaaagtgtttaaataagacgaacgatcacatgtgctaaaaagtaaacggcatcaaatatttaaagaaaaagggagtacattttagttacttttagctaaaaaataattttttgactagttatttattagggaaaagcgtgataccacaaatatagtaaatatagctgctcccattggttttgacatgcacgcacattacacgtgtgcaggcaccgcgcaatgccaatgcaccacgcgtgtcaaaccaagcaacaccccagccgacaatctgcatcacctcctttttagataataataacccgaataacctaatctattctatactggctacacacaccactatcgtcagcatcagaacacggctgacccgcaaccgcaaggcatgggcttcttggaagaagaaagatcatgataataatgcaatagttcagtcaaaagaggtgggattagattaataatctatatgagtaactgccagtgtctcttctgttcagttcagttcaggacataaatacagggaaagaacttacaatgggcagccgctctctttttactccagtcctacccatcgcaaactctttccaacaatcaattaacacgccctttgctgctcgcgctgcggccaacagcaaggcaacaaatatgtaaacctgtagtagatcgatagatacacaagaagaagacgagagaggacagacaaaaatggaagaagaaaaagaatgaagaagaagcagcagcagagctcttgtttcccctttttcctgaacaaagcttcgtgcagcaaaacttcgctttttccatcagttttattcccttccctactgtatttccacaactttacattactgaatatgcccgaaccacctccgcgatcggcgctcggcatagtgggcatttgccaccactgcgaattagctcgtttgcacattttgagcaagtacacatgtgcccgcatctgtcaccatcaccaaatgggttttacaagtacatcagacaaaaaaggttagagattagtaacatcaaagtatcagacatgtttagctgtgaagctgacctgtataatagagaatcaatttgcgcatcgcagcatacgcagcaggttcccttcctcacttgatcccattttgatccatcgtcagatagatccgtcggataccctgaaaaataaaagggacaggttgtttcagtgatttctgtacatacagagtttcagcgaaattactgtatgacaaaaataagaaacacgcaactaactgacaacatgcacaatgtctattaatagcataattaccggaaataaaacttaaactacgtaaagtgcataacaacataataaggaaattcaggtattgtccctatcagctgtagttaggtgtgccgtgtcctctgtgttagcaaagacagttatatgatgcacagatatctcagtatgcaacaaggagcaatggagtacaaccttcaggtcctgcaaagcgattcaaggccgccgacacttcttgtctcactgagcgttggagttcaagttgcatgtccatgcacgcctccagcatcctctgtatgctgctcatcccttgttgaagtctacccatgtcagctttcaaatcattaatagcatcccattcctgcaaggatgcaaagctgaataaatcctccaagatgaaactctaaatgagcatacagggcacaacttaattcaagcaaaaggaactaattaaaagtcacttataaatttcacggttctgacatctcatgggtcatggacccatggcagctggcacatttaggaaaaaggagtatgaaggaaaaacaaattctaaagacgctacagatcatgaatcattgcatgatattaacaatgtgtgtacagaaaacagatttgcaaagcatggtattgaaatagcacagataaagaaacaactattatgcaatagctccaaaaatttaatgaagagataatgcacgggatctctgtgatgtaccctgtgtctagtgctgcagttgttatgacgcaatttttttgggccttagtggctgtcggggtggcaaaggtgggggagggataacaagcgcaggtctgttaacaggagcttggaattgccgagtttcagcattcctctcttgttcctgattttcgtttggtgaattcacagatggaatagctgcatcgagattccaattgaggggtccacgaccacgtctttgaacatatgaccttattaatcgctccaaactttcaccaaaaccattactaagaagattggatacacttcgcctgaaagtacaaacgtggtcattgatcagaataagaacagatttaatatcaataaaagaatatgtttggaagaaattctagtactgaaggtcaatatacctgctaagcaattctctcagttccatgctgtacacattgtcatcatctggcgggatgaatctattttcagttctaggaatggggcccatgtcaagtggagaatcttggaaatcatcttgccagttctcagtaccatgagactcgtcatcatgccattcatcatgctcatcttgaagatgatcatgctccctggcatcatcctccatagtttcactgtgtagttcctctgcattatcttcccaatttctttcagcatcctctgcagtttcattgggccacctatcaagtgagtcgtccagagatggctgccaaaatcttgcatcccgtcctgcctcatcttgcagcctattgtcaacttgagtttcatgcatctcaaccatgttatccaaagctacacttggtgactctatggcagcattttctgcatctgcctcctgtaaacccacatcctcaagcataatttgggtcgtattctcagtaccagtgagggccctgacctcagccccttgttgaggttcgtcactacctagtactccaacactttcagccacagaagaatcaaaccggctaacatcttcactacttacagcactctctgatctgaaataagcatgttgagccatttgtcattagctggatgcaatatcataaaccctatagatattccttacgtgcaaagaactcaaaaaagacaatggcaagaggcatgcattctttggcagtttgctgtcatcagtttatctgatgctgcattaagcctaaccggcagtgcacaagaacatacttcccatttttcatgttgcatggcattgtgaatttttcacagcatcaggtgcaactctgaccattgatggacagtgttatgttagccaaataatacataactatacttcagtagaagcaattctggttctaatatttcaaaaagtgagtggacttgcacttcacgtattagtagaaagaattaaagttgcatggtatggcaaccaagaataaatgtgtccttcattgtgcttaacttatgtaccacatgcaccatgagtgcatgacacagtttgaagtttggcatttgaaactttagattttactctcgttccatctactatggtatgaccatactaattactggtcatgagaagttctaaaaatcaccacaatatacacatcaaatgaaagtgctgatgttgctccttttacaaactactctaaatcataaaagatgtaatcattcaatgcagcagtaaaaaattccatggctagtataccgttaaagataatggttatatcatattgaaatgttgtcagtaacatgaataaaaggagcacttaagcaacaggagatcactaaaacagcaccactgatgaaacctactaagcagttggggtaccagctaatagatggtaccaccatctactaggacggctcttagaagaagatatagagaggccggattcaattcaggggccctaacttccatagtgtgctactagtcaacatcatcaatatatttcatagtaccatttaggacaaattggttggtgaacagtccctaacgtgtagagcaagactgacaagttaaggtagggaccagtataattagtagaactggaacctgaaaccttgcctgtatacttgctgtgatgaaaatactcatttgatgctctagttttaaaagtagtttcagtccttcagattacagtgcttctgtaggaattaagtataaaagaagttttagcttgacgatagtacaaaatcctgcataaatcataaaaaaaaaacaatgtcctgctaaaccatatcttgcacagagcttctcctcaatgtactgaaatggtctgatcatctacttgaacaggattcataattcagatggaagtttccttctaaacaacttctaccacaactatggtttacaacttacaagtacctgcttctaactgtttagcattgggacacccattccatactaaacgtaacggtcacatatgtgactgatactcatctgccaggcaggattggcagtagaaactaaaagaaccaacagatgcacccaactctaaagccctcaatccaagaatgcacaatcaccttaacgcttcttctgaaataataatccttccaacaaaggaaacctatatattctaggcattcacaggtaattaccaatagaaattacttgacaattgacacaactagggatcaacatgtagataatatcagaaagataatatcagaaagtttccctttttaaaatttagaaaaaaaaaatcccaaattaggtcaattatgttattaatcacaatggaagtggaaggtggaattttatgctcatatgccccaaacagacaattgtacatcaccacagctcaatagaaggaagagcaatggattaaacgagtaatgtggcagtgggctcataatgtaccacacaaaaacaccatacaatactaaggggaccacaaaaacaaatgaggctgtgcaagtggggtcgtaagctacataagagagtagcaagtagcaagcgagtctaccaattatccaagaaccagacgatttgtcagaatagtataaataatgcagcgctttctacgccaacattctttgatagatgttagtggaaaagatacaaccagaaaaatccatttgcactgaaaggatacaacgaaaatcccggaaatgctcgcattcatgtaagagatataccaatcaatatatagctacaattacaagagaaagttggaactggaatgcctgctaacctcaaagtggacacacgatggctctgcctcaactgcccgagctccctcgccgccacggatggtggtcgttcctcctcctcaactggaagaaccacgttcctcaagaacctccccctaagcaatccctgtaaagcaacacatatctcagagcaccgtcgtcggcattacagatgaccgattcctgcaatgcaatgcaaagaccaacctggatgcggttgcggctgcggtgagggaactcggacacaatgtgataccctgatatcccctggagctcgcgttggcgctctcgggccatccgagtgatgacatcgagacgcgcttgtcggccacggaggcgaggaggctcccctcgcctctccctctcgccagcggctgtgtcgtccctgcgcgaggcgacgcgggagtcgcgaggctggctggccatctgcacccactccctgacgagcctgaccctctgcctctccgtctcgccgagccactccccggtggtggcggcagcggcggcggcggtggggacgtcggtgttggcggtgaggcggcgggcgatctggcgcacgcgctcgcggtcggcggtgtcgggggagggctcgcggtcgaagggctggtcggcgtcggatcggcggtgctcgagctcgcgccacatctggaggagggaagggggcgcggtcggggagggtgcctgggggcgcggcggcggcgcggtgggcgaggagaggaggaaggaggaggggtcgagggtggagacggggtggaggcgtgcgagcgcgaggagctcggcctcccggttgcgtcgctcgacctcgcgctccatggaggagagcacctcctcggcctggcgcgcgacccaccggctgaggaggcgcgactcccgcctccgcctccgcgcggcagacgactcgggctcctcgtcgggctggtgccccgcggcgacccctccccccgccgcggagcacgacgacgaggacgacgtcggggagaagcatcccccgaggtggtcgcagacgaggtcctcgaggtcccggcggaaatcggcggcggcgcccatgcggtggtggtactcgtccatgggattgggattaggattaggattaggattaggattaatgcggggggattggattgggattggggattagggcaggattgcgattgcgaatgcgaggaagaagcatttggggaagaagagaagagaagagagaggaaggggattaattgttggatagaaagattggatggcgcgagaggaatgggagacgcaagtcacggagaaaaagaaccaaagcagcaattacaataggaggccggaggaagacgaagaggagcaacaaggaagatgaagaagaagaagcggcgatttatggatttcccccctctttttttctccctttttcttcctagcttgttttagttgagggagagagaaagaagaacggatagccaagggcaggtggtggcgtcgctctctctttttttttcttctttttttctgttacggccacacaacgcagcggccaattcaattgtactacgtagtataattatcattaacaaattatactaagatttaaaagaaactctatgaaactactacttctagtttgtaatttgttcacagcatttcaaaaatcgtatggtagttttcttatgatggcgtgtattcccaagaaatacaagccccggggcccacttccagtggctccagataattcggccaaacgtggcgctgtgctttcgttttgctttccgcggcagatatggccaacggcggggctcacaacgacacgtggatttgtcttttcctctcctcatatcatactcccgtgccaatttacaacactacttatttccttccaaacatattatttttattattacaatattttatataaggaggaccatatttctttttgtttttttgtctccccagaaaattctagagttctttccacttctacttactttgtttttcccttaggaaacagcatgatgtaatggtacttaaaaaaagagagagagtaggagcggatccaacatgggtacaaggaggacttagagttttctctcacccaccgaacctatggataccccctgagtcccccctttcattttttcgtcatggttgataagatagaatgtactaaagatctcctaatagcattttagcatagtttaacaccgagattatgtgtttatgtcggtgtactcggtatattgagtcccccaattttttttcctgatccgccccctaagagagagagagagtgagtggttattctaaataccaaaatggttaagttctaagatcgaaggttgtctacaagaggaagataaaggctgttctttcactcctactcaaaagactttatggatgagttgaaatggccattttcagctcttggtgcagcctcttgcatttatttttttctatactgatttcagacttcttaaaaagtttttcttcagctgcaaaatcttttatttcttcatttttaatcgaggaagcatgtgctacgtactctctagcatttaatccatgttcttttcaacataatggaaaggattcctaaaaaataataaaaatatattacacataatgtgtcggattttagcaggtatatactggtacaataattcagctcatatcgatgtcatttattctgttccttctgttcgtgagtatttttcatggccagaaagataatcctatttatgcacacatgagcagcagatgaacaggactaagttttctcaaattgcagattacaatttgtaaaaaaaatgtgataacagtggagccatatatgattcagaagctataattcatttaccagatcatcagagatttgcccttttgcgaaaaaataaataaaatgtgatgcactgttgttatcagaaaagcggtgtcatttatgatatctgtcacacttgaacagcagttttcgtcctaattattgagagagtatatatcaaactatattatgcaacagtgatgacgatgtgcttcctccaattgcatagtgcatact

SEQ ID NO: 32552 - DNA, 22109 bp, Oryza sativa
ctagctggtcctttggaagatcaaacaatgtaatgcctcaaaaagcacttatttccaaatcatgagcactgtgatgaaaaaacaaggctaatcttgcatctttttttttttgcggggaaggctaatcttgcatctattgtctcggggagaaaaaagtaataataattaacaaaggagctgagttcttagaccctaatccttccttgtcccccaaccttttcaataaagtgaaatgatgcaatagactttttgtttagttgtctatgggaagcactgctagctacactgtacttggcaattggtaggatcatgacaaaaaaacaagggttttactagtttttatctgtccatctaatcggttacagatataattaccagttcggtataaactaaattattactacagctcgaaataaatgaagtaatccttctctcctcgcgtatgttgaagtacaacaacagtaagtttgccagctaagaaatatcggtagctagtagtagcaaattatgccagacccgtcgagcgatagccagatgccaaataataacaacaacaataataaataaataaatagataataaagagaagaaaagagaagagaagaggaatgaaaaggaagtgctagctagctagctaggtcaatggatgagcaaagtcgcagttttgtttaatagcgaagtgataacgccagtaaacccattatgcagaggagtagttgttaaaagtgatgttgcatccaatcaaagaaaaccccggaaaagaaaaattatagctcacagtgacactgcacgagtatggtcctttcatttttctctccgatgtatagctattaatattattgagtattcgcatttatttatgtttatacctaaaaaactttaaagcttgtgaacacatttgcggtcatatggccctaatttttcgtttctcaaatatagcttgccatttccttttcttttgtgatacttggaatgaatttgcagttaacatgtttatgcaattttcaagtaaactgaccgctatgatcatatatctgtaaaactagaaaaacgtacaagaagcctacagggcccaaaatacattaagcccataacagagaaagcccacagacctagacaatagggccttgtactccttaacgggcctataaaatgcaccgggctagcacctaacatagccgatctaactcggcccatttgagcccgcgtcggtgtgaggtcctcatctcattctctcctcctcctcaagatttttctcttctcatcattcgttggcttgttgcccttgcagagctcgcgcgatccatcggaggccgcttcctttcaattctcactaattaatcgagttccatatcctctcaagatgaagaataacaaggttcgtcgtaaccgtaatcacaatgtaagtaccagctttttttttacccccctcaccatctccctcatactagttatttatatatatatactgctaattacctgatcaagcaagtgtttttctctacttgttacttatcacatcatttgaggcaagcatcttatataataaactttcggtcctgattttagtactattactatactaaaatctgtgagtcctctctccagctgtaataaactttcggtcctgattttctcaatgcaaaatatgtgaatggcatgattcacatgatttgttgttgactattccctcataattatctcccaagaacccattgtaaagaacaaaaagaagtagtactccactatttattttcaacaatttgtatgaaattacctaaggacgaccagtatacttttgtttgaccctcaagaaatgcattcatgaacaacagcttatttgaactgcagaatttcacataaattaatttgcccgctgaattcttccaaaggttgttttaatttgctaccaattgaaaaaaaaaagggaaaaaaactcgatctcaaaatgattttaacaagtgggtacaaagaggacaaggcagggaagaatggaagggttggggggttgcaccggggcagtagtagccacatcatcgtcttttttctaatccattccatccgtcccctacgctgcacattgcccgaggcaatgccaccacacatgctcccggtctatcatgagccaccctagcaaacccgtgccttatcctatccaatgaaaatggggcggatatttcccgaccgtccgtccgatccgagacttgcggaagaaatataggagaaaaaataggatactcgatactatctgacttcaaatccgaattcgttggaaaaatatgggttaggatacgagaagatacgtatccgtccgtatgtcccgtattaaaaaatacatatgaaaatttattataaatccacataaaaacatgataaaatattggttaatcacttatttacatgctcacgtataatattgtatatttttttcttgatgtatatcttttacttcctccgtttcatattataagactttctagcattatccacatttatataattctatatgaatgtggataatgctataaagtcttataatatgaaacggagggagtagtactttaattatcttattatatttaatatctatgaattagagatacaaataaatatccgttcttgaatccgattcgaagtaaataatatgggacatgatacgggatgagtgatatgttacccggcactatcaaaatccaactccgaatttaaaaggaaatatgggttagaatatggaaaggatgggatccgatccaacccgacccgatttcacccctagtcacgtggtcccgtgcgtccggtcccaccatctatcctgcagtattcccctgccagtgagaaccatagaccacgggtgggtcatacgcctgcatcctcgtgcctccttttcatgcaaaagaaaaaaaaaaggaaagaaaagaacaaaggatgcattgctcttaccaccaccaaccagagatcttagagacgggatgagttgaggattagggggaaaacatgcattggatgagttgacatccaaattcatcatagcttcacactgtattactaccttcgtactaaaatatagttatttttgagttatgaatccaaacacatagttgtccagattcataactaaaaatatctatattttgggacggagagagtagtactattactccctttgtcccataatataatagattttgatattttacctgtactgtttgattactcgtcttattaaaaaaattgtgcaaatataaaaaacgaaaagttgtgcttaaaatactttggataataaagtaagtcaataataataataattctaatttttttaataagatgaatgatcaaacaatgcaagtaaaatatcgaaatccttatattacaggacggagggagtagtatttagatgatggtgataggtcagtagttgctgacactgtgactggggttacataaactctttacaggtaaaagtaaaaaagaattacttactgatcgaatgcacctcttatactatctcctttctgttcagctctctcaaggctaagattaatttaaccacatacatagagacatctaatctaatttgttgagatctacacaccgagatgttacaggctaggagtggtacagggtcttgagcctctttgctgcctggatgaagcccagaatcacctgcaactcatccaattgctgctgctttttatttagcatttggaggagattagagccagaggttaagactacaaactgatcacaggttatactacaatacaaactgcctatctaaaaggtataggtggtgtgtaataggttttcagctgctacctgagactgaaaatgctgctggaccccatggaagagctgttcctttgatggatcggggttcatgcttacctgtgcatagtttttcagcattagaccatggaaatgaaatgtaaggtttgttggatccaggctgcttacaagattgaagtgcttccagtatctccacagggtaggagttccgagtcttgtcaggtttactctctgcaaacaaaaggtaagaaacatactttgctcagaaaaaggaaatggtatgagatgtgcaaaagacagatcaaaatcctagcagctttcccagcaaactgaacgaatgatcaatgaaagttatttcgccctgttcataataagcaagatgcattggctaaaacagcagaagggcctatgacaacaatagatcctacataaccatggaccaagccatgtgatccaagggtcacactggctttaattttggattgtacacggcctgatatctcgattagtaattaccgtttgcaatattgaactggggtgaaaattgcctcggttgctggattttgtacaggatgaccagggccttgtatgccgaactcttggctttgttggtttatggtattctatgatcgctacttgcaaaagcagaagaaaattgttagttgattacactgttaattgttagtttaaagcaattggctatattgcaattatcacaggatggtcttacaatagtccatgtctttgtctcccatgtcggaactgctacagaatgaattgttgccgtcaatatcatcgtcgtcttcgttaccagttggaggttccaagacactcaaagcattcctctgcagcttcacctctacaccattctttagaacctgcattttcatgaatatctcaggtcttggtattgttttccattatatttgcatttaatagttcaactcctaagctcataaacacttaaagaaaacatataatctcaaacaatggtggttatagattatgacggtattattaacacagatgatattttataaacatgtagagaattacttgcctagctactttctaaaacaaaaaaatcagtactatatcgttcacttgtgaaacaaacatttcaagataaaaaaaaacacaataaagtaaagtttaagtgggatactaaaaaattcagtgggagactcaccagccagtgccaacctcctagaccaacagccttcttgacaacaccttgtagaccgaccaagacagattttgttcggttgttcccagtgacgatgacctttgtgtgccgaggaagcactgagagctcctcatctccactatcgtaccgaggcagagacagaacccgggaagagcatagttcagtctccatcatcatgctgattctctgccctgatctctccctggttcaaggttttgcatcaaattcaatcagtacacaaacaaactcaatactgtgaagtgttctatgattgactctcaacagcaaacaataaatagctctatcaacccagtgccagaataatttccaaaattagcatgatgttcaagatttattgcatggtgcaagaaccaagaaagctgcatgtgagatctgcaggattggtgaactttgctaaaacagtgctagtcctaaataaaagaaaaataccaactattattaggcatagcagaatttctgaaactagctcaacattaaaaattaaaatttgaccacgcataaagggaatttgaaattcaaaatcgagtcttgagtcctaagttacacaggaaattcatattttgcatagattaatttccattgggggggggggggggggcgatgaagcctgaaagcgatcaagatgatgtgacacctccatgcaactcgatccggatcggactaaatctctcatctgatgcgattgcaaacagattgaagagcattagtgactcccaaccactaaccattatggtgatgaatcggcagagacacttaccaggacccactaccagctagctggctacaagaattgctcgttacttgctggagtaacactcgtcaaagtggtgcgtctaaggaatatgtacaaaagcagtgcaggtggccaggtagtaaatcagaaaatgaaattgtgtagatcaattttggttatgaaatttagcaggtggctaggtgatttgcattaattctgtgtactagatgtaaaattatgtggagtaaaccaagaatttatagttggggcaggtaactctcctgtgttcatactttcagtaaattcgcatttaaagtgggagttacggagattgcagactacagtaatgaacaggtcggttagaataattttgctacagtacagtcttgtgatgcattttctcccaactgataccctgatgtgcccaattctaatgcaataattttaagtatagattcgaatttactgtaaaacacagtataaatttcacggtacaacgcagaaacccgatctaatcagtcagtttacagatcgtctagcttcaagatcttaattaaatggaggatgaattgggaatgctatatgagaagaaaaattgcatgcaaagccagaattccaaaatgcaatcaaagtctggatatgaacttctgttgactgaggatcgcagctgtaacagtgtattttgctatagacacaggatcctagtacatgcaattaaggatatgtgcactcttgctgcaaattgtactgtaattttgaatttgagaaagaagaagcgaattcaaaatgcacaagactgtttttgtaagcgcaatccgagctcgaattatttaaaaatcagcacaagaagggatatttaatcacgggtttaacactagcagatttatagaaagatgtaacttcgaattgaaattgcaggaccaatgatggaaacagacaacccgatcaaaatcgaatccatcccaatcgagcaccaggaatccgaatcaagctagcacaaaaccctgcaaccgagagcaggcgaaaacccgaagaattcaggggcggatccaacttgggaaatgggggttcaattgaaccccaaacctttacttgtattaagagaggctaaggctctgaaattaagagaaaaggctcgttccagatctagaagagaagcaagcaaaatcgagacaaaattaagtgggaggaagacacagatggatgagaaagagaaatgtggaggttcgttaaaaaaaaaaagaagaagaaaagggaagagaatgtggatgctcaccaggatgcagtaggacgaaggcgcccctcccctgctccgctccggctccgctatgctcgcgagatggatggagatcagcgctggccgcaggtgcaaggagcggagacgagactggagtttttcttggcgctggtgggaaggggcaaagatactcgacgcaatgattccgtaagtttatgagagaagggaaagagaagatgggtcaataagtaaaacgagctgaatcatcaatacatgattaattgagtattaactattttaaatttaaaagttaaattaatataatttttaaaagcaactttcctataaaaagattttgtaaaagaacacattgtttaatagttcgaaaagtatacgcgcgacaaacgagagaaatcttctctcagctaccgaacgcaattaaagtaaattaatccagctttaatcaaccaattgtcactttaaataaccttgttgtctcaaacttttcaattaaaaccagccatccattatttgcaatgactagtatcccatatgtaaatagtgcttgaagaaaaaaggcaaataactcaattgggatgggtggcgaaaacaaacttgttccactgacagcacccattgtctacctttcctctcctccacgcaccaccggcaccgctccttctccacgagccatcgccgttcctcctctctatctccgcatgcgcagccgcacctactagccactgacttgtctcctcttctaccccgtcgccgcgcacattgtagttatagtcgtcattgaggccagcaacgtggggactcgaaaggtaggggttgacctggtagagacttgcagacgctggatccaggttgtcggaccttatagatccgcagctgttggagggaagaaagaaaaaaagggagagatctagtgtgtggagcgatgataaagttaccggacttggaagttaagtgatgatatccatttcaacggaagtggcataacactccactctccacagtccacacttgtctcattaagactcaagagcagggtgaaggtatatatgtggtgaggcggaattggcaagggagtgcagctcagggttagaaatttcggtcatttcggatcccccgatataatattattttggttgaaattttatttttttaattttttgtgaatttagtaatattttgtttaaattttactaacatttgtttaaacttttggaaatttcggtatatcgatgacctctaatacaatcggctaaaccgaaaaattaaacactggtgcagctgcggggacgagctcgacttaattttgtcggatttttatcgtgggctgtgaaggacttttttttttgtttaatggacttacagggctgaattttaatccggaaaacagcccatcgatctaaacatattttatggagctattaaaattacttacatgcctatattattatacgctggttttaggtctaaaactggacttccaagtaaagcgtatttactcgttcaggtaaactgtgataattcatagctgtatattggtatgttactgtcaggaaagatacttttttctaaggcttggtttagttcccaacttttttttttaaaacttccaacttttccatcacatcaaaatttttctacacacaattttccaacttttccgtcacatcgtttcaatttcaatcaaacttccaatttttgcgtgaactaaacacacctttaagtcatgtgaatgttgtaaattctaatagcagaaagctgcttgtaacctagctgaggatgtatgttaacttgtctgtcagtgtacagttcattactgcttgtttagatttgcttctgttcatacttgctcaggtaaaatgtggtgcatggtccgctataattaatagctctaaccacaagtaattttcatacattgaactgaggaatttaaagaattgtttacttttttcttatgcttttagtttttacttgttcaagtaaaatatgatgcatggtccgctataattcataggctcatagctagtatgtatgtatgattatggctgtcagcaagatttttttttttttttgcacaattcgtaagtcttctcatacaccgtggcatttgaagacccggcaataatggcgccgatagggccgatagcatatcagtatagcactaacaagtttacaaatacgcatgcttaacatttacttaacgagaggggatcaaatacttgatcacacataacataagaggggatgagaggaggtaaaaatagtaactagtaaaattcacatttggagatggaattgatgcaaagctatatatagctgaaggcgtgcaaccaagaacatgcatgcctccgcacacacaagtaccatttctcacaccaaacatactacgtacacatagatataattacagcaacatcagatatatataaacgcgcttataattatgcagcggctagcttcatcgatcaccagacggtaataacacacgtagtactgtagagacttgatcctccatcatcttgcagcatcaactcggttgattatttcagagtaattatcgcttaattaagatgatggtgcatggtaattaattagtcccggctcttgaaggggattgctctgatcaccaccacgtggtagatggccgccagtgccgctccgatgaacggaccaacccagaaaatccactgcacaaatccatccatcaattagcactaatcaatgaactaaattaacgtgtgattattagcaactactccctcaaatcccataaaaaacgaattttgtacgatgaatttagatagtatatatatattcagatacataataatagaatgtgtcacgttccgattggttttttatcggatggatggagtagctaagtagttgagaaagcattaaataatggttggttgcatacgtggtcgtgccatgcgtgggcgcggttatagacgatggcggcgccgaggctgcgggcggggttgatgccggtgccggtgatggggatggtggcgaggtggacgaggaagacggcgaagccgatggggagcggcgccaggatggggacgtgggagtccctggcgttgcgcttggcgtcggtggcggagaagacggtgtagacgaggacgaaggtgcccacgatctccgccccgagcccgtcccccttggtgtaccccgggttcacggcgttggcgccgccgccggagcccatgtacaacccccgctggaaccccttcaccacgccggcgccgcagatggcgcccaggcactgcatcgccatgtagaacaccgcccgcgtcagcgacagcttccgcgccaggaacagcccgaacgtcaccgccgggttgatgtgcccgccggagatgccggcggtgcagtagacgagcgcgaagatcatgccgccgaacgaccacgcgatgccctggatccccacggtggcgcacttggacgccgacttgttcacccccatcaccgtcaggatgctgatgtacaggaacaggaacgtcgccacgaactccgcgatccccgcccggtagaacgaccacgacgtcagctcctccacctcgaacaccggcgccgccggcggctcccggtagtccttctcctccgccccctgcgccgccgtcccgatcggctgcctctccgtgtacctgttcgcccccagcctcacatcctcctccttcccctccattactattaatttgcctcttcttctttctactactcactactagctctcttgccggagccggagacgacgacgacgacgacgacgatggcgagctgtggctgtgaggagagcgagtggcttcctgcttctttttatagctcctgctccactactacgtctgcaccaatggccttctctttctcttcctctttactaattaattaattaattaattattcattttgttttagcagtcggcaatttagtaattagtggacgacaacgatgatggtaggggtttttgttttaccttgattaatctgtggatgacaggaagcgctactgttactaagcttgaatttgatggttcatcggttattgtcagcgagagataaataattcacaagatgatatgatagattagtagtatgggttcgtttgctacggggcaggttctggaaattaaagccatttttgtttaggtgacacgggccctgtttggatccggagggctattaaatagccctccggaatttcgttatttaagagtattaaacgtaaattactgacaaaactcattccataaccactaggctattttgcgagacgaatctaacgaggtatattaatccatgattgggtacattaatactacagtaatcagctgctaatatggattaatttacatcattagattcgcttcgcaaaatagcctaggggctatggaatcggttttgtcggtaatctacgtttaataatcctaaatagcaaaatttcagaggactatttaatagctcggaggatccaaacaagaccacggacagagtggtcagtttggaagattatcctttgtgtgagctcatcgagctgtctcgacttgcatagcattatctttagcttgatgatcgatcaatcatagccacaaactagccattcttcctaattgctagcagttggcaaacattgataattcagcattgctaacaactcgacccaagaagaatgaatatataccttcatattatgtgctaggtactgtctcacttgcaacagtaatcccctctcgatttaacaatctagcatataataatgtgcgtccattcctctcagtgataagactatcaagtagtagcaaagtcggctagtatgggggaaaatggccactaggggaagaagggcagctagcagagtgggtcaaaaggaaaaggagagctcactcgtttattcacttccaaattttttcttcaaactttcaacttttctattacatcaaaactttcctacatacacaaacttccaacttttccgtcgtatcattccaattttaaccaaacttctaattttagcgttaactaaacacaccctcagctatagctgcagctgttcattcattcagtcagtcagtcaccacatcaatctgcatggacatcatgatcatgatcatggaatccagatgcactagcgaacaaaggcgaccaaacacaacagaagccgcaaccactcacgaacaaggtctactgctactacttctaccgttctacgagagcagcaaacggaaggaaaaacacacgagaaacaagaaggcgaaactgtactgcacaagagaaaaggggagcttgggcggtcggaccaggacagagacgggcacggcagccgttgcttcatcgctggccacacaccactagccgcaccaccacctcccctccactccggtctccggcctcacatcacctgtgcagctgcatacaaaaaatcaattcataaaggtgcacgcccttggttagaaaaatgatgctacttccatttgcatatatacatcaaagtgacgtagtgatatggagtggttttgtcttggtagaaaaataaatggtcaggacatcacagtatttctgtatttgccgtttgctgaacaacaactgttcatctatgatgattccctcccctgtgtgtcgtgtagtgcatatctcctgcaccgacaaagctactaggctcttgccacgcgtccacatgatcagacatactctttccgtaaaaaaaaaaaaagacaaaccctggtttttcatgtccaacgtttcactgtccgtcttatatgaattttttttataattagtattttcattgttgttagatgataaaacatgattaatattttatgagtgacttatctttttaattttttatatatttttttcaaataagacggacagtcaaacattggatatgaaaacctaaggtttgactttttttttttttagggaccgatggagtagaatcgatccagggaaaagaaaaaaaactggagaagctggtttataccttcatggtcctttccatagctgtgacactcctatctgggattcgacacagttatattgtcaggaagaaacatgacagtttgagaattacagaatctgtatataaaaaaaagagtccattcgccatggatcagatggacatgttcatggattgttaggaccatggaactaaaatcacttaaaaattccttcatttcttatgtggccacaaaactatataaccggttactatacaaaagattgatgcctgctagtgatgacaacatggatccgtagttccatactaggacaacagcattgaagcctagtgccctagttacaaatacttctacgtagtactacgttactacaagtcagtggagtcgcgattctgcctccagagaacatattatgttacaataccgtgagcaaatataatttacatcagacgtatcagtgagcctctccaactccaaggccatgctgataagctttcttacgagcttacagcatcacaattggtgtccttcggtgaaggttgcatgtgcatgtgcgtgcagactctctcaggctgtcctcttgtccagaggttcctgagttcaccccgtttcctgccgagcgctatgaaggtgcctgcagtagcatggtgccgtgttaaaatgagagcactaaacccctgaagctatgaaccttctcaccaggcacaaggaaggctttacttaccaagcgtaaaaggcacaatgtaaagaagagctggttgaccatgaccatccataaggttcaaggcaacatacgtgatcataagacctaaagaaggggcaaaagaatacagtatgtcagactacaggtaaaaaacaccaacatgttgccgcacgggttttgttagatgtttcaattgttcacgtatacgtatgagaatcccttttctttcacattcacgtatgataatccttttattttgtcatttccatcaaccagcagaaaataaaaggtactacgtccatccctaaatatatgacgctggttagttaaaaaatgaactaaccaacatcatataaaaaataacaggggagtataaaccaaaggtcccattgtaattttgtttctactatcaaaagtatcccattataggacaatttagtttaagctgtatctggcaaactgtacctagagagttggaaaacacagggaagtgcatgtaagaagtggcgtcttaccagaaccataagcaaccattgaccacaaaaagtaaccagattgcaaggtctttttggcagcccaatcatacctacaaagagagattgaaaaaaaaatcagtgtagtgctcaataacgtactgtgctcagacacctgcaaatccaaaacaatttatgctgattgttctcaagcctcctgagcaatttatgatagcccaccaggattaggctatttttttttcacaaatatgcaaaagccttgcacgttaatatagcaggattaggcaaagacttgtagataaagcggatgggcagaatttaacactgaccttaatgcaaaagcaatcaacagcccaggaagaagtatatcaccaaagccaatgatactgaatccaccccatggatcaaacattcgtgggatttttaacagcatgggcacaccgtcttcatcagtcttatcaccacgggcaacctacgagcagacgctagggcaattagcatttcgcaagttgcagaagcagaacatcacagtatgaaagtagtcatctgtacctaccacaatcatcacactctcatgaaaccacatcttggagataaaaacccaaaagatgtcatataagaaggaacaactgagaagaacagatccgacctgatcatgatggaaaaagagcaagaattgttataaaagtccccactccccactatatggtaagcataagcagcagggcacaataattaccttgaggttaggtatcctaacaatttggattacagtaacaatcagagcaataccctgaagacaggcaccatgttaattaacattcaacctcctaatcatcccaattgagggtgagggtataaaaacgaaacttcacttacaagaatatcttgcccaatccaagcataggtcatccggcgataaacagcccatataacagcaaacacaatgcaaaatggacagactgcgattgtaaggtatgaaaccgctccaaagaagggcactttcacgaaagattcggcagcaggtttaaaccatctgaaagatcacatgattactggtaaggaaactttcttatgttctcttggccacagcccacagccatgatatataaatattcatctgagacgtgtctactatataaatcctagcccataaaacaatttcaaagggccacaaatgtaccttgacaataaagccaccaagcaagtttgcagaccctgcataaacaaataataaagaacacacaatgagctcaagaaatgtaagaacaacaatcatacaaacataaatattagttttgaatatcgactaacagaactaaggtcaatttaggccctgtttgtttagcttaagattattgtaatctagattatcaaatcaaattactataaactagattataataaactgacatagaataagctgtgagctgtttgtttctctggattattagaggcatctaagggtagtgggtctttagccactcaataatcttggaaaaagctcatccatagaagattattagattataataatctatcataataatctacttgtttgtttcagcttactcctaataatccaaattataataatcctaagctgaatcaaacagggccttattcttctattcgataaaagttatcatgcttggcattaaagagaaaccacaaagctccttgctcagtttggcatgattctttcatagtagttcatatagtactgcctcacaatttgtgaaatttagcatttggaaagcatacagattatatgtttcaatggataaacagtataaagatcttagggccagatatccagctaattaattacagggaaaatggaatggcattgaacacacctctacaccaccaatgcaaaagatgaccaccagaagctccacaaaccagtgagacataagcttgtagagcattatcaagaagcaagatgcaataacaacaaacagtattgccgatgtcatgttgatatctaccatgccactagaaccaccagcctctaagtttagtgaactttcatggccatcctacataaaccaaatgactgttagttctcttttcaagcaaacaaaatccagaacaatagtcaaataagcttctgttcagaacctttagaagcttctcttgttcaataactgcttctcgagcactccatgctgaccagtatgatgcacaaagaatggtaccaacagccataagccacaaaaacacctctgcagtatcaaccagaggacggtctggagagtatagctgcaccgaaactgagaaattgaaaacaaattcgatacatatgttagatactatggccaaaaaacaacttccaagacaaaacaaaatttgaaacaaaaaaaaaacctacataggacatggcacaagatttcaggtggtggaaggctttgaagatttacctttaccacgtgtaagaagcttctgtaaatcattgcctgcatcttttggcagaagaactgcaggtatatttatgtccaaatctgtttcatttcggtcgcagaccatcttgtatagctctgcaagtggaagcaggagtgcaggacacatgttaaccacatttatgagtgctcacctatattgacaaacatgtggggactggtgcaatacatgtgtccaactttgaaaaaaatctgataacacagtcaaaagtaagtatctaacttatcaaacaatatgaagtgatgaaccactgcaactaaatttgggtgtgatgcatagacattgacctttcaatgataaaacaacctaggaagtatcttgagcacgcacgcacattaactatttgcacccatggcaagaatatatgttgatctgcctatgtagggtaaagagactaatggttgtaatcttacaatagatagtaaatgatcttttaacaaaggtaagacacagaagagatttcaggtaggatggcaatggtaaatagaaggtttatagtggtccaccatgcatatgcatagtaaaatggtaagggagaatattatgctattcgactatttcaacatcttgatctactaactaatcagctgctgaacgcaggtataaagcaaaggacattatatgtatgaatttacaaataatttcacaaataaggcataccatggacatgattgatgattataatagcagaagccccagcagcttcagcattcttagcttttttagtgaacttacagtttcccctttgcactaacaaaacatctccagcaacctagataaaggaataatcagtcactgggtaggaatgtaggacaccatcgagaaatcacaaactattaatttgtcatttccagtaagctaaccttctgtgtggggggatcacaacagtcaataggatctgctaacaatagtcctgtccgattggcatgcttttcctttgactctatagtggggccaaaacgagcaccaacaccaacaaactcaccatcctctctgttattgacccaggtttgcacttttacctgataacacggtgatggaaaacaacatagttaaaagaatggtcacatgatgggtaggaatacttgttatcaataaagtagcactgtaaggtgttaggtataaaataacaaatttgaagctatgaagctaatgcccctgtgttgtgaccctgcctcctactttgcaaccaaacaggcacctggagagggcccgaggcaggttgcaacaacaggggttagccagtgagtcaggtaatgcaaggaccatatctccctgcatcgaaacttgataattctaaaactcgccattttgaaacctacactgacaatcaccatatagaagagactacaaaataccatatgctatactgaccatctaaaaacttagtttaacaactataaacactaattgaatagcactaataactagttgttcaacagttcaagtaaactagtaactaacgacaggtcctcagcttacaaccgaagcctccaaagcagatcgttaattgtaggctatagcccgctccaacgattgactgatgagcttcagaattcaaaccaaatcgggcaggctaatttagtcgagactctaagcaaagccgcgagtccgtgtccccaagttatcaatcacctgttctgagcagcaaacaacatcggtgaagtctacaattgacaaaatcggacaggctctataccgtccccctgatctgatactgtaaagtcacaaatcaatagctcgaaaccctagcttcacctacgactgaaattgaaccgaacactcccgtcccgtgcagctcggaaccgaaaattcgggtcgcatcgtactaagggcaagcgaagaaaccgcgcaagcgagatggtagaaagtctgggaaggggcgtacgaggacgaagtcgttggagcagccggggatcttgggcgcctcgtcgtcctggtggacgatgtcgccgccggccgcgaccccggccagagccgccatgaccagcaagagcgcggccgccatctccggcgagctggtgcccatggccaccggacctctcctcctccacgctgctctccgccgcgagggatggatggggatggggatggggatggagatggacttcttcctcctcttcttctccgcttctgttgtgagttgtgacgcggaggaagttggaatggactcgggggggaggtgggcgggtccacctgccagtgagccagccagagtagtacacgagaagatgggcaacgtggactggtcgcgatcagcgggaggagtatcgtgctcgtacccgatggacttatccccattctctctctctcttcgggaggtaggggctttacctgggcctaggcctgctatgaaaatgttcatgggccaggttgacggcgaagtaatcttttttttcactctttttgagtaaattgccatttggtccaccttttattacccaaattttaatttggaccacccttaaacctattttttcaatttggaccgggtaaatttaccattgttgcggtttggactaccatgacaacttttctcgtcatgtttaatttccctttcggcaaacatatgaaccatatatagaggagatcggccgtatactagagctgatgtgtttaaggtcgttgattgcatgagaaaaaaaatcattcgtggtggtccaaatcgcaacaatggcaaatttatccggtccaaagtgaaaagatatgtttaagggtggtccaaagtgaaatataggtaataaaatgtggcccaaagcgtaattcactcttttttatcaaaatatttacaaaaattagggaccggattgcaaagttctactctatctaaaaaacaagagctgacatattctagtataacagagtcaaggagggagtaggtcgctagccatgagcaacgatctgattaaggtggatccatcatgagggcgtgcggggttttgagccgccactactagcgtaaagaacttgagagcctctacaaaggtcccgctaaatttttggagagtcatagatgggaggggggattgtagatttatctagtttgttcagattcctctgatatttttctttctgaatttttcactgaaataattaattaattagggacttggatgcaaaaatgttggaccattacgcctactgggggagaacggtccaaaatatggatcgaaatggaaaatgccgggggttacaatcggaaatacgggccgtggactgtaaaaaagtttaaaaaaacccactaaaaacgtgggccttacaagtgctaagggcctagtagtagtagctatctaatccagtagtaaagttggttcgcatggcgcggcggaggcgccagtggtggatggcgtcgcggaggggatggttggggacgagctcgcggcggggcagcttcaggttcgtcatcggcgacgtgtcgcgcccgctgcgcagccactccctgatcgcctccgcctcgtacgagaacccgtctccggcgatctgcgggtcccgcatcacctccttcaagatcgggcacacgaagtaggacggcgccccgccctcaccgccgtccgacgacgacgacaccgacgaccacgacctccccggcgccgcgctcatcgccgcctccagcacgccgcatgcctcctccagaagttcgccgggacggcgagctcccgctggctcctcctccacgtcgcagcatttcagcccgacgagcgccacctccctggcgacctccaacggccagcctccagagctcgcgtcgaacacctcgtgccacgccttgctgccgcccgcggcctcccgcgcctcctgcttcgccatcaacggcggcttcccggtgacgagccggaggaggaccacgcccagcgcgtacacgtcgcgttccggggtcatctcccccgtcgccaggtgccgcgggtccacgtagcccaccgccggccttgacagcgccacgccgccggagctccgcaccagcctgcacatgccgaggccggcaagcttgctcgagcagcactcctcgcccaggaggatgttcgccggccggacgtcgccgtgcaccgtcgcccgtggctgcgtcgagtggaggaacgccagcgcggagcatgcccggtgcgccacgccgcacagctcgtgccacggcagcgccggcgcggcgccggcgaggcggtcctccaagctcccgcccggcacgaactcgtgcaccacggcgcgggcctccgggcacgcgcccacgagcgtgacgaggttcgggtgcctcgccctgccgacggcttccacctcgcggcagaaaccgacctcgtcgacggcgacgtcacggccgatcatcttgacggcgaccgccatgctgcgcaggtcgcccctgtacacgctgccacggctgccgtcgccgcctccgatcctgacagattcgtcgaaatggttggtcgcctcctccagctccggcaagccgagccgcaagaaggtcagtctctggtcaccagcctcgcttcccgccattgcttccgccggcacatcgtcgcgccggcgctctcgccggagctggtggaggaggtcgtacgattccgacagcttggcctcgaggtctctcatcatccgctcggagctcgtgatctggagctcgagctcggcggcgcgggcgtccacctcgcgtgtctgctcgagtatgtcgtcgagctctcgcctgtcctgctccatggccgcgggctccctcgccagcctctcctccacctccttccgatgcctcgcctccctctgctgcgagctctccgcttcgttcgcctgcatcgatcacatcatccatccatggtgaattttttcacgaacacgtaaaagaattgcacgtcaatatatcagaagaaaagaatgtttgtttatacaacgtaatccgccagaccggcttatgccaagagaagagagaaaagacaaaccaagaaaaactaaagaagaaaaaggaagagactactacgacgagtaaacgcaacttcaatcagcgggaagcatccatggtgaattcgacatgaacaatgggatcgaaccaacgatgcaatgcagcttggattcatttcctctacttacaattcttgtcgcgtcggcgaggtcgcgctcgaccttttgacgccggcgagtctcctcgtatgcctcatgcctgaggttctcggcttctatcacagcatccttgaacttgtcgtacgcatcgctcacatcaccagcatcctcctgtcaaaacggaatgcaccgtttattgtttaaatgtttactatctgaaacacatataatgtgtattacactgatgctgtatattctggtgcagatcagttggccaaaatcttcgacttatgaaacatgtgctgttcaaattatgtttctgtagtggagacaaaaacaagtcatttcgacaattttagtaccattttcagcagtccaagatcaaacaatctaggagtaggaaaataaacagatgtctagcacttgatgtaactgaacaagtaaacagatgtc

SEQ ID NO: 32553 - DNA, 7720 bp, Oryza sativa
ttggtgagtcctcttcaatttcttgcaaagactgcacaacagcagcagctgatctctgtacagcctctacattttcagacactgggactgttgatgaactagcaacagcaactgcttcatgattaaaaccctcagtgccacggtccatggcattgtcctccctgataggagtctgatcaactgatgatgtcgtcggttcggctggatcctgcataccgaattgctcgctgcttaggctgtgcactcgtggcgaggatctcgacctcgagtaatcagaagtgctcgacctcggagttgtgctagttgtcgatgatcctgttctattgagtccttcgttcacctccctataacggatcagacaaatggaattaaaggaaatatgtaaatcttataatatttttccaggaaaaatagaatatccttatgttagaacagctagaaagctaatagaagaatgccaaaagttcagaataatatgtcacaaactaggatgttcaggcaatctcagtgcttccacaggtactatttttgttcaaggtttgttattttgttagtcatttgtcataaacattatcatattatcagtatatcagattattctttgtctggcctaattcttttttgagcaggatgtctggcctaattcagtctgtgatcattgtcttaatgtgagaacagctaaaatggtcatagaagaacggtaaattcccagacaactatgtcgggaaatgttgccgacgcaaccacagtttctatcatgtttatctcgagaaaaaaaaagtttctatcatgttccttacaatgatagaagaataaccacgagttaaacggtgtgctacttcaattcagtcttcagtctttgtcatcagtgctatcatagaaatctacaaatacctgtcccattttgagcaagacagggagaagaaaaaccaaaggcttttgcaagttgcatcgttggcattaagacttttttgagtcatgcatgcatacctagtgcagataaggtttcctttgcagacaaaccagatcttgcaagaggggctcgccttcagttgcaccttccgagctttcttagatctcggcgcccgcattttcctaacatcacattgcatccagaattccagatcatttgcctttgaattcagcaatccactggcaccaagctggaccagccagttcttggaccgatcgattgataacaacagcagcgacagcgagagctggatttgtatgtattaatttccaagaacaagacagccataccttgaataggccttgtcagatgctgctcccatgacaagatcagtgatcccatgatcatcgacgagctggaggaggcctctcgcgatgtcgtcgcaggagaagatgatcttgctcgcattgacctgcgagtttttttcagcaactttgttagcaacccaggctgcatatggagaagagggagactgtcataataagaacacagccagaggctgctggtgagttgagactagcaatctgatattgacagcaagcaagatggatcaaatgtaaaacaatgaactctttatcatggtttcaaccttttgacttttgcaaatgtccaagagatcatctaagactttgctgatcctctcctcctccagctgcctgtatgcattcacctcctcctctgcaagctgacttactgggacccatgcccccactgcaaatccacaggtagtacccaaaaaaaaatgtcacaaaagatccaacattttttggaacacaaaagtgtaatgtaaaaggtattgtaaaggtaggaacataacaaaaggcacctactttcaggttgacagatttggtgggaaaagcaaagagaacataaacagccagctggtgtcattttacaagaaaatattggtagccaagtctaacattttgatttcatcaaaataatagccagataaaaggggaaatgttttacaacctgattaaagtcagagctagcattgcaattcttaattagactgaaaatacaaacagtgaatatgcttttagctgaagacggatatgcttagcagaaactatagtactgttccacttggcagagatgtatttgtataagattattctgagcaatagtttaagttgtccgagatgttgatttctacgcattttttttccttgataatgcacgtccacgacaagtcagaaaacaattgaggcctcaaatgggaaaataaaaggaatgtaagcagtgcacgtagaacagccgcagcatcaaaaaaccccagtttccatggaggagacagcagctagcttgaaatgggttgttatttgccaaaaagaaatggaatgatctttctagaaaaattagatttgtcgcatttagggaaggtggtttgaattattttctgttatttgcaagagcggatttgaaaagatcaggtatttgccgataacgggagatgaattttatatatataaaaagtttgcaatggttggaatactgagattgcaatggtgccatttcgaaggagtgcaatcaaatgccaagaaacagaaaaaaaaagccatttctgaaccggattaattacaagcaagaacagatgcatgggggcaattgagaacccgtaaaattaaacagaaaaaaaaaacaataagaagcataaacaaccaaaacctctgcaaacaacaagaagaccgcaagaattagcgaactgcaacaagaagaacgcacgcaatgaagaacgggagttaattggaaataaactggaatagtatttggaatgaaatagctagcgatggagcatactcatattgacccgggaaggcgggcggtggacgtggatgaggacgatgcggctcctcctcctcctccaggggaaggcggcgagcacccacatgaggttcgccttccattccttcaccgcctccttccccacggcgcagtacaccgcctccgcctccgcctcctcctctagccactgctcgccgacgtcctcctcctccgccgccgcctcgcgaccactacctccaatggctcctcctgcccctgccgcagcttccatgtgttggggttggttcttggttgtgcacaggatcacgctgcccttctgctcatccaaagctaggctaactaatacggagtactaaagccaagattagctgctaactaactactctggaattaaaaaggacaagacggcgacgcacgcatgcagcagcagcagcagcgttgaggaatgaaggaagctaggaggaatcgaccatggccatggagagcctgctgatatacagacgcatgcagatttaagcggtactattactaagctgaatctctttgcctccaatccaatggcagtggaaaaggaaggagggatgatcttcaaaagggaggaggaggccgtggcaaatggcaggaggggataggagaggctgacaggtgggcccatggagtcggatattccccgtaccttttctttcatgggatcccgtgtggccatccacaacgacgtgctcgccgtggcacccagctgcacacttgcagtttcagactagctagttgtcgagttcctccatcaatcacgatcactactgtacgtgcatgtgtagccgccttgtgtgactcccggtcacaaactgtcagtgtacttcaattgtcgttcatgcatgcatgggaccaaatactacaccaaaacctctctctgatctctccttctccatggattcaatgctactccagctagtacacgtagtagatggtcaagacatcttcctgtttaattctaatttctgaattaatgtccctctttgcatgtgcacttgaattctgaaacttcgctctgatttccagccctgcaacctgcatatgcctttcgctgcctatacgaacccaaccttaaattggattggtcggtgaggatgatgcggctctcgatcgattcattgcatgccatgttcctcctaaccctgctagctagttagttaccaaacgcatcaactaggttgttcagttattaacaagctagactctgaatctctgagtagtaagtactaggacgcaaattaatttaaaaccgcggataattgattaattagttgcgagcgagaagaggtcgccaacatgaatcacgtacgggagacatgccgtatttatacacaccgttgactaaaatggatgcttctatactaggaatatcccatgaacatagatggatatgccttgaccctgcaaaataaagcccactaccgtaatgtttcttaaacagagctgtctacatacccattaatgatgtttatagtataatagcatatgaacatgtcttaatacaccaccaagctagcttacctagttgtatttttcaaattaatggcacccttaaatgctcaaagatggttaattagtagcaccagcattaagaaaacatacctgtaggttaaaacttaattggttatcagggccacgaacatcggagataaataatcatctgggggagacttgaccaacaagttcatctgatgtcagtgatgatgagtcctcttaatgacacatggtggggaaggatgagcaatctatagtatatgttatgttttggtttatctaccttaattctcagcatttatgcgatccgaatataatgctgatctttggtttttctggtcattttgtagtctgaattttcagatcagacaacagaactgaataaggttatgaatctgtgcttacattcttagctacttaattttttcatagttaaacaagtttgttataaatgaaaatgcgagctgctatcagaagattgacatattggcggtgaagcatgcatcatgtatggaagatggaacaagaggtagttgggaaaaaagcaaacttaccaacccctaactgttctaaccttttatctccaacatttctcaatttgttcctcgttggaaaataagcacgctacacgcgtggggttcaatcagcagtactatcttttctgatttcatgacaaaaacatgtcattgtttaccttattcagaaacaagaacctgaacatatacacaccaacaaatactactattccatttaacagcgggagaacttttgctgatgtatcaagaattctcagagcacacgcatcatctacatcactgcatgcgtatcaaccgtaccaaaaattaatccgttagcttaaccaaactcatctggttatgacaaaaaaaaatgctattgttctggtagctatctggacaccattcttcagttgtctgcctgtcggtgttagctaaatagttcagtcgctttctatgattcgagatatggctagctaaacacaattccaaaaggcccagaattctaagattcacactactttcagctctttcgtagtattaggttaatgattctaactggacacctaatcaggattttaaaaatattatagagaagagagagtgaggatgccttgtcaacctcagctcattcctagggaaggtgtatcgatcgcattacgtctccgagttgtcgcataaggcacacgataagtttgtttgcgcattttatatagcactccgtatcacttttgtacttctttgatctttgttagttttgatctgatcaagcagtagtaaactttaactattagtaaagtggttatgattacaaactaatgatacaattttgatactataatcagattattttataaaaatacagttggtgagagattggtaattcaaagtaaaaaccgacatttgtttctgaacggaggtaatactaactactttcgcacccacatttgagtaaatttgtacttcctccgtactcgtttaggacaatgtttaattcaaaccttacaaatttaaatcatgaataactctcaagttgttagtttgaaaatgttaaaactatattgaatagatttgttcttgaaaaaatactttcatatgacgatgcatatatcattttttaataaatatttttatagaaagaagaagttaaagttgtgttttggagaccgtgtcgctgtccaaaacgacttcctttacgagtacgtagggaatacgttaataaaagaaatacagtttccagtaaaaaaatccaataatatgcacaacaatagacaattcaataattaatctacactttccttccgcacctatagtacttggaccaaagtacatgttgaatgccaacgtctcatcagcgcattcaccttcaaaagatgtacaggccaccatttacgtcaatcgtaagccaacgcgtattcacgagaatacgttttctgtacgtgagaacacattccagtgtatacgccttcgcgctccatttacgatttcataacagggaggcgtatttcatagcgaacgtgacacgcagaaaccaacgaggagtccactccagtgatccgcgctcgcttggaaatccgagccgcggcctcagatccaattttccgagtcaaaattctgggaggaatccatccaatccgcggaggaagcttccaccgcgcagatccccaaaccccggcccatccccgtcctccaatccacatcgatcccctgcagattcgaggcggaaatgggggaggggatcaacggcgacgccggcgacctcgcggcggcgccgtacgaccagtggctcccattcagccccgccgggggatccccgcgcccatccgcgcgttacaaggtgcgcccaattccatttctacctccgattactcacggccttgtcgtctgatttttaatttttattgttgtagcagtagttttcgtaattttgtccgtattgatcagttggagtagtagatgttgtcgtatcaattctcagggaacgcacgttaagaacaaacgaatgcgagtagtagatgctgtcgtatcaattctcagggaacgcacgttaagaacaaacgaatgcgaaaatgtgacaaaccgcgtgcctaatcctgtggctttggagatgccatctctgcgtatagtgggacaatgccgagggattggcattaggactgaaatggccgacagaagtagtcttgagagaattttggtttcagatacgcgggtgtggccacattttggtaatttccctactgtcctgttttcatggttatctgattaaagccaaagagtttatgcaaggcggcatactgaaaccgttgttgtagtgtgctccatttgttagactgtgaaacccattaaaccttaagatagtatatgataaggataacttgaaaatctttgggttgcagcgttgcctagtcccctaggagatcttcttggtgcttagtcactactctttctccttttctcctctccttgttgttctcaggagtatggtttctaccctagttaatctagcgtgccctccctctcccctgtaaacccccatgatctgcgtcagcactcagcaggtcgcagttgtaaaatctctcttttcctgctaacatatcgatgcgcaaggcttttgcgagttcgccgaaaagaaaagataacttgaatagcgtgatgttctttggttattccatatgttgtctatcatattttattgaagtgctaatacatgacagcatgctgcggaagtggttcgtgaaaaactctatgtggttggtgggagtcgtaatggccgctatctatcagatatccaggtttttcagtctgcactaatgcactctaacaaatcatgtttctcatgccatttctccttttatatcataacaagggaaaacttcacaggtctttgattttaggacactcaagtggtcagcattaagtg

SEQ ID NO: 32554 - DNA, 663 bp, Oryza sativa
aatcaccgggttaggtctaatgactgtttaactgggcctttgatgggctttgctttacgacagtttgggccttgaccgaattagtggaggcccaattccagcccagttaaaaggactcccatctccatggaggctctgccgcggctagggtttgttcgttgctgcgtgctgtgctgtgcttcgtcggcggttggcggcgaggaagatgtcgaagaagaacaacctcgccaagcggaagaagcagcacgagttcgacctccaaagtaccaccgatagatcatacatccggctgctcccttgtcgattttcctctcatctccttgtagatttcaccaaccaggcatctgatttgggattatggtggctgtcttgtatgtgtgtgtgtgcaggggaaaaggaggcgaaggagaaactggccaagaagctgcaggccaagaaatccaagatgaaggtactatcaacctcttctacatctccttttctgtctatggatgaatcatttgttgtgtagttcctctcttgctgagttagtatgatcagctcctgattggtaacactggatggtcttcatctgttaaattagcatgcgtgtttgagtatgctatgtcatgcagtttagtttccaaaaactagttttaccttattgttggtggctataagctt

SEQ ID NO: 32555 - DNA, 1279 bp, Oryza sativa
ccaaatagacaataacaaaaatttagtaataccaaaatttactcaagatttggcattgccaatattttggcatggtttcataccaaacaagtcgtaataataatccaccaaattgtaacccccttccactcaacgtatagagaaaggtaggagatatatatgtacgtgatacctcgacgatattactaagatagatagatagtacatgtgatgccaagatgttataacatacattaagagaaacactcaggggtcttccggctagctccacaaggtgatagcctaaatgacctggattcgtaacctcaccccttctaattatttgatattaggtccttcactaatattcatgttataacataaatcgagaaatatattattataacactattttggtgctatcttgaaactcaacgatacatcactagctaccattacgtataaacgtgtattaatagtataagcaaatatcaacgagtatcatcaagtatcaatgtgcaagaacgagtattagcaaatactccgtatcttcatgaataatatcaaagagtataatcaagtatcattgtttaattatcaacgagtatcatcaaaatatcatcctcgtatatcatactccagtatcatcttgttgtactttttctgacaaagatctccagctggtgacctgtttctcgaaaggaacaaaaattaaaaaaaaacctagcaaatcgttcttaaaaagaatggcgattatatatcttattgaattagtatgtctactgctcaacgagatgagaaaaccgaagagaagaggggtatataatcgagtatatgtcatcgtcgtcgtcatgtcatgcagccgtccatgacttcgtccttcccgccatcggagaaaccaaacaagcggactccacgaagctagctaagctagctagcgcgccaaaactttaaaaatcctcacaccctcttccaccttcgcttcatctccaatccaattctccatcgatcgttacacccaaagatcgagataccaataccatggaggaaatcttggaatccgagtactcggccgccgccgccgccggcgacgcggcgtccttcgtgctctcccgcttgccccaccccgacaccacggcctccgccgctgccgccttcgtcgtcgacgtcgccggcgccggcggcggacgaacgacgacgctctcgttcgtcgccctccgccgtgccgcgctctccctcgcctcggggctccggttcgggctcggcctccgccgtggcgacgcccgttctggtgctctcg

SEQ ID NO: 32556 - DNA, 4301 bp, Oryza sativa
aggagggccgtgtttgcttggcgtctctccccatctgcagcgtccacggcttgccgctgctcgccctcgcgctcccagccgccggagtgaccacggtgttgctcgccgcctcgccgttttccgatccaacggcggccatggaggcggcggccgcgcacggcgccaccgacgtcgtggcgacgcctgacgtcgcggcggcgctcgcggctcccctgacgatgctctcctcgctgaggagggtgacggtggtgcctgctctcgcgacgacggaggcgcggcaggcgttccggcggtggctgccgtgggtcgagctgacggagatgtccggctcgccggagaagatgatggcgtcagcttcggagcaagtgcaggtggcgcctgacgctgcaagcgccgcggtgatagcacagtaagtgcgcccttactgaagattctatgtatcagtcaatatttgacacttacgaaaaaatggcacatttcaccttctttacatgtcaaaattcttgcaggcaaaacagcggaaaggcccattcaatatcagtgacaagtgaaccaacttcttcggtaaaattctcgactcaacatcactagaaaaatcatgcatgaaaacatatgtactagaacaaacattggcaaggaacgatgtccttctcggggtttatgaatgagatacacacagaattgagacatgcatatagtgacaactgaaccaaatttatatctgaatagtatatttgcaagtttgaggtatataaacaatgtattcatcccctcgccgaaaccaatgaacactttctacttctgtaacaccgactacagaaaagtatgccatgacgaacacaaaattaataactaatcaattatttctagaatgtgatacaaatgattcggtatatttgtatgatgttatgctcttactattgaatgtctaacttgcctatggaaaatttctaccaggtgccactacttaagaagattcagaagactgtcttgggagatattatctcaaaatcaaccgcgaacaagatcttgagggagcacccagaaattatctcaaaactgtagcagctctgcatgcgtctctctgcttggtagctgcttgtcttggtgttggtggacctgacaaccatgctcaaagggttacaagcactgcaaaagttgtactgtgaaatatagcgaattgaatgagtggcaacagattacgaaattatagtctgaatcaaattgtatggaaacgggcataatgcatgataggagaaaaatgcagtatttatgctagcacttgatttctgtaccttcagcctccaggacttaagtgacaactctgtgtgtgaatttgtatttggagtacagaagaaatgcaggtctaaattcaaataacctctgtgggtacgtgactacatgtatttggtatcacagcattttagcaaatatctttgtctcgaacacgcaggagatctacattttagcaaatacgacttgcatatgattatatatatgatatgacattttgaccaagaaaaggttctaccccagatgatctgttattgggttcatttcacaaataccaacttttttatcggccgactcacacaaccactacataggaagaaatactataaaacaataactcttgaaatgttcgtgttgccgatcgttatatattaccattttatatcaatgttacaatagcaataccaaaatgagttaaaattggcagctcacaaatctcatcattcttaaaataaagttccagtagtaaagtggtgcaaaacaaaagcgctttgacaattacttaaagcacaagtacaccagaagttccactccaggatgttgcaagtagcacttactattcatcatcagagatctctgcacttcctgccacccacttccaaacacccccagatttctgtctttgagcagttgtcatggtttgctccacctgagatatttgttgccgcaacacttctagttcattctccaaagaatcagtagattccagtcttttatgagcagcagcaatttgggactgaattaacgagaataaggaaataggttagcgttcagaagcatgtaaaaggatcaaacaaaagaagatggcatgctcatgcttagaattcattgtagtgcattaagacagaacctccagtttctggcacctagaaccctctgctgctaactgatgttgaactgatttaagctccttcataagaaagaaaaatagtgaggatttattagagatgaattgagaattccattttacaaaatggaaaataaacatgtacctttgtcaattcaccatgcgataactttaccatatctagtctatcctttagttttgagttttcatcacgaacttctgccagtctggactctagcttgcctttctctccattaagtgcatcaagttcagtagtaatttgtttggaagaacctgaaggctgaactctcttcacatctaaatcatccgttgcaacaatgtctctggttttctcatcagttattacagcataggcagctgtcacagaagcagctgcggcggcagcagctggtgattggagcagacgaggttgcactaaattccttggcttaagtttcataacaaatatctgcagcagtgtccacttgtgaagaaattgcaaatggaaaaatgtgcaccaaaaaggaagggaagatgaaaagagaaaaaagatgcaaattcatcctgagtgtgtcaagcattgaaggcacaagacatgtgacacctaaaagtaaaaaatctacagatggatcatttcaaagctgaattgaagtactatgcatagaactaagtcactcttttaaattcaatacctcattattgtattgtccattgtaaccaccaaaggcaaccagaaacttttcgccatcaactgtggttgagcaaagagtgagaccctgaaaagttttttttttaaaaaaaagaaatataatattaaagaaaagttgtcagcaaagcaaaatccattatgttcttaaaacagtagaaagagaagcatccacatttgctgtcagggacttgaaattactgctgaagtttgaggaaaaagaaaattatctataccataaattgtggtgggtacagattatgatgatgtagattgatcagaaatatataggagttgttaaagctgtataagaaatacgatttcattttcagcaatcgccacagaactgtgcaggaaattcggctagtttactattaacatgatttgttttacgtaagtatagaggaaggaacttcctattcaaatgtgtttgttctcacagttgtgcgatagaaatttatatgagcaaaatttatcacagaactaggtagcacaattgtttacctcacaagcaagcggatctcgggctggcacactggtgactacagaccaaacgaacttggaagcattcatcataattgtatcagtagaacctgcatcgttgtattttctagctacttcagcagcacaggtggtgcaataaaatgaaaatatgagcatcatgtgttcaggaattaccacttgcgttatctccgccaccaactatgtaccaattttcatcaatcatggtaccagcatgaccactcctaggatttatgtgcgcgccttgagtgtcaggttgagaccactccatctgtaagcattaagcttcacttaatcaagaatgaatagaaaacaatgttcataggagtattagtcaaatcataacttgggttgatataaggggaggaaataaaattctccttcattcagaagcacaacatgatttgttttatgtacctattgccagcttatgatatacggtagttgctgttaagttttcgccataacagactgaagttggatcttagtcattgcatacaaccacccagaaattcaaccttagtttccattaactggatacagtttgaaacttgaaaggcctactagaacctagaactaccagtgcggggggtttggagatcttcaataggcaatcaatgaataaatatcaagacaactgagtaactttttgcctttgaaacttatggtatgtgactcaatgcacaaatccatctgtatggcaagatacatggagagtatataacacttacagtttgcaagtcaagaaggtagatatcactaaagcatgtagagtgagaggaaccgccaaagatcaaagatactgatcagcataaacagcagctgaatgatcatacctaggagtggaccacctttcctatttcacacaaagataataatgaattatgcaataacaatacgtaaatggaaccttgcacaatcaataaataaatt

SEQ ID NO: 32557 - DNA, 335 bp, Oryza sativa
ctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgt

SEQ ID NO: 32558 - DNA, 1243 bp, Oryza sativa
ggtttagtttaattaggtggttaattacagcagctagcacaggtgcatgctattgttagaaggtgtaaataggcagtataggagatggagcacaagaagaaaggttaactggtggccaaggaacgggcacgccgagagtgtgtgttaaaaggctcccttttaattacttgtggacgattttgatgcctggctagctccctctactagctgcttttaacttcgtgtgccaaatatgtttttacatcattattagacacccttaatttagccccttgcttgttttccaaatgcttaattacttaccctcttgaattaacccatcaaagtgtatgtgtgtgtgcgtgagtgaggatgaagctgtgcctactcaactattatactagtatctatagttagcatagctgttgttttctttttggtgatgaattcaagtaatatactccctttgtcggcttcatttctagtatttttcagataaattagtaatgatgagaaataactatggtgtctcttattcatactcctggttgtatttactaattaagctccaattaaatgccttagtctgattggtttgaaccctttgaaatctaagtttttttatgggatgaattttaagcaccagaaattaagtctttctagaacggagagagtagacagaatagatagagggagctaggtgacaacatgtttgccactactaatatatgtggacatggacaagagattgaaaaggatccaagtaggagtggcgagtgagtaatttgtgcgtggtaacaggtaggccaagaaagaaaagaaaccatgcaagcaagcccaatattccctgggggatgatgtgcatgtttggatgtgtgattcctggggtgatagtgtcacactgcaaggctgtcttgaaccacaggagaaaaaatactctgctttttgatctgcttctcatgacctatatatggttctttctatttctttgcttgttttaataattagtatgcctttaaatttagtaataaaaggtatatgtgaaagtccaccaaattgtttgatggttcttaataattgagatctttatttacatggagagtagtctttggcagcaattccactgatgatgaagcgctaatagacatgaacagctagttttgcttggcagttggcaactaaaattaggaggtagtgaggtagtggtggtgcagctgcagctgtctctactctccattggccacacaaaaatacctgcaatttg

SEQ ID NO: 32559 - DNA, 5707 bp, Oryza sativa
aagtcaacgagtgatcgagggaggaacgggtggtgactggttagtagctgattaatagatgattcttgacgtgatgaattgttgtttgttgtgtggggcaacaaggaacttcattagaaaaaagaaacagagtttaattagtttggagaccaatgccaattggatatgatgctgtggtgtggtgggggcaagcaaggcatcagttggaagctggtctagcttagctagatatagcttcctttctctctctaacacacttcctctctctttggatctctcaacactacacatgcatctacacttgctggtcactcacttgttctgcaatccaaactacgaggaaattaatgatcagatcagtggctgctacctgcctttgttttctctttgccatacttaagcagtgcagaaaagataagtgcccttgagcttgccatgatcctgcccatgattggcaattagccaagttgtccctcatgtggagaaccctagctttaaggatctaattagtgcatgcaacgctagttggacaactagtacccctgaacgtgatcacttctgttaagctgaccattatttatccaaaagattaacaaatctttgtatacacacggcaagccacctatccttctcttaaaaaaaaacaaaaacttctgagagcagctcaaatgtgctgagagctgatgtcattgcctgatcaagttagcaaggtaagttaattagagagtgcatgacactcctctggataataaagctttaagcaagatttgttactaaaaccttgtgtgcttttgccctggccaaagtgcttagtagcatatttcaagtcactatatagggatctgtaccagcagtgattcgggcacacaccaatgagactgagttggggtgaattaaggaatctgcctgcctgcacagaccaaaaagaacacaaataataagtgaacagaataaaatccaggaaacacacagtggattggaatatactagaagtgatgaaatgaaatatgtggtgcagttgatggacacccaccaagcacacataccataccagccatggatcatccagctgcctgcatatattgttaagtagtagtaggatggagatgagctgcctgactgacccggctcaagtggatgatgagtgaagcagtagtgggacactcgacagtagcagcagcaccatccacaatccatgtataattagcagggggatcactggctgcaagtgactgggccaccactcatcacgtcatactcatgctactagacaagagagatccagtgagaccaccagtataaacgacgagatgatcacaaaaattaagggactgttcagatgattatcatgatggacggaaaaaagaagaagagagaaaagaggagaagaagtgtggcaataaatggagagacgagattcactccacatgacaacagctccccgaaggatcccaagcagaagcagcagctgtatcgtgctgtctgtcatgcttggagaaccgttaatcacgatgcatcatcaggttcaggcctcactgacagagtgacagacatgtcttctccaaacaaacctgcaggccctcaagtcaattactggtagttggtgttactactaagacgtactttgtggatacacatggcaattgacacttgtgcagggtagcaaggaggacataaccacacttccaacttccaagctaggatgggaataattcaatatgtggcaggatgattcttcagacttgttgagaagccattgatccataatatgcccctgctgatggaattgtatgattgccccaagttaaattagtggcgtggagtgaagggagagtcaatgcttcatcacataatagattgctgtggctgccaccttaagagtgtggcaagtgttggctttgctcatgggcaaccactcctcacacactgattggtgggcaaaccttattccgatgccatgtgctagaatcatcttttgttccgtctcaagtcatgcctcctctttgcttcctggctgatgactgcatgttgctaattaaactcaacctcacacatgtacattttctaatgatgtggtacaagtatgcaccgcccaatgctccaagaaacttaaccacctactgctgctgacggacacaagcttaattgcttcctacagatgcttctccactggtgcattaacttaagtagttaactaaaagttctccagctccatcagtttgcatcttcatccaacgaaatggacgtcgccacggtaacaaccaacaagtattgggcaaaagttaattctcactgtcctgtgagagatagggaaaagaggaaaactgagaatgagcaaagagaataacaaaatactccaatgccttgtactagctactagctctttggaaaaaaaaaatccaatgccttaataggccattggtttctgaaaatagttagtattattttggtttatttccactgttgctattaaaaatcatttataatactgtcgtttgattagtcaacattaatgtaaagctaaaaaaagctaatggccaaagctatatttcaaagaccacgaaaaatcgagaacatcaaatagaaaaaatagggagggagtaatagctaagtattatcttacataaagcaaggagaccggaaccttcaggttgctcacagccagtagtaattctccgttcagtacaactcttatccaacagtataggaaaatagattccacgaaaaagaaatgtgggtccctgataatgacttgtaatgaatgtcagataatatccgaaataaccagaccttagataatataatccctaacctttctttgccattctttttggaataataagtctggagtctgggatttggttgaatcgaccatataataataacacagtggtgcatatacagctttagcgaagataaaaaatgacctgatcccaaaagtgcatccacagattctccaagattcacacagcagtatcttatgatggagatcaaattcagattatcaccagagttaacatgcttgccgaacttgcaaggttatagttagttcggtgaccggccaaactataatgcgtctctggcaagttggccatcactcactctctttgtagctcactgctcagctgatgaacactttttgctcgcaccactgataagtaatgaagacatcaccttcatggccaatactttctgctgcaacccaagtgatgcttccaaaattagcaactttggtagctacagagtccctgtttatcgcacgcttatcagctatcacattatgctcacatttacaaatctgccactgagagtatgtactgccgtactggcacttagtttgctagctgcaaaatgcaaattgaagaaaaaactgtatctgtgaattttctttctggtaagagagtcgataccatcatgacccacccctctaagaactaacatatcagaaatgcatccctggtttcaattcaacagaaggtcatcttctaggtgcacagttgccgttctagaccattctattgccctgcaaccttttcactcatctactcatagctatcaacatatatactataaagacatcggtgtcttgaggcagaaattagaatatccacaaaggatatctaaccattttgctagccacaaaaaacacacggtgtcacatgtccacacataatcagctgagcgactagtgtcactacagagtgaagtggctctctctcctctcactccctgccactagggagctgataagtggcaaaagtagtaagtggtactagtagcagtagcaggtgtggcaccagagcagcaggagtacacgctgagggtagcaagggacaacaacaggtagcaccaatccaagcagtagtggctgtagtgaaatttggacactgtacgagcatcagcttgtggaagcgaaggaaagaaagccttttttcaggagaggctgggattgaggcatatgaatggtaccgtattcggtgtgacactagaaccagagcgttccctgagtgcgacgctgcaaccaatctcctgcactcactcaagcaacttttttgcaaggccagctgatctgcttggtccctgtgttgtgtgcatgtgaagtgtcaaagtgtgaatcagtggaatccatcttgtgcactaggtcatcacttcacttcacttcacttaacttgtggcctcataccggtctcgtgaccaccaccatccctctcctttttacaaccatccttctgcttaatttacacctgtattgtaggtaaaatcatattgtatttatttcatctctcaaagagatgatgtatttatttcaagtaagtaaacaagaaagaaggaaatatatgtgtgagcttcctaatttctacataatacgcaagcctcacccactataagccgttgcttgtctataaaaatatataaacggataagtctgggactgggatggtttggtctagtctgcctacttgtgtagtagaggattgtgctcttcaacgcaacttgctgtaccatcaactttagatatatgcctttggcttgggatggatgtgtcgtgttgagttgagttgagtggtgctgctcctctcgtcaatctgtggccgctctcaccttggcttactactactttatagtcatttcatatttttcatcctgggtactgcaggtgttttttcagaatcaatagcctctaatctgcacaacaagtttcatatactcctctgtgaatatgtcaaatgacgtctaaggtgctttcagcatctttggtcaaaatcctagggtgaagaaaggggtaatcagaagtattaattgatcaccatcttttcttccccccatttttaagataagatcacaagtccaatcatactagtagtatacgtttttgtgtgtgtgtgtgtgtgtgagagagagagagagagggagagagagagcataacgaaacttggatgcatgggcctcaaagggggaaaagagcaggcccagatttaaaagccactgtcaagaactaagcccagctcagctcgtcgatcagaagctttacaacctagaagcttttctacaggcaatcagcgatctgcatgtacggatataccctagaactagtcaactagaatgggagggaccaaggggttttgtggttcacaagtcagttactcttatctggttttaacaattatttgtgtggggtctatgtagtctgggcacaattggcattttcgcatgggcttcatctggcaagataaagaccaggtggaaacagcagagtgaacaaatattaacccacataaaaatctaaatgtcatcgaatagagcatgctgtggatcaaacatggccaaatacatggaaagctttggatgactgaatgcacagaacagatagaagtaaacatacctcctttttccttggcttggtaaatgttttgtgcaataacctgataggcacaaacaatatcaatgaagttaacttctgtgttcatatgaacttgcagcagtacatgcacaaaaattggtttgatcaccatctttaatatctcattgcttaagcagtgacctggaaaagtatcactccccctcagtatactgaccttgtattggccataaagaagtgaataaaattgttgaagtccgttcagccaattcatttttggtccattcaaatacaaagacatgaactggaaaatttcatattgttgcaacaaatctgaaatatttcagc

SEQ ID NO: 32560 - DNA, 3500 bp, Oryza sativa
ttcacctagcagctgttgttatgtttaaatatgaaagggatcttcgtttcaaaaaatgtccaaaggctactcatggtgcaacaaacatcatcactttccttcattagtactagaaaattatttgcagtaaagaaaagaaatatttttgcaggtaacaactacttcatagcaaaattaaaaagacatctaaaaggcccaagtgggcaaaacccagtaaagcatcattcttggcaaatagaatgcccaagtgagcataaaccagcaaggcatcatttggcaaatcaatgtgtagagttccacctccccaagaccccaacaacaaattgcataaactataagaatatttgtatttgtacctgcagcaacaattattgttaaggagttcttagtctatccaaatttagcactgatatttcaaagagcacagtattttcttttccaactggaacatcttttcctccatctgggttgtggatgcaactgtgcaagaatgtctgcagtgtaacatgtgttacacatcctttaacctcacgtacatttagtttgtagtaaatggtacttgccaccaaatcattctccaagtgatgagactgcccggccacttacatgtctagatgcactgaagcagtatatttccgtaaaatatgtattctgggatttctgctctcttgcaagatcatacctgccacatttcaaacatgccaccctatgagattactgcaacaaacttttcagagagccaaaacgcttgtcgaggattagacaatagaatcattcaatcagcactactgaccaccctgacaagataaagaaacatctatatctggtagataagagaccaaacttcgcattttaaactctgtaaaggtttttaagtaaacgttgagcttgccatgtcattcctggttttgagaatgctctgcatataaaactaagagtgcctttagatggactgaatcctttttctttcatatctttgagacattttttcacctcagttccatttcgaatccttgaccatccacttacaaggatatcataagtacaggatgtaggatgaacacctctcttttgcatatccttgaagagctctttagcttgagtcatcattcctgctttagtgaagtcacttataagagcattataagtgcttactttaggaacaaagccctttcccaccatttcacaatacaatctcattgcttcgactttgttgctttgttttccatgtcctgtagccagtatgtcataggtgagattattgggttcaagcccactcttctccatctcaatgagcacggtgcctgcttctccgatccttccaacagactcaagaccacccagaagcgtgttgaaagtagctatatttggtgaaatgttttggtgaagcatctgagcatatgtagcaaatgcattatctagatggctgctcttgcaatgaccaagaataagagcattgaatgtgattgtgtctggggcaattccactccccaacatttcttccagaacaactgtggcttttcttgtcatgccatggtaacacagaacttgcaaaagcgtattgtatacggtgatatcagcatgaagcccagcattcatcatccattcatgaatatccagaatcacatccaacctcctgctttgtgaacatgcttgcaaaacccgtcgatgagtcagagaggatggagagaatccagctgagaccatctcatttagcaaatactttgccttctccactgccccagtcccaaagagaccagcaaccagtgtgttgtatgtgatgaggttaggctttatggagctcatcttcatttcatgaaggagttttagagctttagcagtctctcctttcctgcaatgcgaaacaatcatagtgttatatgttgattgatcaggttttaatcccatatttctcatctctgtcaagaaggattttgcttccttaaacttcccaagcatgcaaaggcaattgataaacacattataaacaactgcatcgggcaacatgtttctgtccattaactcctgaccaaacttaaaagcagtaggcatgtcgcctgctttgaagagcccatctattaaagtggtatagtttacgtgatctagtgacaggccactcccactcgcatctttgaacaatgccatggcttcctctatttttccgttctgtctcaaaccattcaccagagaatcaacaatgaatttatttaccttgacaccctcacatagcatgtcatggtacacctcaagagctgcatcttgcccttggaacttgaagaaaccatcaataagtgttccgtaggtcaccacatttggattgatgcccctttccttcatcatcctcttatactcagttgctttgtcaagcaatcctcttttaacaaagccgttgatgaccgatgagaacgtaacaacatttggactgatcgatttctcctccatttccagcaacacctgctctgcctcatcgacgttgtgagctttgcagagagcgtcgatcaatacagtgtatgtaacaccattgggggagagattatctgaaagagcaaaacgaagtgtgtcctttacttcatcagtcttgccttgtttacccaaccagtccatcaaagcagtataggtgaccaaatccatgaccacgcctctagaaaccatctcccccaacaggctgagcaactccttgcccctcccagctttcgccagcgagtcaataagcgtacagtaggtgacatggtttggcgcagccccaaccttgtccatctccctgaaaagagcatacgcctccgagaagcggccatccctacaaagtccagcaacgagagcgctaagcgtgaccacatccagcagcactccattcctgaccattccctcatacaaatcgaatgcctcctcgacccctttcgtcctgcagtagtacacaatgaagggtgtgtaggtcgccacattcggatcaacccctgcctccttcatcatgtccagcacgccccgcgcagcatcaacctggccggcgcggcagaacccggcaaccaaggtattgtagcccaccacatccattggcagcccctgtgccgtcatcctgtcggccacggacaatgctgcgggcgtgtccccaaccctgcaatatccagcaatgagagtgttccagccgatgacatccaaggcgtggatccctccgcccctgtcggccagggccgccgccgcgtcgacctgcccattcctgcagagcccagcgagcaaagtgttgacggtgaccccgtcgaacggcaccccgcgcttgcacatttcggcgagcaccgcgggggcatgggcatggtcggagagggcggcgagaaggatgttgtaggcgacggtggtcgggcgagaggagcggaggagcgcgatggcggggcggagcaggcggaggcggcagtgggagtagaggagggcgttgagggaggcggggtcggcggggcggaagcggatggcggcggcggcgaggccggaggtggcgagggcggggatga

SEQ ID NO: 32561 - DNA, 17569 bp, Oryza sativa
tggcttttttgcatggaggccccttgccgccctaacaaaaaaaaccctccctctcccgtctgtcatcaccgcccgtccctcccccgtttaccacgtcagcttgccgctctagtggagggcgggagggtctatttttgtaattttttttttttgccgatggattatttctgtaaatattaaaagaaaaaaatttaaaaatgaaaaaaattcgatgagtagtagggcttctctctgggcttctttcgggcctgaacgcttaaagcccgaaaccaatagtgggcctttttaactctcgcggagttggccagtaacctgttgatgggctggaccttggcgctgacgagaatggcccatactgtcttcggcctagcccatagcactttcagaccaaaaaaaggaagactaggggcaaatccaaatgcccccttaattcactggtgtttctatattttcccttaccactcaaattcatgcacaaaactcaatccaggtcaatttctcttctagctttcccctgatatcccgttttcatatattttccctagttatttcagtttctagtgtcccatagacctccatcttttcgagttgaaaactggatatggcagaagtttgaagaaaatttgactcatatgagtaggggaagtagaaatgcaagtgatttctaaggggtatttggattaggtccacctgagaagcagagtagagctgaaattttgattgcccatttgttgatcagccacgatcaattcttcaattctgaaattaaattttagggttcatttcgattatattctatcgtgatcgatctatcacttttaatttttaaactaccaatagcacatgtataagagttttatccatatgttttttttatcaaacctatccaatctaaggctccatttgaacacttgtttagcttttgcagctcctcatttactgtgagtatgtttcctaatctgttaaacgacatgttctttgcaaaagctttttatatattttttaatttataatagttaatacctgatcgatcatatagtaattaatattatttctcgtttcgcatgcggaaaaaaaacaaaaactaaacgtggtttcaaacagagagcaagcagccaagcatgcacgtagcttggtggttgatcgatctgaaattgtgaatggggtacagtaataaacctgatgataaatgtggtgtgtgcttgtatctgaaaaaagtgaagaaggcccggtgacatgaaaaatgatgggacagacagaactaagatgcatgatcgatggaaatgtgaaactgatccattattattccagccgagatctatcgcatgcaattgtagaccactttatcaaattattaccgacagttagctcttcacagtcttcatgtgcatgcattgctgttcattatctaaaacaaaaatgtgcatgtcgcgttgagttgatcgatcacagtacaatatgcatgcattacgcatgcttaatttgcctgccttatgcatgcatgcgctgtttaacttttttatgatcttctttttctctgatccgtgtgctaatcgatacagtgtatgacatttgtcgtttgtaaaacgcacgtggtttatctttgtactgatctgttgggtttttatcgttttgaagagaaataaaacatagccgaatgtactcgctccgtccaactaagaggcaaaaaaaaattgaattctagtaaaaggtcccccccaaaaaaaaaagaaaagaaaagaaaaaacggtacgatgttatattatattactaccacaaagatgcaatatacagtaccggctggagtagtagtaagaaactatgggttgaactcttagtgactagtgagtcaaattttaaactctagaattgtaaatctttttcaaatggagaaagtatatgagaatgtttagataagattctaacatgttgagttgtgatccaaattcatttgcacttaataaaggccagcttctgccgtagtggagcggaggcccgtcgccgggaggcttgggcccatcccttttggggttccaccatatatatacctcttgtaagccgccgtgcggcgatgtaacctcacctcagatatagtaaagatattttactggctggcgcccgtggttttttctctcctgttttgggagggttttccacgttaaatctcgtgtcttctatgattgatctattgttttttatcgtttgttcgcttatcgtttcctaacataacatatgtatagctgctccaaataattcaacttatcgtttcgattcaaagaagttaattgtagagttttaaaaaataaagtaaaaggtaaaaacctaattttttataaaagggtaaggaaaatttatttaaggttttcccgaactgaccgtatattacccacggacaacatggcagccgacaaactattattaatgtgatcattgcatatatatatatatatatatatatatatatatatatatatatatatatttcaaaataattaatctcaatgttatattaaaagaaaagtaaagggaaagggaaaggggcgaatataatagaggcggtcaagctaattaaggtcggtagggaggaccaagttaagtgatgatcaccacgtgtcaacgctgaccgcgtccatgtcaaaatcatccgctcaccactagtagaaccactagtagtggatcgatcgcttcattcagatagccagccgcccaggccaagttccactttaatttcatccgtttttagtcatgcatggccatggaaaatatatagcttgcgtactccctttaatttgttacgtggaatatatatatatacctactagagaaatatgacacatcacaatttaaacatgttagtacacacatcacagtactataaatttaaacattgtagtacgagatatgatatatcctaataatataaatctaaacatacatcttgaatatgtatttctaagatgtatcacatatcatacgtattaggtttatttttatgggatagagggagtatacatattagaatacgtacgtggattatattatatgatggggaagattgattttttttttaacttttgtgttggacgttttaaaaaagaagagtagttttattgggatcatcagccacgtttgttttaaatactgactcaaaacaatatctttctgaaggcctgtttagttccccaaaattttttctcaaaaacatcacatcaaatctttggatacatgcatgaagcattaaatatagataaaaagaaaaactaactgcacagttatggggaaaatcgcgagacgaatctttaaagcctaattagtccgtgattagccataagtgctacagtaacccacatatgctaatgacggcttaattagtctcaaaagattcgtctcgcggtttccaggcgagtactaaaattagttttttcactcgtatccgaaaaccccttccaacatccggtcaaacatccgatgtgacacccaaacattttcatttcctcacctaaacacaccctgattatacctcctgaggaggaccatatatgcggccatagaataatttatatagagtacttccaagcactttgtcattttgctactagctaactaaaatatactatactcccatattttgggcacgcgacccatatgcatgcacacgagtgcatacaattctgtgttttatttaacttttggtcaactagccgcaactccataaattcggtctgaaatagtagcgcgtatatatgatcgtcttcaacatacaatatataattaccccaaaaagattgatctataccaaaagattgaaaaaaaaaacactagaagctgatatctgtgacgagcgcaagcatggccgttagggtgacacgagtgatcgatcgatcgagtcatcgagagactgagcatgcacgcatgggaaatgtttaatttaaactgtatagtaggcagctcaaaaaatccataaaaattaaaaaaaatacagaaaaaaatacatatgcaggctattcgtactaggattgttggacttgagttgccggccaagttttggaggcgccgcaaatctcagaagtatgaattgaaagctgctgcctaccaggctacacagttcttgcgctgcctctttcacatgagctatcttaattaattattcgtcgctacagtctctgcctccaatttcatctagaagtacgttgctgtcctaattaacatatactgtacgtatataattatatgtgcaatactactccgtccacgattgactagtactgattgacatcatgaaaaagatcatttgtgtcatatgttaatatgcatcatgcccccttcaattcaacaccatatcatcttaatgactttctcggatttaatgcatgacactccattcttccacacaagattggctacatgggcatcgagaaatgtaaatattaatgaatcgcttatttacgaggaatgactattagtatgtttaaatagttgataagtagaattacttatccttggtctgtgtgccaagataaaatatgactatcaaaaatagatggaaggagtatatatcataatgatgagaaatctcgatcggtacaaaacggggaacacatgcatggagatatatctagaccaacaagtacgtacagaaataaacttctgtcgaggatgtacttgaacatgaatgtttgcttgatattgttatttagctatattttagaatactttacaaatggagggatgaattgcaagtacaccctctaatttaaattagattaaattaaacacatggtgaaataggaatagttaggaagctaggcagccgtaaattaacctaaaatgtacatattgatagaagcaaggcatagtcatttatgcgtaaaggtaggcaccgacgactacagtagacgaaattttgggggtggacggagagttaattatttttccgttatatatttggtacatatataggtaattaattatgtggcggtttatataaataaataaataaataaagggagatgcatgcagtatgaaataggcaaagggaggcgaggagaaatacggcatgcatgttgaccggaaggcatacacatacatatgcagaaaaaggaaggacggaaaagaaaagatgcatggcggaaagggaaaggcccgacgaatgggaggaatcatatattccatcgattagagcaagtttaatagtaagttcaatatcaactatcgaatcaacatatataagtacagtagttgtaaggttatttttaatttttcttctcctctctttttctctcactaatgtatttatattagagcagctaataattaattgttgttgcatgagagccaacacgtacgttttcttttatatattttttcttttacataataagtttatagtgtgcttatactacctcattgtattatgtttgctcttaattaaggcattaattaaggtggacggagaatcggaatggattgatgcgatgcctccactgggggaacctccctcttctctggatgcttttgctgtgccggcgccgcgtggttcttcgtttcgtttgtctcgccatctcttaattccttacgttgaccattatttaagcctcaaaatcatctgtagcttagcttgttcaaggaggccgcgtcccgcgtgcgtgcgtctgtcgcggtcgcggtcgatgccatgctatgctagcatcacctgtcaagcacgcacgcatgcagttgatccagtcaaaccccacaatctcctcaggcctcagctctccatccatctatatatacattaacaccacaacaccccttcccgctcataccatccatccaaccatcgatcgatcacttccaacttattttctttaagagaaacaacaagcttaagctagctagttagtcatcttgttaattttggcctcaaataggtctagaattcatcaagaacacgagctagctagctgcactgtctcgctatatatatatatacactgctcatatggagctagtggtgcaggctttggcggccgcagctgccctcctcgccgtcttcttcctctccaccttatacctctcgccggcggccaccgcgcgccgcctccgcaacgccggcttccgcggcccgaccccttccttcccgcttgggaacctccgcgagatcgcctcctcgctcgcctccaacaacgacaccgacgaatccaacaccaagggcggcgacatccacgccgccgtgttcccctacttcgcgcggtggcggcgggcgttcggcaaggtgttcgtctactggctcggcacggagccgttcctgtacgtcgccgaccctgagttcctcaaggccgccaccgccggcgccctcggcaagctctggggcaagcccgacgtgttccgccgcgaccgcatgcccatgttcgggaggggcctcgtcatggcggagggcgacgagtgggctcgccaccgccacatcatcgccccggccttctccgccaccaacctcaacgacatgatcggcgtgatggaggagacgacggcgaagatgctgggcgagtggggcgacatggtggcgtcggggcggagctgcgtcgacgtcaaaaagggcgtggtccggaacgccgccgagatcatcgccagggccagcttcggcatctccgccgacgacgacgacgccaccggcgccagggtgttccacaagctgcaggccatgcaggcgattctgttccgctccacccgcctcgtcggcgtgccgctcgccggcctcctccacatccgcgccacctacgaggcgtggaagctggggcgggagatcgacgcgctcctgctcgacatcatcgagtcgcggcggcgccgagaaggcggcggcggcgggaagaagaagaagaagacgacgtcgaacgacctgctgtcgctgctgctggccgggagcgaggcgagcgcgggggcggagaggaagctgacgacgcgggagctggtggacgagtgcaagacgttcttcttcggcgggcacgagacgacggcgctggcgctgtcgtggacgctgctgatgctggcggcgcacccggagtggcaggcggcggtgcgggaggaggtggtggaggtggccggccggtctggccccctcgacgcggcggcgctggggaaactcaccaagatggggtgcgtgctgagcgaggtgctccggctgtacccgccgtcgccgaacgtgcagaggcaggcgctgcaggacgtcgtggtggtcgccggcgacggcgagaagaaggtggtgatcccgaaggggacgaacatgtggatcgacgtggtggcgatgcaccgggacggcgagctgtggggggaggaggcgagcgagttcaggccggagaggttcatgagggagggggtgcagggagggtgccggcaccggatggggtacgtgccgttcggtttcggggggaggatctgcgtggggcgaaacctgacggcgatggagctccgggtggtgctggccatggtgctccgccgcttcgccgtcgaggtggcgccggagtaccgccacgcgcccaggatcatgctctccctccgtccatcccatggcatccaactccgcctcacccccctatgctagctaattaatcatattattcatagttaatcactcaattatgttttgtttgtgcatgcatgcatgcaaaggcaaagcaatgcatctgcatgcgtgcgtgcgtacgtacgtatactggtgaccagtatacatgtagtcgtatatacactaataccatgcatgaattaatactagctaaagcttgatgctttaagctttaagctgagctgtgtcatatgaatgaataattgaattgaatcgatctgccggatggttattaacttattactgctctctctgtttcatatttgacttttttttctaaattcaaattgaactaagtttatccaaaaacaaagtaattaatgttttgaatgccgaacaaatatattatcaaaatatatttattgttaaatttaatgaaattaatttaatgttataagagttgttatattttttctataaactcagttaaacacttacagaagtttgatttttttaaaaaaaatcagagtatcttacgatataaaagggatggagtactatgtccatgtttaaatatatttacgacgctgctaattttatatatgtggtttctatgtgcagctttgacaataattttctctaataaattactaaagtatcaactgtggatcggaagtaattataaaagaagaatcacctatatgatttttatgtttcaaatttgaatatatattttaagaactattgatagtcaaaatttaaagagtttgattaaataaaaattatcattgtgtgcataatacgtaataggtgcaaaaatgcatgtgtgtacgcagaacggccgatgatacatatctcaatcgatatggcacatggtcatatatatgtatacatggccacgacgacattcataaattaatatatacacgtgtggttatagtaactaattaacttggtgcttagcagctagcacgcactataactagctattagctagctgatgtacgtacatctcgatccataaactatgcgtgtttgcattttggtattacgtgttaatttggcggtgttggtgcgttagtaaccaccacaaatttgaccatgaacaggctgcccaaaaacggaaagaaaattcgatccgtactacgtacggtccaaacgaaacgggacttatatattgtgaatgctagctggctacctgggcgatcgatgacttcatcagtaatgaagtactagtactactcctacatactaatacattactaaccacttcttctgatttttaatgttttgactttagttgaatttaattcagacatatgtttgtcatatcacaacaaaataaaaatgttcaaatgcatattaaaaaaaacaacggagtcaaaccggagaaaagataaatatatagtctaatgtatattcaaaaatcaacggagttgagcatcagtacaactggatggagtatcttaagctagtggtgtttagttttcttcattgttttcttatgccgctgcttcctagtaacttcaaaaatcaactaatctgttccacgcgtgcctatgcatgccatctcaagaattagctaatgtcaaattagtctttgatcaagcagagagatgcatgactggctgagtgagcaagcatgctggttggacgtacgcatgttgttgcctagacttctggaaatgattcttggatgcatgataattaagagaaactttaagttgaaaaggtacttttattattccaaaaaaaaggtacttttaagtagaagaggttaactttcatagcaacttgcagctgcgtgtggtgtggatgccgggtcaaatgtacgttcatctaactagctacatacccggcttgcttccgtgttagaaaagaaaacggatggatgtccacccgggagattagaatctatcttcaacgaataatgtagaaatgtcatccaaacaaaaaaaattccacctcatctgttcttgttgagaatggttatatgtactgtgctggagttttaaaactgttagatcatctgaactttcattccatctctattttgtttctggaggaaaaatggtggcttgaaaaaaaatgaaacggaatttttgaaatatgttatcatcatctcaattagatgaggtaaaaaaaatgggatgaggtggagggaaaaaaatgtataaatagagtgaaacaaaattaaaaaaagagaagagaaaaacaaatgtaaaaatagattgagataagaaaattgaaaaatagatgaggtaaaaatgtaaaaaatatattgaaataaaaaaatttagattgaaacaaaattaaaaaaagggaagggcccatccgggttcgaaccggagacctattgatctgcagtcaattgctctaccactgagctatggacccttgtatggtcagttgttggatagtaactacatatttaaggaaaaatggggccagccacatcagacacaagtgtggtggttggtgtggacgcctcgccgccgttgtgcaagagagtacggccgccgcatcttttccttccatctttctggtgttctccacacagctagtgtcatattatcattttatttcgcatgcagctgctcattttagtactagagccgagtttagatcaaactttcaaacttccaacttttctatcacattaaaattttcctgcacatacaaacttctaacttttccgtcatatcgtttcaattttaactaaactttcaattttgacgttaactaaacacaccctaggaaacgactctcaccatcctatccccttctgccagctgaaaagagagaaggaagaacacaaactaagctaactacccaatccatcctaagacgtaaacatttaaaatatgtgacattgtatagcgagaggttataattgattaagaagagaaaatagatagaaaaatcaaataggggatagttgtgagttgtaactagttcagatgaaagggataggttaagaaataccttacattttagagaaaaaaaagtttcaaaaataactatattttggaatggaaagaatagtttacaccatgcaccaatcatgcatctgctaaaggaacttgcggcctcatcttttcacttatacttatgcttatcagtcaaaatttgaaatttcaatcttaaattttaagttgattttaaggttttttcatcgaagtttatttttcagcctttgcttttacatagataagagtacgtatataaaatttttgttcactttttttttttgtaaatataccgtttcgcgatgggtctgatgatatatccaaagtatgtatagcctatatccaatccaacacgaggtcggtcggtcggtcggtccggtggtcacatagtgcggcaccggcagcagcattacaatctctctcgtgtctcgtgcatccagttgacaaacgcaagaacaggccagccaaactaattgactctttatcacctctatctttcactgtttacttgtaatagaatgtacttgaacttgacattgccgtcctcccttgtgtttagttagtacagaggaggcatagatagatagcattggcttgacagactgcgattgatgtgtgtccattattcttcatttcttctaccttgacaactgcttgacagttgacaaaacattgctccttgctccttgcttccatttgtcggatgatcagatcactgcatcccatggttttcaacccaaccaccgtgttcctttctttcggagcccacaggaacaagcaacctccctgcttctcttcagatgcattccttttgtcttctaaccaacacgagctccagtacctaagatatactccgtcccaaaaaaaaaaaaaaagtcaaaccctaggtatgaatctggacatgatatccagggtttgccttttttttggaacggaggaagtagtatataactagtactctctcgattttgcttgcaatgtttgactattcgtcttatttaaattttttttacaaatatacaaaacaaaaagttgttcttaaaatactttggataataaagtaaaccacaaagaaaataaataataattctaaaattttttgaataagacgaatggtcaaacagtgcaaccaaaaactcaaaatcccaggagtacatagtacaatgttttccatgataaagatgcatcatggctaaacaagtccataaacgccactgcaataccatgggctattcacctttcttttattttcttgagttgatgagctcactcaagtctgaactgatactacttttatagcatcttaaaaagctaaacttaagcagtgtagtagtgcaaattaaatggacgatcttcaggtaccaactcaataataaatccccaggttcttttttcttcctctatataatataatagggtacgatccggatccttcattctcatacaacaccgcagatgcagatgcagcagattcacagtacaccaccataacattcatattctaatacttagtatgtagaggagttcctaacatagcactgacatatacctcagcatccagcaacatcatttctcaaacaactctcttcctcttacacctacagcaagttagcgcatcgcgttgcattgcatgctaccaagcgcactcacggggattcggggaattccgtcagtcagagatagatatataggtggtgctccttccttccagcaataatacacattactcgcgaatagagttgatgtcgatgtttggagttcttgagtccatctgcctcatcaacccagccgaccatccacccatcgtatgatgcggcatgttgtgatctggcagtgccattgtgggggtctcctcctcaccgccaattggctcttcgttattctccgtctcttgctcagctttcgctttatttttctttgtcccaccatacatgaagctccccactatcacctatttcaaccaaaaaaaatataaaacaaaatgcgtaagaaccaaaccaaacagatatacacagaaaacagtgcataacctactcataactggttggttactttgatgggcaaaaaagctgatacagggtaacagacaagataagctgccatgtaccccttttattcagttcagataacagccaaaccatatgacaccaaaagaccgagattggttggataacatagcatatacaaacatgactacctgaacagttccagctgctgtcaggactccacctacactcccaccaataaccctgtggtcagggccacacagagctatgcagaggcctccactccgggttcgcgaaccaccttcctctatcaccaaatatgatccagacaggcacaggatttcaaatcgaccctgccaaaccaatggtaaacataagggcctataaagaattaagctaggcacaacaagacctacattgtaaactatgacctacattgcaagtttgaccatggatatggcaatctttgactgctaaaagaagttctctacaaagataactatggagcaaaagttcatctaaaagcagcatcaaagccttttactcaattgaggaactatggaaaatccaaaatgaatggagacaagttgattaccatttctaatgcagctcagcacatgcaataagtatgcgtcaaaaaagagggataagaggtttagtttaccattctgagtcaaaagcaggataaaggatcttttgctatacccaagagtgaaacatgaggacaaaagcatgaatatggaagtcccggctacaataatactaagaatcaaacaggcctacaagcagcgtacctcatatgtaaccacaccaccagagtttgaatcctgatgaagggttgctgtggatacagctcctgtcgctgagatgatgcacactgcccttgggccctgttgtgagaaggacattatcctggcagcaacatcctgcatgggataggaaagctatactcacagaacaacaaggcatatataacaacatgaaaaactgtttttcatttccagagactaacaaaaaagatcagatccactgtagttttggatcttaattagtttttttttttagaactcatgttaattagttggcatccatcagttatcaggcaaagaattgtagttcttgcataggactactatgagttaagaccactgactccaaaagatgaatcatcaacagctaaaaagtacacctttgtaggtttgcacaacacacagatgctagtgcagcctgagactaccaaatgatacttaactgtatatcccaactaccagttgtatactgatgggggaagccactacatgccaatgatagtgaagtgatttttttaatcaatagacaagagtttggtccatgtagcatgttaatgaagcatcatttattcaacaacgtcatcagtattagttattacaactgaaattattggaaatgtgttgcactcgcaatccaaaaaatagttttgacgaccatttgagggactacattcaagctatcacgactcacataatcagaaaatcgttgcgttgaataataacagaaagtcaacaaaggttacaacagcatgattcttagctattagtatcctttgtataacttaacttacctctcctggtgaaataataatcacatgaggagtaaaacctgttccaacagaaccaagaaaccattttcctgaagaacacattacagcattttattagatagcaggcacacaaaaaaacccatttcacgcataaaagaaaagaagagggaccaaagctagccatgcatagtcaatagaagtttttgatgttgattcaagtagtaaatcagattttaggagtacatatactagtattatcagtacacataccccaccaagtttccaacaacaccataatgagcgggcattgtgtttgcatgataacagcccgggcctccaaagacaatagtaggtaaaaaacaaccaactaagctggacaggataccattttcacatttgatccagatacccaatagcatatctaagcttaagttcatgaataacaatgaaataccgtacataaaaaggggggcagaatgtttgcagatctaacaagcaatactatcgtgcaaaatgtaagggagcatggaattcaaaagtagacaaaattcaattcaacaattcggaaatcatctaccactagtttcttagtgcatttctgttaccatattaaactacccttgcattccatcaatcattaccatattaacatacaacatgatcatgaaaatttgctaggttgcaagatctcaccaagagaaagccaactgctgcatctttccagacccaggtggccgccctcggccacgcttctctgtaagggcaccagaccccgaaccccccgatcctgcccccgacccaaaccctgagcctggtgtggtcaccattgtacccatcgccgaggtcgacgagtgaggcgtcgacgaagacggcgagagccccagcgtgaccgccccatcaggcttatacttcctcggcctcccccgcttcttcttcaccggctcatcctggccagcaccactcccctgatcccctttagcatccgcgctcatttcgacacccatgccaatgtccataccaccaccaccgccaccactgccgtgctgcgcgacaggggctgaggcatcaacatggtggtaaccctgcccaatgtgggaacccccaatgtgagggggctggaaagggtaccccgcagagactgcatcaagatgctgccgatatccaccgggcggcgggccgtggagcccggccgggtgcccggagcctcccggcacgccaatgccccggtgctgcacatagaaggaggagaagttggagcctgacgccactgtggactccctcccatccattcatggaatgggaagctgcgccacagaggaggaaggaggaggaactcacgcggccacccacaaccacaagcacaaccaaggtggcaactttccttcactattcgagattagattcctccgaaagctatcggaggcgaagcaaatggacgcaagaatatcaatctcggagagagatctcttctccaccgactcccgaacacaaaaaccgcagtttgtttgttttgttttttttctctcctcgagaaacaaggcgagatcagatcgagcagcgacgggagatctcgactctgaacaaggcggtgaaatctccaggcagcaaaagattggaaccaaacccgaaaaaaaaacgggcagaaaaaaaaaccccatctttcgcagggaaagaagggcgaaaaggatgggatttgcgcgaggtcgagaagggatggatacacagagagatagagtctgcggcggcggaggcggcgacggcgggcggcggcgggatccgagaggcggtggaggggggagaggagtgatccaatcgaaatggcgatggatgggggaaatgggagatagctaaaaccctagcggagggggatcacaggagagaggagcccaagagaagagaagagaagagaggagaggagggagagagagagagagcaagcatgtatggtgaatgtctctatgtgttggaggagagagagtgttgtgtgtttgtgtgtgagggattctttgtggagccaatatggcagatctcatcaatgcaagtgatatgctgccttgtcctaggagtgtcctgaaatgatttgttgagtatcgtagtttggtcgaagagggctacgttagatatatgtatgtatattgaatatggtgttcattaaattaggtggaatcggacaaaagttttattggccaacaaaatagtggatatcgtatttgtcggtttatgttattacgttgttttgtcctatcgtacggttagttcgaatcaatgtcaaaataaataatcacttgttcggtctccgttttttatgcaacgttaaggtagcgacaaaaacatcattaaaaccttccaagttgagattctctaagactcggagattgatgcctattgatttggtaagacagaggcaatgatatagtgattctttctattaagagcatcggctacaacattagctttatcagagcgatactggatacccaaattttagtctttgatgagccgttactttttttggcttggttttatgtttggttggttgataaaatatttcaaactttttatggctgatatggacttcacacttgttacgatcaaaagtgttagagcatgaactatggttgtcagctccaagtcatatgttggataattggctttatgtgatcgtaattgatgtgaagtataagcaaccgctttgctatcttacatcaacccacatacaatctcatggcgagatgcataaactcaaaattcatatattaacgggtatttcaagtgttacgagactttgtttttttaaaaaatgtcttataggatcaccaatggtagaatctcgtcaagttgccatctagaaatggaaagtgaaacaatatttgagtcgcaacaatcctctagcaagcttagttttagagtaccattaataccgattttatcaattttctcagatttaatgtaatgtctatgctcatattgcattatattccattgaaagtggttaaaatgaaatatgagaaagaaaaaaggtatcagtgcaaaattgtttctcactttttttagtacagtggatccgtggatgtgacggtctatgcaagagtagtgtgacgaaatatctgccacaaaggatcatggccttgaccgggtaaggagaaagagaccgagctctgctgacgcgtcagctaagtcgataataattgggtcgataaccccggtgtataggtgagcaatgccattatcatcgagagagtatttgcttacatttgttcaacaacacctgttcaatccagattttgatttgggacagtgaaaaatgctcaaactaaggaccgaaaatacaatcaaagatctttttctttttctgaaaaaagtgggtaccattaaacagacagagcggtcggatatgaagaaattgtcaatttctaaggatttggatttttttttggtttcttgggacggatccaaaagttttattttcccaaga

SEQ ID NO: 32562 - DNA, 1475 bp, Oryza sativa
aacctgaaaacattcaataacatctaaaaaaactggtgaaaagttcttgtgtagagcaccatttgtcaacgatgatttgctggtcagacaagttgcataattgtcgagcaacaccaacaaaaggattcacacatgtgccaagtttgctgcagatgtagttgtttcatccaaatagcatgaaatagcaaaaaatctacttccaaatgcaacgatctcactttaatattttaaaagtgttcgagatgttaattccaggctctgccactacaaaggtactctacaaaccaacgtatagaaaagagtaacaagctccaactgagtagactgccaaggctagatggaatatggtcacttgaccagagcaaatgcactcatctgagcatagaacttgttctcttccatcaaaactatatcaacactggagcacagtttagcaatggaacacagattgtaggaagtaaaactccccagttacttgtcgacctccattgcttgcgcagctttggcttttgttaaggctgaaagttttgtcttcacctttttcttgccaaccttaaatttgccacccttccttttcacatcaccatctatttgaataaaaatgaaaagaaagcattaagaaggatgctgcaaacttttcttaaccacaaaaaaaaagaagaatgtagcagtttgctatgttcatatttatattcaagtaaaaacacaagaccaatcaacaggaagtgaaatttgaggagccagattgatcaaattattttttgagaaagcagtagggaatgtaatctcaaacaaggcctatataactgactgacccaaagtaaattatgagcagattaaacaagctctggaagacaagcatatcctcatctaagattgtcatgtagttcaagcactatttctctagagtacttaaactggtgtgagcaaccaggtcacagcatatcagatggcaaatatatatattgtataccgaagatcatcaggaggtttaacgaataaaagagtcaacacctggtgcaaaaacaaaaggaacttgacaacacatgtttggaattgctaataggtaaacttcagaatatacgagtagatcgatgggaaataaaacccaagaagtacaaacagatcatataattggatagaactcatgagcaatcagcttgctcaaatacactctcaaacacaccacctacatttcactagcactaataactgtttgtgatagtaaaaaccagcggcttggaagcaattgagggtttgaagccataaaacagtaaaagactgaaggtagtccataacctaaacagctgcatttaatttcagaaactgcctaatgagtaaaccagtgaggcataacaggactcctggaactgcttgggatctgtgagctcttgagatgtcttggaaaagaaagtggcacatgggaaatgaaatcgctcccagagcctcatgagaacgaactacactaaccattt

SEQ ID NO: 32563 - DNA, 1102 bp, Oryza sativa
tgcagcatactgtgaaaaccaactacgatgaaacataagcatacgtcaattaatttactaggagcacctatctgttggttgaaacatagcctatacaattcgtgagatgtggtaaatgactgtaagacagaagattacttgagtacttctggggtgagcagcgttgccttgccctttggcagaaggaagttgcggtagaacccggccctcactttaagcgtgtcccctttcttccccacctctgctatgtcatctgtcagtatgacctgggagaaaaagaaactcaagtgaagtaaatcaaatacggaatcgtgcattacatgctaaagtatagaaatgcataatagacaaggaagatgatgacataggcttggaacattttacagtttacaggtgcaaattttgaactgggtgtatctagatgccttttagttgcaactttccctacaaacaaacagcatggccaaaccaacaattccggcgttccggggcatatacagaatcatattagagatgacttttgcatctgagttgcaatgctaagaggcacttaattaaaaacatgacgatagtttcttccatttccatgtactgcatcagagcatgcgtccatggcaatgtatcttttcctatactcagatgtgtgaatgcacacagtaatcttaagcttacagctgctgcatttcgaatttttcgatcgatggaatgcagtcgcatgcgctttgtaatctactgtactgattagtggacaggtggtgacagacagtacattgggtatggctagttctaaaagagccaaaacaaaagcatcaccagcaacagcttggtcaatcagtcagtactagtactgcttagctcgaacgaatcgcaattaaatacatacatacatacatgctgcaactggggaaagaaaatacaagtggaagccaaacctggcgatacttcttgaccttgccctgggcgacgacgaccagcgacggggagcggcccggcgggaggcgggaagaaggggctgaagaagaagcggctgaactccagccgagcgtggaggccatggcgttggggatggattgcgggggaagggaaggaactgcggctgctg

SEQ ID NO: 32564 - DNA, 627 bp, Oryza sativa
atttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagagggaatcgtaaacttaactttaactttagcatatggatcatcacacacattatgaaaattacctccaatacctcgacgattgaagctcagc

SEQ ID NO: 32565 - DNA, 1333 bp, Oryza sativa
gtaggtcgtaacgcttgacagagaaaggattgttttacataatgtttgcaaatgattttggactacagagttaggtctttcgtcccttgatttgtaaacaccagtgaataaaattaggtgttggaagttcagatacgtgtttgaaggatgttctgatgtgccaatttctgtagcgaaatcagtaagatttcttcctagcgcgcaatttagagagaaggaaaccgctgctacttggtaccaatgagagttttgccccccttgacttattttaaagaagatttgtggtgcgcctttgtatttttatctcaaaatcccttgcacatccatgagttttgtcgcttccttcgtcatccaaacttttcgtccgtcctttatctacgcctgttacgagtctatctgctgagaacgtaagagtccgcgttagatttggtgtgtcaaatacgtattggattgctagtttctacgtacgatttgctaaacaaatcttctcttttgagttgagtttatcaatctacagtttttctcatcagcatttctcgatgctaaatcatatctcatgccagtacttgatcccaagagaaaaatcatctcattgcagaacttgatcccatgaaaaaaaaagaaactacttcctctgtctacaaaatataagggattttgcacggatatgtcatatcctactctctgtccagattcgttgtattaggatgtgtcacatccaaccaaaaaccttatatttgtggacatataaagtactaatgtatggttactttttttcccggtgtattacaatgtctaatcaattatagaggagatgaatgcatgaaggaagtagtaggggtgaaaacggtacggaaacggacggaaaccatctttatcgttttcattttcatatttttttcgagatcggaatcggaaaccctggatacgaaaacggaatcgaatattatcaaaaccgaaaacggagtgaaaacgaaccggcgcaaatacgataacgaaaatttatcggaataaaaaacccctcaaactgataaatccaattctcaagtctcaacggtcaacaattcattgtaaaacacaatcatataagtccaattattaagcatcaacagcacatcacaaaacacaatctatgaaataaattatctatgtttaatagagtaatgttgttgataaattccaatgcatggaaaaatattctgatgtgattttagattttcataacaaataatttttaaaaaataacaactaaacaccatggtattcactattcagtgcttaaaaatgaatccacggtatttcagtcataaaatttctggaaattccgagaaaa

SEQ ID NO: 32566 - DNA, 9941 bp, Oryza sativa
cggaatcctgaaagtttccgtaccgttttcaccccaggaagcaatagggtgcaaagggaacacatgtgacattaacgttgaaagaggtgtgctggcagttctacacaaatcgtcttccttacactaaaaactggtttttactagcagccaattaacaaggttgcttgcgaaaaccgatttcaacatacaaccatgttaagccgcctaactgcgatgatttttttttctctaaaaaatcagaaccctaaccgatttcaatatacaaccatgttaagccgccacagcaagatctaattaacctcctcaccgttggagaagctgacaccattgcagtcctcaagaagggatgatccgtcgtatccgtggcagcaggcggtggatctgccactatcgttgccaggatgaaaatgggattttgaatcaggcggtacgatgaaaatgcctattatgtacattgaaaatgagattgtgccgtataaaatagtaggtagtacgtatagtttcatctattggatgcatcgtcgattttatataacaccttttataccataattttcagcttttacaataacaacagaaattttgattatatattgtatacttacacgaagtcaccaacttgtacaatcaatacaagttttgtccttagtctttgcgatctttctatattgagagctcaattttcacacaaatcaaaattgaagggaatccaaacaaagaacgaaccaacacctcctatctccacactatgcatgcgtttgattagtggatgaaacaagatgggttgggttgatcctattttttaagttgtttggttggagaaaggtgtggaatgaaatggtccttgatgggaatattatgcttagattcggataacggaatgaagggagtatattggacatggtcgcgtggtcgcattttctatgtaattaataaaaattgaatttatatttcgtagagaacgatgagaacgtttcttctaataaaacctagtggatgtatacatacaaatatatcgtacaaatgataaaattgatgatttgctactctttaggttgctaccatgtgacaatgtcgagtgggactctcatgattcaatgacgtgtgggtggcgtggcgataaaaaaaatacatcaattctcgagtggaaaaataatcgaatataaatctccggacaaatagaagaaatgatatacatcaaatctatttcaaaatcacctcaacatgaggcttcgaccaagttctaccatgcttaatctgcgcactgaccgagatccaatcgtccagcctccacggccgatcgccattgctcaccgtgttccacccccagagcccgtcttcctcgacgcgcccgtcccggacgagcaccacgcgctccaatgtcgcgcacacccgcaccaggtacctcaggaaccgcgtatgccgcggcgcgctcgccgcgaaccccaccatgcgcacctccctcagccgccggtgccggaacttgcgccgcggctgccagtagatcggccgccccaggtgttcgtccggcgagggggcgggcgcggagacgtggatgtgcagcgactcgagcgccggcgccgcctcgaggaggaggcgcggccacgagacgtcccaggtgggcggcacgtcggcgacgaggagctccctcaggccgagcagcgcggcgccgagcgggcgcgggaggatccaccgcttcggcccggtgaagcggacggcgagcctcgacatcgacgccggcggcgcgcccccgaggagggagtcgaggacgcggtggtggggcggcgtcgccggggacgtgggggcggcgaacgtgaggttgacgtgcgtgaggcgcgggacggcgccgaagctgagctccaccaccggcacggtgccgtcgccgaggcacgcgaggcggcggagctcggggaggccgcgcagctcgacagcccggaacgagcagctgtccacgacgagctcctccacgccggagcgcggcgcgtcgattaccagggcgtcgcccgcgccgcggcagcacaggaggtgcaccacccgcaggcggcggcacccaccgaacacggcgtcgtacgcggacatcggggtggacgccgccgtgtcctgcaggacgagccgctccagcgcggcgtaccggtgcagtggcggcagcgcgcagtggcccagcgtcaggctgcggaggcgcgagcggtggcgctcgtcgtcgaggaggtggtccgggaaggcgtacaccggcagcggggggtcgcgcggcgcggacctgaggacgacgacgtcgaggtgctcgacgccccactccccgacggcggtgtcgatcatccggtcgatggtgccggcgccgtcgtaggtgcggaagaactcgaggtagagcgacctggcgcgccggcggcgagcgccgggcgcgtccaggaccccggcgaggccgtcgaggaacgcgcgcgtggcgcgccggtccaggcgtttgatgtacggcagcagcctgccctcgacgtcctcggcgtcggcggcgccgcgcgccctggctcggcggaggcggtcggtggagtggaagtagcgcggcgagagcacgtcggcgacggagaacctgagcgccgggaggcggcgcgggaggcgcgcccggcggcggggcgccttaatcctaggcgtggcagaaagatttttagtttggatgacggtgggaagcagctacgtacacaggtcgcagagataatataggcggctcggcgagtcaccatcgcattccgattccgactccgatccctatcctaacacgcttgctgctcttgttgacgtgctgtaaggtgaggtaccgaaaacagagcgatagtttagcgtatcattagctaaataaactttaaaaatagattaatatgatttttatatgaacttttttattaaaaaagttgtgtaaaatatagtttaagaaacatacgcgcaaaatataaaaaaatagaagttgagaaaagggagaaaaaaacacagcccaaacgatggttactgttgagcagagctgcttgattccgctgatatgatagttgatgaatagataatgtctatgaactggttttttttttttgaaactttcaatttttaattttaaaaataaactcttctaaaacttatttttaaaacctagatcttttgacctgccaaacatggcaaaacaatactaacacatcatctgtagtgggcgtgatagttttattatgccacaacagcaaaaccgacgtggccaagaaagatttatttttacaattaaaaatttaaaaatgttttagaaaaatcaaaaaatcgcaaacttgttggttgttaacaacaaaatttgataagatgtacgaagaaaacaatggattcgatgcggatttggaggagataattcggtttctaaaaacagcgcaatgcatcgactagaaggctgtaccttcgacaccccactctccaacggtgatctcaatcatctggtcaatgatatcagcgttgttgtagatgcggaagaactcaaggtagagtgccttggtgtgccgatgatgagcaccgctagtactgggcgcatctaagatcccagcgatgccatcgaggaacgcgcacatggcacgttggtcggagtgtttgatgtacaacaatagcttgccgtcgaaacaactaaaactctcattcctacaggcataagatgttatgttgatgtttcttggttggataataaaaaatgaagtatctttattcatgatccaacttctcatgctgccatttggataaaggctattagtgcaaattctctttcacctttgcatgcagagctttcagtgttctgggtggcttataaaacttgcaggtgtttaagcttgatgaatgtcatcttcctcactgatagtgcaacaattgcgactatattccatcaaaataatttacaggagaacccaggacattggagtttaaggccattactatcaaaatttcagaattttccttgcaggagcaacaattgcatgtcaagtggatccctcggaaggcaaatgaagttgcggatagacttgcaagtaaagctagaagacacaattctagggctagaaactataattattgtctacaataattctcatacttgttatcactctacatgtccaaccacaagtgccctagtaaacctctgtcttgaagagacgatcataactcatgtactttgtttctaatttctagtgtaataaaagtcattagttctaaaaaaaaagggaggtgcctagaggtggccgagaaagctggtttgttcggtgtttgctaccccttcatttttttaaataacccacacaagacagcgcacaatttcgtactaatatagtagaaaacaaaacaagtctatagccctggaagactatagctagaaaaaaaataaccacaccacgcgtctacaaccggatccccgctagtaaagagtaaacatgaacacaacacccctaatggaatgggtcttcaaatgacaccaccagcgaagaaacggtgtcgagaaacaccaccgtcacctattctgagaacatgacatggttttcacctaaagaaaaccatcaaggagagaagagattctacaacaatgccccaagggaaaagtggcgcccatgagtgtcgctattgttggcccaaaggctaggctttcacccgtaatcttcatgccctcccatgccacgtgcacctgtccgtatcagcggccaccaccaactgagcaccttcaatgcatagccaccacaccagcgccttgccgtcgaccatccattaagcaggattgcaggatccagctcactcaacctccatccacacgattgggttgaggaggaagaggatgagagagaagagtggatctcctcttcctcgtactaggccgccagcgtggccatcttgtgacggcaaggcgtcaccacgagaggactagcgtatggatcagagtccgttgcatgccctgcaaacacccacctcacggcatcgctgacgcctccacctcgggcagactgcccaccttgctatcgcctcgccccgaagccatcattcgtcatcggatctcccatgtggtagcgcctcaacggtgccatcattcctgcctccatccatcgacatgttgccactggacaccggccacgccgcgatcgcctcccgttgggctccagctgtcgtcaccaatcagcatgggttcttgctacccgcgtgcgccactgccagagcacgacagccctcgctgccgcgcttgcctccaccagccttctcttgcgcctcatcggtctcctgctgtctcgtgcgctgctagtcggctcctccggccagatccattgcaggggcgacagatctagccgtgggtggaccagatcctatcgtggcggcatcggatccgtcgcctagcgctgcgcagcgtcgccgcctcgtcttccccacacatcgcatgtcaagccgccttccccgcgccgaggtggagcgccgccgagggtttgaccccacattcccctacaattttgattttcatgaacactgagttctcgatgtgtttacacggttcgtgtaagccataaactaaatatgtcggagaaaacgttgatgccatcaacttttagccaatcttctatttcttcctatagtccaaagtagaattccaccttcatatgtgctcgctactttctaatggacactcaactgactaaaattcgttttgtcattgtattttagctttggtttacacgtaaccgataagtttatacacattcaattatatcctcctaacaaattcgtgtatcacaataatttaactctactcctgattaattcagcagagagagaacgtgtttaggccggagatgcagatctcggtttgatctaggccgttgagtcccgatctgacgccttgtagagcccaacacaccggcggctctgcatctcgaagcccaccggccgaagcccccccccccccccacacacacacacacacaccggcgccgccgcccctactccgatggctactccggccagcgagcccgccggcgcagggacgccggagccagcagcgccgttctccgccgactggaaggagcggatcttgctgcccgccgcggtcgccggtgagccgcccccaacccaccccccgaagaaaaactcgccgcgggcgattccaaagggggagggggattcgctgacttttgggatgctctgtaggtgtggtcggagctggattcgggctgctgtcgcggcaccgggctcgccttggcgccgcccgcgccaccgccacctacgccgccaacctcgccatcgtcgccgggtgctacggtggtgagctcctcttgttacgccggggcgtctgatttgtttagctttttgttgcaaagtctgtagctcttgggttgaattgaatctctaagtgaggtgcggttagataccccgatttggattattggagtagtatttcttcactgaacttgtgacttcgataatctactgttgtggtaggagagaagtagacttgctatacttcacttctcaccatttcttagttatgacttgaatgttggttgagattattaaatttaagctactagactatcattacaaaaaaaccgtgagtaactggatcggacttaaactcattttggaggcgggttgcctgggaacatggcgcagatgatgatataatgataggcatatacaaaacgatttcacatttctagtagtgtctcagtttgggatactgaattactattcttgttaaccattgaacaaggtagcctttctctgcgtaaattagcatagccatttttgctggggaatttgatgtggtgccttgagaattgcgatattgtgactttgtgagtgattatcttctaacatgcctccagtccctccatagtaaggtttctgattatccattatcctctaagcatgctgttaatcgtgctatcaacatccatgaagctatttcacaacatccatgaagcaattgtgaataaaagaatgattgtcttagtttgttgttaccattgtctcactttgatttggcaaagattcaatgcctaagtaaatctctctttgatctattgtctatgatatgatcttaggaaaattaagctcatcagatatgagtaagtagaattgtggcaggctggcagctatgatcttttaaatgcaatgccctcaacataacctttttagtgcccacaactccttttttttcctttttcctagcacttgatcagttgaaataattcggggttttattgctcaagattacaaaaaaactggagaaatttctggtcagccaaggaacataggttgtagctattgtgctacatgggttctggaaatgtttgacatatttgaaaccctacttgacatgtttgaacttgttttgagctattattgcttacatttgtacacagtatgaagtatgaacatttgttgtccttttcacatcagaatctggcattggttttaattctgcttggtactacaactgtacaagttctatcttgtggcttttaatctactatttagaatacataacttttttagtgggatttagaatacatacttttgcactgttcgttttggactatgattttcattttagggaacatattaaacatgtttgtaaaaggtggaatagcgtcttctcatttattgcagcacttatattttctgtaagctcatgttaataagggacatggagcctctggatgaatatattatatatcaacatgtttatgtaatgcatgtgcttgtttccattcaggagcacgtgaacttgcaagagatgctcgggcttcaacacctgatgatcccatgaactccgttgttggtgggctagcaagcggagctgttcttggtcgattacaaggttgatcattatattgcacaatcatatttggacttttgttctttccatatttgaaagtatctaatttaatcttttcagtaacttcgtattttaggggttatcaggcaggtttcatgtatggtactaaaatcaacaacttagatcagaaagcaattatattatatatttccacatgctatctttacaaaatacatatagcagccataaaatactaagctagtaagctagagttcaccaacagacttgatagccatcagggtttgtgctttaatctgttcaggcaacattttggaagctagaagttatgcctacttcggataacatctgaacaaaagttctagtgcacctgtaacgtggggcccttttattttctcaaaattggcatagtgttgtacatggaagaaatgtgtgctggtcccggacaccatcatgggtaaaatcataaaaaggttaatttattgtaaattgtgatgtgctcatttgttttcactggttttccagaattttgtgggatgtgggtactggtaaggctactattactgaacttgagtgtctttcagttcctgtcttctgttagatgcgggattgcctattgtatgtctctttcttatacatctccagaatctttgtaacatcttctactcttgtttccaaagaaagctctacataaaagctttcaatttgcatccttcaacatcactatagttaattgcacttattgatatcactctacagtgaattttagagttaatttactatgatgcatagtgtagcctttctgatgtattagcagtcttagtttagttccattcaagagcttaagatatttcaattttgttctcatgggttatctaaggtgggtggtcttgctgagctccaatctaatcataataagatcttcagttccatttaaatgaaaggcatcattgttgtctttggtagcccttttttttttttaaaaaaaaaactattatgcaaaccttggattgcttcattctaccatttaatccatctttcttccaagcttgtgaacaaattatgaaatatatgctttcaacctgctattactagattctccagttatgcatatgcttgcatgtccacttgactattctgttcaattaaatttccacttgactattgctttagattaccttgaagtttcatagatagtccaatgtgatttgccttactcaaattatcaacaagtctgatcattttataaaaatcaacccttctttgtgatgaataccttttggccttcagaattcaaacttgtctgaatttgtttgctgtgatgcaagcattttctaacttgtctgaatggcattatttgttttctaccaggcagcttggtggaaacttttgggatatatatattgtctgaaaactcgcataaaattatatcgcaatgttcatgtttgtgccctggatctcatgatttgcatttgctcactgtcgctgcaggcggacactttggggcagttaagtatgcagttacctttgcagctgctggtaccgcattggactatgctgcactgaagctgagtcctcaaattaatggcaaatggcatgccctgaaagaacatttttctggagacaaagactggtttacgctccccgaatggtcgcctattcaggtgttggatgaggaggccttggcgaagaaacgagctcgagaagagaagttgttcgctcagcgagctctcagtaaacttagcaaggaggaaccatagttacagtgctacagtactgctatagacttgatagttttgtcaaggcgctatgcgtcacgtaaaccattatagttctagactgttagaacattcaaattttggagttttttttatcttttcgttatcctttgtaagcttttcacggaaagggagaaaccatgttggtcattgttgtactggaaagggttttagcttccaaaacatttgcttgtctgctgtggtgtttgtaatactgctggtaatctggcaccttttggaagtaaaactcttttgaattcacataaaatacaacccagaatgtgaaatttaaatgcgttatttttcctgtaaaataccattgactatta

SEQ ID NO: 32567 - DNA, 8538 bp, Oryza sativa
caatcttaagttatgcatagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgtcagcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatgtgcgcctccttcctccttctctctcgctcgtttgttggtgtggctggatctcgctcacgggttcttggggtggtgaattttttttcgcagcaaggtggtgcgcacctcgatcgcgcgcgtgctgacggtgatctcgcagaagcagaaggcggcgctgagggaggcgtacaagaagaagagcctgctcccgctcgacctccgccccaagaagacccgcgccatccgcaggcgcctcaccaagcaccaggtatagaaacaactcgtgtctcttctctttctttgtcccattcgaatgcatctaccttatactaattggatgtgaattacctcagttattgtttagggctagatgtgctgtgttacataggcatttttcggtcaaattgctctagttgatgttgaaacagttaccaattcttcagtgcaagctgtgttttttttatgttagattggattagtagaacacatgtattgggaatcaagagagctctttaggaagaacgatttttgcacggatttttatgagattttattgtgtggcttgcctagttgttgctggtgatttgcgtatttcggttactactctgttagctgtttgtagtttaattgtgataagctgttcgcaaattgtcatatgattgctgtaaagctgttggtctcaccttgtaagagtatatagtgctgagtttggttattttgtgtatgcatgtgacatactgcggaatgataattactgcttgtcttaggtgatacatactcccatccattaaatcatttagtcaggctcacaggcttgtttaatacccttttggttcaatattcgcttcttgttttgttatttttgctgtttgttattggttattttcacactaggctttaatcatatggcatgcatgtcatagtgtgtcctctcctgtgtgccttgtttttgttgtaacaaattacagggaccatgcaattccctatttgaatcacttttgagacctgagcctcacctcctttaggaattctggtcatagcaggatttacatcgagtttaaagctgtctctttaggtcttcagctgcatttgtattatgcatctggtgtagtttagaatttggagattttatttatggtgcatgtaacttaggtcgttttatgtttatggtcttgtcttgtgaaatcctctagtttgatctgatcctgttaaaatatttagctaaatggtttgggcttttggtactgaatgatttgctttactattgtgcagctctctttgaagaccgagagggagaagaagcgtgagaagtatttccccatgaggaagtatgctgttaaagcttaggttattaggaacataaatgttttaccggtcaagttttgcccagttgcctaaatttgatgttttgtgtggacatccattgtcaccttagtacaatgtatttggtctactgcatgaagtgcgtactattttgccttttaacgttgttatttggttatagctgcctgtcacctgtctgttgaaaatgtgatggttaccttaatgtttaagagattccacttgaactatgtccctacgtagttcaaccgtggatgggcattcaaattcaatctataccaaaggtagtgtgtgctagtgctgaactgaggagcacattcttcatctctggtagttttgctgaaacctgatgtgcaaattatagtagttactaccaggtttcacttttttttgattgaggtggattcactccagggctgcggtgctttttgtgaaactttgatcaaaatatggcttggaattggaattggtagatatatttgttggttcgatgaagagtaagcaaattgatgggagaattgcaaatataacactactcttgcaatctaattcgaaatagcccctaaaaaacacaaaactgcaaaattttgccactgaaattggtgtgcacacatctatttgccattgacaaataagaagacaaaaataattcataaaaccaatataagaaatacagcaagagttcataaaaccaatataaaaaagacacatataagaccgttttagccccttcttaaccctctcccactcaggaaccctacattcccatatcttttcatctcttcatgcaaatcaacttgcactacaacagaaaccccgacgcctctcaaatcctttcatctcttcttgcaaatcaactgaaattgatttgtcatctagtttatctcaagtaatcaactgaaaattgattcatctagctttagtttatatcaagtaatcaactgaaaattgattcatctagctttatctcaagtcgggtaggaattaatgacggacgaaattagcaacttcgatcatcatttatttcggttggcatgttcttttagaaagtaaaaatgattcttatggattattgtatggcatgttccttttagaaagtaaaaatgattcttatggattattgtaacggtatccgtgatagtatgtacgagtatgtgtggataatgacttgaaatcatgctaggaatcatgtcgtgtaatacgaatagaatcggatgttttaggcaacgatgtacatgatatatccacacggattttgcgcgtttcattcgcttggtatttacatcacacggacctctttcacatttcgctcatgaattgtgacttcgcaatgaatgttacgcgtgacaggaatcggatatacacgtaccatagttttgacaaaaacatcttcaatttttaaatcgcaggcgaggacgacgtagtcccaaatcccaattggacattcgggaagagcaaatcgtgcacgcgagggcgtcgcaggcccaatcgggcatgcggaaattcacacgccttagtccgtttaattgtcttaaagttaattgtactatcgctaataacatatatataaaaggtttattcataaataatttttatttgctagtaataaacgatttggataagcatataaataagcgtgacaataagatagtacctctccgtcctataaacaaacgaatctagaatcggatatgacatatcctagtactatgaatctagataaatatatatccagattcgtaatactaggatatattacatcgggtattaggctagttttttatgggatagagtaactgagtaagtgagttcacgggacctacttgcaccgctgattgcgaggggaaaagtacacgaaggtccctcaacttgccatcgagttacaaaatcgtcccccaacagcaaatccagatatccggcgtcccttaactaatcaaaaccggccacaataggtcctttggtggttttaacctcggttttatcctacgtggcggctgagtcagcgtgagacccatgtgtcagcgtggccatgctagcctcctctctctctctcccttctctatgagggcagcagtgtgaggtgggagagcaggagggcgtcggttgctggtgacgggcggcgtgacggcggtggggggaggagcggcgggcgggcggtgggggacgggcagcgcgcgggctcccccgtcggccgcgcccacaaggcagaggaatggtggccaggggagaggagcggcggccggcggagtggagttgggcagccccttcgttcctctcctttcctcctcactctctcactcttctctctggactgggcaggctggccggcagtgggaaggaggttgaggatgatgttgtacgacacggcgttgaggtggacgcctcgcttcggggcgagcgggagcatgtccttggtggcatccgcgcgaccattggaaacgagggcgttgaggaacaaatggaatgtggcggcagagtgggagtagaaggctgggacggcgcggaagacgacgactgcagcgtcggggcgagaagcggcgccgaggtggttgatgacaggggcaaacacggtgggccggagtgggccgccgtgggagtgcaatgcggcgaggagcgggggcacgagtgggaagaggcgcgcgcgggcgaggcggtacaacacgcaggcggtgaaggggtggtcgtggaggtgcctaggcgccgtcgcctctccgccaccgcgctcgcccgccgacaccgcctcgccctgccgccaccctcctcttctctcgtgtctccgccaccgcatcgtcggccgcctgtcggacctcctcgctctgacgaccttctccccaccgctggctggcctgcccagtccagagagaagggtgtgtgtgtttgtgagagagagaggaggaaaggagaggaagggagaggccggcctgctgacgtggcatcatgacacatggggcccacgctgactcagccgccacgtcggacaaaaccggtgtcaaaatcaccgagggacctagtttgcactggttttgtaagttggatgatgcgtcatatctagttttacggttgggggacgattttgtatctcgatgacaagttgagggaccttcggtgtacttttccattgcgaggactgggggagagatggcatgggctttaacatgggcctggcccactaacgctagacgcaccggcgcacactatgctcctcctcccccctccttcccctacacgactctactcgattcgaccgttccgccgcttccgcagcctcccccaattcaaaaagaggaaagaaacgctcctcctctcctccccccacccccccgctcctctcaaatctcctcccatcccccagatcgatctccacaaccccaaaaacaaaagaaaaaacaaaattctgggaatggagcagcagcagaagcaggaacccggcggcggcggcggcggcgtcagagtcgtcgcgaggatctgcccctgcgcaccaccgccaccaccacccgacgccgccctcaacttccaggtcgccgccctcaatgaccccgccctaatctccttcatcccccgtcgcccaaccgcatccgccgccaccgccgcggcctctgggtaagataagaacaaacgccttactgtttggattttgggggatttttgttttattttatcgctgatgaaatttaaccacacgcggttgcggcaccagccgaggagatggccccaaggataagcagcagcagcagcagcagaagtacagggtcgatggctgctacctcagagacgatcccaaccaccgcgtcttccacaacgaggtcaagccgctcattgatggcagaggtggaggaggaggaggacgcggcggcgccaaagcctgcgtcgtcgcctgtggtgatgcggctgccaaacgtcacctcttcatggtattattaatttattattatgggttactagctggatgaacttgagttgcaacggaattaaaagaagagagaaaaaaataatcgtatctttaccatttcaaatattaatccaagaattcatgttgcagttggagtttgatatcttccccccttaaatactttgtatagaaattctctttattgtttgttgttttcagatcacagtttgatagttcaatatgtcttgagatagtggttgcaggtttaggcagattcaccaccacttgagtcttttaaaagagtacagatgctaatttttcttgcattacataaatactgtatttacatgctaccccagctgaggctgagcctgcctttcgtcagaacctaacaccatcttgcattcctcagttgcaattgtcactgttaggctactcactctcctcatctgcaggggtctcctgatcaacctggcttgttcaccatggcaatggcgcaactcctcgactcctccaaagccattggtgccgctgtcactgtctcatcctatcaggtgctccaagatactcacatcctcgacctcttggagcccaagaaccatgaggttctcatactagaggatgccgacggacagactcacctcaagggcctctccagggtacagcactactcatctttcctgaattgtttgtatgcctattaaatcatagcaaaattcatttagtattaactggatccgtcatattttacaggttggtgtcaactcaatcgaggagttttcgcagctttgttgttgcgctaccaaccagcagaggcaccatcccgctaaagattccacccagttacaggattggggacaccaagggctgattatctacgtctctagctttgatcagcaaggcaaagaatgtgctctagctaagataaacttcctcaacctggcaggtctgctcttctcttttctgcacccaaccttctagctcctcattggtatagtgtgttgcataaatattgtactgcatatttcgatcatcaggctatgtggatcccaagcagaagaagaatgaaggtcttgctctactaaccggtaacaagtctatgcatgccttgatgaatgttgtccaagcactgaacagcaaccagagatttgtaccatatagacaaagcaaagtaactcgtattctgcaagattctttatgcaagagcaagacgagcggtagcgtcctgatagcctgtttggtaagctactaacagctaacactttccttttgtatagggctgcaccaaagaaaatagttatcaaactagtttgactcttacccatgtaagttctacaagtatatttacctgtgaaatgcaagttttagcatttggtcacggtacctgtcggtgattaggattcgatcaatatatgtgcgtgctatatgtacatgttgctgataaagtagtttagcataaaacagaaccttcatgcctgatagtattgttcttcactaagtcaccaaactagtactaccttttagtccaaggatatgtcggtgtgataattcgatccagtcctcatttgccatatgctacaaattgttatacagaatatgtactaaagcatcgctccatctacagttagctttgactggttgttacatatttgcatatgtaccatagctttcctgtttgaactgatacacaataggtgttactctcccaatctaaatatatgtttccttgttcttgcttgttgtaggctgaagattgctgccaagattcagtttctactcttgccttggcttctcgctcgagccaagtggtcaatgaacaatactacagcttatccttgagtgctaaaaaatcatcaaagtcaaatatgaacttacctaccgatgccaaaaccttgtcaaggacgtttattcacaaaacaatgtcgatgcaagagaagaatgcccgacctggattcaataatagtggtgtaaaaggcggacaaactcctactgctaatagaaggtcttaggaatttaatatgtgaagtaaaagattttgagcttggtatttcattacaaagtgtagctaattgaggttttatttcacgcaggactcagccaatcattagttcaacgaaaaaatctggaagctcaatctgtacttcaattaagatgaaggaaaattatgctaaacctaaaataagtggaaggtactcttgtgaaaatagatctatcattcttttttttctaaaccagcttaaattgtttttttttgttgtcaggaaattattttgtccaagcaacaattcattgaaggtacaaaactgactatcttaattgttatactctgttgcggtttatcagacaagtaacacatgggcatgaaattgcttttatcgtctaattgactaatcaatttcaacttttgaactatttaggaggagaatgctacggatgttgcttctacagtggtaacagaaactaagtcagcaacagtgagaatacaagctgatgttagtataataagcaccctactatgcatttttggtgattatcagttgagttattttatcttggacctccttacattattgtacaggaagtacaaccattagtaggcatggaaattcgagct

SEQ ID NO: 32568 - DNA, 20334 bp, Oryza sativa
tcgtgataaaaggtggcatgcaggcggccacattagggcatttacaatgcacctacgtgacgctcagcctgagagaaaggaatggcatattcggtgccacgtccttcacatgtgtagccaagtgaagaccgagtagccaaacttggtcacccgtttttgggctgaaaagcatgtgaaaagcgcaagcgcagctgggaagaggagagagagcgcattgggaaaagcacacacagaagcacaagcacagccgccccacaccgtcgtcgccaccgctgcgcagccgcctgccgccgaacgacgccgtagctgctcgggccacggcacggaggctggaggaggaagggggaggtgccgctccaagtcgtcctctccgccccgccgcggtggaaggccacagcgccgccgccgccgcaccccgacgagccgatgccaccggatctgggcagctcggccacgccgtcgtcgcgactcgccgccgctgcgctgcgccccgacttgccaccgtggcgccgcgcccagactcgtcgctgtcgtgtcctctgccgccgtggagcgccaagcccgtctccggtggagggagccgccggtaggaggagggagaggtgaggtggcaccgccggtggggtgaggatgggagaggtggcaccggcggggtcaccggagttgagtagagaggggatcgtttgggaggggatgagtggggaaaagtaaagagtagatagaaggaagatgaaaagcatctgatggtgggacccactataagagagaaggtagttatttgcattgtgggatgggtggctttgtaggagtttcatccaatgtggcttcccaggttcggtgttggtgcgagacgcactgtaaacttctagagttctagtatagagaggactagactagagggctttattgtcttaaatgaagtcctgttgaaacactaccacatgataataacatttagaaatagagtatcttttaaaaaaaaactcaggttttagggaatgcataatgtaaaaccacatgataacaacatttagaaatagagtattttaaaaataaaaaaaactcaggttttagggaaggcggaatgtaaaacctcattttttgaggcaaaatgtttcaacgtagatgtttcatattgtgaatatagacctatccatcagattcatactaataggtgatattctagtataggttgctatatttttgaataaaagcacattaaacttaacatctatgtttctccctcccattaattcatgttctacatatccaacatatatctgccttgcttaataggactttctcccaccacatagtatcttaagagcaagttttatattacatctaatcttgtccatgtcatttccgtaccaaacccaacacccatattaactttattttattgttttcttgacaaaaaccggttctaccgtttccgttttcacttttttttaaatcaaaatcaaaatagtcaacgccaaatacaaaaacagagttaaatattatcgaatacgaaaacgaaacaaatacggatcagaacaaatatttgtcggaataaaaaacaactagaactgagcttctcagatcaacagagaggaatatttatcggctcattattttttctaaaataataaatcggcatttatagcaacaaacatcaaaagagaggaaatcacatcaacgccacaccattatcaatattggtaccacactgtatgatgattacacgaaacacataatagcagcaaaccactgcaaagcactgattctctcacagaacgccaactcctggccaaagcattcgctcttgagagaagcaactggataaaaaaattacaaaacaaacacatgacacctttgaccaaagaagcatatgcacactccacaggagaaccatcgcactcgcgctgcttactttcctaggagtcgataatcccggacatcatctttttgatctggtgaagataacaaagcagtggcaattttagtacacccaaaacccatggagtttgcaaaatgaagcagctggagtctaatactattcaggaatatctctagtgacagtgtaatccagtgaaatgtttgtgaaaactaaaaccatcttccagtgatcaaagaacatagataaatgtacacattgcaatcagattctccagtacctcttttgaattcattccgatgatgtctctcagatcacttatctgcgaaagcaaaagaatcagctctgagttgcattgtcatataataacttctagttgcttgggtctaacggctactcccttgttgatctagagtgctcacctctttaaatagctctgccgctctggtgactcctcacgaagctcaagtatgtagtttgcccttttttctccgattccctacacatgtatcagtgggttaatggtaagaaagaagcaatctgggctgccacgatatgattcagagcaaacctttaagctttttaattgctccctgcaatggacacacaaacaaacatgcattagaaatgcagaagtggtgtgaagtcggttgtaaagataatgccaaactcacttattagcactgttgagaaaagtcaagcactcttgagctagagatttctgtgggacataaaaaacaagagagaattcatcaggcaagatgattataagaaggtacaattaaacacattaagcgaataaaatgagtcagtgaattaaaaaaaaacaggttaaccttaatcccagtgctgtgggccataagtttatccttgggatcttccgcttgctcaaattacaaatgcacttcaggagtttttggctctggtgcaatcgtgttgattctccggacacattctatgttccacttttctgccctcacgctcactggccgagtgctaagaagcttcaatgagtttgaaatctctctcagtcggtcactcaactttggggaggatagggtactgctggcaggagtcttctcaacaaggttatctgggaatgccagtcaggtaataatgtgatcatactttgcattcacgtaatgaacttggcaacaaataataagagtgatgctataacagtgatcccatgtcaatacatgaattcctatcggccagtcaggaaaaaaaattggggaactaaaccaggccatagtcctgaacaaagtaacaggggcactacgtatttaatacagaactgtaaacagataatgagtattccttgcaaagagaaacctcttcttgtatagtagtacttggtagcagttcttgcatgctgcaatgtaccacttcttgcatttcagatgatttaacatctctggtgtttcctgtttaagaacatacttgcattagctccaaaactatatcaataggccattcacttgggacccgggtgaaagggaaccaaaaaaatggtccttcattggcaaaggggtcgaaactagatttcggcaatactaaaaggggtggcgaacaagctatgaaaatggatgggttatgagacataggatttttacaggtttaggccttctcgatgagaagtaataccatactcctgtccggggatatattccgccgattgtggtattgatctgacgatcttggatgtgattctgccctcaaggggccccgacccctccttatataggcgaaggagtcaggaaaacaagataaaagaccttatcccttacggtctaagttctataaataatttacaattgtaaccgactaagactacgggatacttcctttatatacaagttaatacaatacccgagtccttatctttgcatattctgttactatgaattacccccgatatccagtcaggtaacgtagccctagggtatatggtacccataatctccacagtaacccctaagaccttcacagatgatgagacaaccttctcctgagtggtaatgatattctcccgagtgatttcatgaagaatccaagtacttgaatcatcctcaccataaatcctgagtacctcaatcatatcatgctgtgaagggctaaaaaagaaaaatctaagtgcatcgactatataaacctaattagatgtagcccccgactatatgattagttgaacaaattaaacatatagtcaaggaaaaaataaacaaccgaatggtttaaaaaaaattatagtcaccaaaatgactgaattaattacaaagcatatgcggcttaaatcctcgaaaataatcataatttataggagatcagcacaactcctcccctgtgcctgaaattctcttggaccgatcgaaatgcatagtgcagtactccagcttctccgcaggtacatctgtctgggactcggccacaaaatccaccaaggctcgagacttgatcgaggtgtgggctttgaaagttaggtctaatgccatcaactctaatgcccacttagtgatacgcccagtagctccgcggttgtgaccaccgtaaccgagtgactctgaaagtaatgggccaacttcctgacagtaattaagacaccatataataacatatgtacctgtggatagcgtgttttggtgtcggccatcacctcgctaatgaagtaaatcggcccctatactttttggacgtagccctcctcttcatgctcgacgactaacaccatactcaccacccgggatgtcactgagacatataacaacaacggttcctgtgggtgtggtgaagccaatacgggtggagttgtgaggaaattcttgaagtcttcaaaagctttctaggcttcaggggtccactgaaagttttctgtcttcttgagcagcttcaaaaaaggcatccactgctcgcctagtcttggaacgaatcagctgagcgctgccatgcatccagccagcttttgaacgtctttctgggagctcggcggtttcatgttgaggatggcattgatcttctccgggttggcttggatgcctctgtgagacaccataaagccaatcaacttccctaacggtacttcgaaggtgcacttctcgggatttagcttcatcctgaaggctcggatgttggcaaacatttcctccaaatcagcgatgagattatccttgtgcttggtcttgatgacgacatcgtcgacatatgcttctacattgcagccgacttgggttgtgaaacgcctctgcatcatgcgtagatatgtagctcatgcattctccaacccaaaaggcatgataaagtagcaataagacccgaatggcgtgatgaatgaagtcttcaagcagtcggacttcttcgggctgatatgatggtaaccgagtaacaattcaaaaagtttagcaactcgcagccggctgtcgaatcaacaacttggtcaatgcgaggcaagccgaaggggtcctttggacaagacttgttgaggtcggtgtagtcaacacacatgcgccattgcctagttttcttccgaaccaggactgggttagccaaccagtcgggatgaaagacctccttgatgaaatggcgcattactagaaacataattgccagcaatggcgcagaaatacttctggtatattacggttacagaatttatccgcaagcgcacggatataccattgtagtatttcacccgagagtattccaagggtatcgtaattgtttaatcccgtgggaagattataatagagagaaccatactaataatttatatattacttgcaataatcaaagtctaagcaggggctaatataattcaaagagtatagtgacactaagcagaagcattaatactctcattcataattatctaagctaagtggaaagaaaatcgaaagatcatattcctatacttctagtatacaaacatattacacatacatcctagttatatgattacttagctaataccctctttccatgccctcctggtgcttcaagaagccacccctgattgccgagttccttacgacaatctgtcatgactacccaaccggggctaaatacggaggagtaccctccccaggaaattaacttaggactatatacacacgcggaggactatgtacacgcgcggaggaatacccgtactgagctgtcaccatcagcggcccacctcgcttccgtagaatataaccccaaataatgatatccagtaatctaaacaccacgcttaagttacaaaatactagtctaatatcatcgtcatgacatagagtcatcgtaaatacgatcattatacccacaccattgcatctccctgataagctagcatcataataaatataacttggatatataataaagttggtatttgatcatttcgatcatatactcggaaagtaatacaataccaaagtagtataaagaagagtattttaaattaagtgcaagtcttacaaaagaaggaaaagctactagagccatacccgaattcttctgaagactcggagaactaaagattctattctatttctattccactatactctagagactatatactaaacttgagagatgtatgaagctttttgcttgaggtgtgtcttgaaatggagagagtgatggccttaaataagctggtaatgacggttatggtgattggaaaggtcggtaataccctccaaccgccatagggaagccatccacatcgtccatcgccaaccctggatccagcggctgcacgacgggttctgccgaaccatgggcaggcccatccagcccacaattcgactggtggcctccttgacctcttctatcttcagacttgtgaattttggcccaattcgatcgtgtcaattctgagttcttggtctatcttcctttaagtctgattatcgacagcgtccggttgattaatcgtccattttgttgtcgattctcctccatcttatgcttattctgtgtaagagattagtaatcctagtgctagtggaatatatattattttaacacaaaaatgcattgcaagcataacttgttctcctctatttaggtaatattgacgggcgaaactgatcgctaatgactgtcgacaaacagcttggctaactctttcttgatcacatctcttctgtcttgcgcaaatcagcggagtcgttgcctaataggtttcgcgtcttctttctaggaataccaggcatatcagatggttttcacgcaaatatatctttattagcttgaagaaaggtgatgagtgtgctttcctatttacaatctaactcaacgcctatcacagtagttttggaaggatctaaaggatcgagtggaatcttcttggtcttggcgtcgttttctcttgacttggacaaatttttagcgggcacgtctccctctggtgaagtagatgtagctagacagacttcttctcggccgagtgcttgctcgcaagattgggccatctcgcagctttccttgtcgcaggtgatagcctgcttgacatcgctgcgcagggatatgactcctcgtggtcttggcatcttcatcatcatgtaggtgtaatgtgggatggccatgaacttggctaacgccggtcgtccaagcattgcatgataagctgtctcaaagtcggcgacttcaaagcagacattatctgtatgaaagttttccccagtgccaaaggtaaccggcatagtgatttggccgagtggtgtagatgaaaacacaaggaagactccgtgaaagggtgcattcctcagccgtaactcgatcctcgagatctgcatttcgtcgagagtcttggcgaagaggatattgagcgctcttccgccatcaataagggttctcttgagcttcacgttgcgaactactgggtctagtactgggggtaccgccccgggtggaccactcggttgggatgatccgagcgatcgaatcgattgcaacctcagaccattgtaggaattgtggtacttctggctggactgcgttgatctcccggtcggtcagcttctgcttcctcttggactcgtaggcaagtggccctccgaagatgtggttgagctccttccttgaatcctgcaaagtgccttgagctggctcggtgtcgtccttcttctatgttgacgtgtcagtttccccttaagtcggcttcttgaattgagcgacgtactgcttggcaaactgcttgtagacgaaacaatctttggcagcgtgcttggagttcgggtgaagtgaacatggcgcattcatgatcttgtcttaggtgttgacacgaattcgttgatgctgaaaagtggacgtggcggcaaccagatcctcgggcttacacttgcgatccttgtggtgagtgttgctgctacttgcaccgttgttgccactgtccttcttgggcttccagccactgccggactgcttcgaagctaagactgcgtcgtccgccttggcgtactcgttagccttctcaaacatttccttgaccgtcctgggtggtttgcgtccgaatttgccaatgagtagctcgttgcgaactcccttggtgaaggcggtgatgatattgccgtcggtcatgttagagattttgttgcgcttctctgaaaagcgccggatgtaatcccttatgggctcattaggcttctgtatcacattgtagagctcgaagtgagtgcttggccgttcgaaggtcccttcaaagttggcgatgaagtggtcgcgaagctcgccccgggaaccgattgtgcctcgcagtaacccagcgagccagtttctggcctagttagccaatgcgacgggcaggtagttcgccatgccttgttgtctcctcctgctacgcgaattgcgagagtgtacacgataagccaggactcagggttggtcttgccatcgtacttctcgatgccagtcggtttgaagctggccggccaattcactcgacgcaggtcacgtgtgaatgcagtgactccttcatcattgccatcaatgcactccgtggagtggtggtgccctcgtccgtgtctcgctctccgtcttgcattcaaggcttctctgagatcaaccaggccatgagaagacttctgctgctcgtgatctactcggggccctctattgccaacagctggagagtgaaccaactgctctcgaagcccccaacttgagtgcgaagcgcgagaattagaccaactagctcggcttcctaactgatgatgcgccgaggtggtgggttaccgactgccactataatcgtccggaagtgttgccgcgatcatggccttcatcctgttgagagttggcgtcacgtagtctggggcctcaggcaggatggtgtcgatgagggtgattgccccgactgcattctgctgaggtgtgagaaacacgttggtgtcatctacaacagtctgaccaatgagttgtcgagtgcgacgtccacattgagccaaatctctccgccttcccttttcttctctccgtctttgttcttcttcctctcttgtacggcgctcctgatccagacgctcacgttccaatatctgccactcctgctcctagcgttcttgttctaaccttgtccgttcttcgtctgccagtcgtgctgccctctgctcgtctgtctcattgttggtcataaagacgccgaagtacagcgaagtgtagtcatcgttgaggtcaccgtagtagtcgtcgtagtagtcattgtagcaagcgaagttatcgaagtcgaagtcattgttgtagttgacgatttctggtttcgcttgagatccgatgttaggggagctaagatagctggcaatttcgtccgtcgagcaagagctgagtggttggaggatgactccgacctccctggagctagatctgatctagctcaaagtcagattagatcgagacctagggggacgatttccttgagccgaaaatggccgcgagatcgtcagggaggcgcatagtgataggcggatatcgtggcatttaagcaaagctcactacaagaaatcttatcatagatgacgcttcatttacgtcacaaaaacataaaattccgtcatgttttgtaatatgcgacgctcgtgtgacgaaaattcattcgtcacctatcatgcatatctaatggcgttctatgacgaaatcttatttttttcatcattaatctagtggcaatccttatgtcatcataactttgtgacgctcatatctaacataaaaaacgtcataaaatatctgatggcccattaaaatccatgtattgaacaccctgtttatgggcttagcccaatggcaagcccgactagattttagcctagcccatctatgatgtggcatattttcagcctaattctattatattcatttgctttaatatcaaataataaatgtaccaagtccattgcaaaagcccatataggcccaaacattataccacaccattttcagccaatcttattatattcatttacattagtatcaaataacaagtgggctaagcccatataggcccaacaatcaaacacaataacaacccatatagcacaaaggttacagcccaattagcatccaacacaacccgacaaacatccaatacaacacaaaatttataacccagttaacagccaaatccaaccaattgctcacacctaggcaagcacaaatcctttcaaatctctaaaccaaatgccatgagagtacccccaaagtcccttacatggagcacctttttttgctgcaagtaaaaaggaacaacattaattaacttatgtacgcaaccaatcatgaaaagcatactttcatgttgacctggcaatatacatgcacacatagtaatctaattttaattagttccatgaggataaccatatcattacaatatcccatgaacaaacttagaagtttctgatgcaggagctagaaagaatgataaaacactcttgtaaaggactaaaggatcaagattcgttcactcttgtaaaggaccaaaggacagtaataccaatatgattttattttttgttagttctatccaagttaacaaacatcttttatctgcgacgaagcatatgttgcggtcagcagcagcacaaggagaggaaaactcactttcgttttccgtgcgcaaactcactttcgttttccgtgcgcatgctaagacttactccctctgtcccaaaaaaaagacaaaccctaatttccatgcccaatatttaaccgttcgtcttatttgtaaaaattatgaaaaaaattaaaaagacaagtcacgcataaagtattaatcatgttttatcatctaacaataataaaaatacaaattataaaaaaatttcatataagacggacagtcaaagttggacacgcaaacccagggtttgccttttttgggacggagggagtagtagtatactgttggctgcatgaactcaattaaaatgggtatattttctcagtttctggtaggaaacaaaccaagtactgcagtgaactcaagtgttaataacacgaattttctttgtttctggtagctaggaaaaacaggccagttaagattggaaacatattgcattagttggacaaaaacaaaatattcaatgaagcgatgactgacattttatacaaaaagaagtgttttacattgttgggaagcaaagtatagaacaggaaatattaaaagcgctaatattagagcatgcaagggggaaacaaagagagtagtttattagttgacacacacataagactcatgtctatactgttattactacatcaaaaaaattatctatactttggggttagaatgaatattagagtaaattcatccgaaaaaatgctaaatatattagagtaaactgacagcagtagaactatgcctcaatgatatcactccctcatggcctgttttcaaaggaatggaggatacaggaagtagaacttaccattaggcttagcggaggtcatctgttaataaggctgcaccttgtcaccagtcaccacccaatatcaatggggtccgctagatgttaatctgactatgcaaatccagaaacttttccaaacatcgttaatctaattatacgaatctagttagtttgcataaacatcttgacaattaaagatcgcagctgcatagtttagtaataacctgtgcagtaaacatggtacaatggttatatatatccacggttagaagcacacacatgtacagaatattaaaaaaaaaacactgtgatggttgttaggatggaatgaacctaatcttttatttgccatgctagtaattcgacaaatcacacagggaaaattaaattagcataataaaatatgcatcacttcatcacaatcataaatactccactttatcttttaagtaggtttgcatgtctttccgacagaagattctattagaattaatttaacaaattatttggcatgatcaccctaaaccattaaatacaaactgagtgtaacttagccctgtgtttacttactgaattgagaaggaaataaactgtctttagctactgaataaatcatgtagcatatgcaatgtctcatgaacaactcatgggagaattaggcaatcaggcaatagcttttgaatgaaaaagtacatgcaaaccaacaatgagatcggccgttttttgtaagacaattttgtttcagtaacttacatccagaaacttatatgcatttcagtgttacaatgcgttagacatttgagtaaactaatagcattgaagttaggcatcactattatcattcactccctggccttgttggaaaagagcttcgctacaggaaataaactcaccatcgtcaggcctggctgggacagcagccgaggtcacttgtgaaggccgcagctcattcgcctcacaggggatcgtagcagctagatctcgccaccatagtggtctgtcagcccccactctaaccgctggatgccaagccacgggagggtacagctcactgccgtaagcgtcacaagtcagccgccgcctgtgggatgcaggtgagcggcttcccgcccgtggtgcgggacgatgcgacgagcacctcgtacttcgcctcccagaggtcggcggtggagtggggaattgctttaacatttaatatatttttctagaaatgcattatataaatctatgatgtttgctttgtgccccttattacattaatattcatcacgatatcccattgaaatactttgtgacgatttctagttggtattaaagacgaatacatttttttcgtcactaagccaccccatctcatactaatcatcataaaatggaatgtgctaatgataaatagctccgatatcacgaggaattcgtcacagaaggtcatatttcttatagttgctggatgccatggaggaatcttctgcggagtctctcgagtggtttgaaaccaactcgagggataggttcttggagtagatctcagccgagttcaggagaccgaacggggccgagatgccatctcctcccgactggttcgaatccgagttgagaagagagatcttgccgaagctattagtgatgaagtcgaggctaccgaagcggaatgtctgcccgagagggaagacgaaatcgtcaatgcttgatgtagatgtagatcccatcgcactagtcggcgaaaaacttgacgcaacccctacctggcgcgccaactatcgaaactagatttcggcattacaaaagggggtggcgaagaagctatgaaagtgaatgggttatgagacaaaggatttatacaggtttaggccttctcgatgagaagtaatacaggtttaggccttctcgatgagaagtaattccgccgattgtggtattgatctaacgatcttggatgtgattctgcccttagggggcccccgacccttccttatataggcgaaggagtcgggattacaagataaaagaccttatcccttatggtctaagttctataaatattttacaattgtaactgactaagactacgagatactttcttgatatacaagttaacatgatacccgagtccttatctttacatattttgttactatgagttacccccgatatccagtcaggtaattaacgtagccctgtgggtatatggtacccataatctccacataatgcagctcgaattttcatgcctactaatggctgtacttcctgtacaatgatgcaaggaggtccaagataaaataactcaactgataaccaccaaaaaggcatagtagcactatacttcctaccgtgattcttctgtccactggttgcatctcttgctacgtgtatgcctgtggtaagatgcttgagtgcaagtgtctttctctcatcacctagtagttgatagggataatatctttgtgttatcttctattttctactaaccatgacatgcaccaacgatgaatttaaggactgtgtgcttagggaggaacttgtcaaagtactcgaagacaaatgtggagctatgaacagagatatgactgttgcgatcgagaggatggttcaaacctttaccgagaggttccaacgcatgttgaatgccagtcttacaacgaacaataattgtcttgacgggttggtgaatctacaataggattatactagaaaataaccgcggctttgccgcgcggaagtatacatagactggatggacccagtttatacactattaaagcctaatgctcacgtaaataagaattgatcataactaaatctatacatccaaaaccaaaaattgggggtgcataatcacaaaattttacattaaagaacttataatctagttttacataacatcaaacttaattgcttttattcctgtcaatgagaggtcgaccgtatttccccttacaaaaccaatgaggttcatatcaaatgtttccgtttcaaagatattacacgatcaatactttgagattagcattaatgctgagataaggagatttaactatttgtaatgaatagaaaataagataatgttttcattgacgataatagtatcaccgaatccatcgtctggtgatacatcattaatttaccacagccttgtttggcatgagcattgctctcttaccgaatcgtatagtactcttaagtcccagttctgcatctgcatttcccagacccagcgctctatgttaacttatgaaaacgtaaatggcataatgaagtacataaggtcatgaatgtgttctgaagaaacggaacataagaatgtaacccttgaatttaagaattggtagacttcaattcaaattttaatctctataggagaaggtagtgactcagttattagaatataacatgaaacaaatagttttgggagagcatgatacaagtatatgcgatctaaaagaaatgtagcttgttatcaagacaaaggtctttgtgactacagggtaactcaagcagatgtcctggttgtgatactcatccatgcagaggtgaagaatgaaaaatcaaagaaagctagttttaaaagcaaaatagaaagggcaatttctttctgctgctcttattggtcaaaattgtcctactgatgtgagtataatagaaacgatttcttggattagttttgttggactactctgtgccataaaaaggataaagaatattttttctgaacaacttgacaaatgcccataacattaatactccctccgtttcacaatgtaagacattctagcatttttcacattcatattgttgctaatgaatctagacatatatatatctatctagattcattagcatcaatatgaatgtgggaaatactaaaataacttacattgtgaaacggaggaagtatcagataagcaaaaggttttggatcttaacgaacaatcatgtaaatagcttatataactgctaaattttattcacataatgctaactgaatttaagtttcaaatgccttgctatgctttctttttctttctttcatttttcctgttgctgattagtgcagcagctttctgaccaaaggtgtaaagcatcactgctatcaaagtcattcgattgatatctgattgattaacgtccagaaccattgacacataggttgtgtttaggtcacggtaaaattggtcaagtcctcaacgtacatggagttggataagcttgttgcaatccattagcaaacaccaaatgctgagttttttttttcttcgctcaagattagaatattctgaaggttacgccgatgcattcaacaggaaattaatctgctcattatatacatggaaaccttgttaaattaatttgaattaaaaaaaacacatcaagatgcgtttttcagtttaattaagtacacacagatgagtcagtattcacctcaagaaacgggcacccatattggtaacttgtgtgcatctccggtgagctttcttgcctctgtggctaaccaggtttaatcaaatttttaaggagaaaatcagatgccagaaatgccttgcgccctggctttgagcaaagatgttctagaagacgtgtgcacctgtcagcatggttggagctgctgtcaaccatgaccacgagattaggagaaggatgcagcggtggccggtggcagtaggcggaggggaggcagcggccgtgcgcccgtgcgacgctggaacagcgcaccagattggcagtgcactggaatggtatactggacacgtggcgtgattttaccatacgcaaacttgcgttcaggttttgccacgtggcccaatcagcgccagggtccgatccctgaaatcggtataagagattgatagcaactggcttaacttcaatcgttgaggtattggaggtaattttcataatgtgcgtaatgatccatatgctaaatttaaggttacgattccctcttttcattgtgcctatgatgctgaagcttattttgattgggaaataactgtagataaaaaatttagtgcacatttattcctggtgagcatagggttaagcaagctactagtgaatttaataattttgcaacagtatgatggactcaaataagtacagatggactagcacctacaacatgagaagtgttaaagacaacttgtgcactagatttgtgctccttcttttagacgtgatcttttaaagaaattgcatgcttagactagggggataaatctataaaagaatattatcaggagttaaaaaatgttgtttgcattgtgatgtaatagaggatgaagaggctagtattgtaagtttctatggagggttgaaccgtgagattcaagatattgttaactataaagaatatgaagattgtttctacttgcatgtttggcagaataagaattgcagggacgacaacaatcaacaaagtaccgttttggaaatgctatttcaacaaggacggtatctcctcttacatgctctggtgtgtcttccaccaaccaagctccatcgacacccgtcttcattccaccacgagctaccgaggtgagtaagtcttgtaggatcaaatcacaaaaactaatccaaccaggggggtgaatggttggtatacccaaaaaccgaaaacttttagcggaaataaaagttaccctcgaattcgacggattgcggtctgaccgaaattgccctgccggtctgaccgcctggttgccgtcggtctaaccgagattagatcttcggtctgaccaccgagatcatctgccgcttgctgttgccgccgccggtctgagcgcctcgctcccgccggtcggaccgccgcgatgccgccggtctaaccgccggttagtcgccagttaaaccgccgaaacccggtgaaacacaaatcaaagaactcttaaagtggatgacgactttattacttctctctgtgtttacaaagtgcaccaacagcactccttacaaaaatttcgactaaactcgaaaccctaactcaaaactcaactcaattgctctcaaaagcgataccgggaagcctcacgctccccctctatttatacccgaggtaggcagcctaaagccatgaaccaaactcatactaggagtcctaaacaccttaggaaaccctctagtacaagatagaaactttagataaccaatcgtaccaaatttggactccttccaaattcgactccgcatcccatacgcacacaataactccatcgtatgccatatggaatctccatcaaccacgtgcatcaactctagccttagtatcctgcatgatctctgaccaccacggacgtcgtcttatccccaagccgactcccgattcatcaccgcaaatactctcccgagacattgagtcacctacacatggaacaaacaaagaaaccatattccgagaccaatctatctccaacttgactcattagcagcaaacaatagtattacatacgtatagtatccatctagaagtcataatcatgaaataatcacggatatccaaataaacaactcgaaaccgaaaccgacacagcgtcggccggtcagaccgcgcaatacacgccggtccgaccggcaacccgtgcccggtctgaccggacccaaatccagcagtacctgtatattcacctgtgaaatccaatcatctccaaaaccacttcgtgaataaattccaaataacaaaaccaataatctccaatgcccaattgttcatcacagaataataatcaaaaacacctttgattttacaatctcccccttgatgaacacattggcaaattcataaaaatgttttggtgtttggaaaaaaaaaacaaaagtggtaaaaagcacacttcgtacaaatgtacacatcgtgctcaaaaatccaaaagaaaacttctccccctttttaaaagaaagaaattcccaattgaacaaaaaacatgctctttgctcttctcaacaactctcaaaaattaatcttgcttctccaaaaattttcacattacttctcccccttttgacaatgatttcatcaagtataggaattatgttcattaatattcaagagcttagcatacatatagcatattacgtcatgtgttgcaataaaaagaaaatgaacccatctataacataacaaacatgaattaaagtataaccatgaaccaaagattttacagttaagcttgaattaacaatcataattcatgatttcatacgatttataatgcaacatcttaacaagcacataggttgaagaataaacactaaacacatatacctattgcaattatcactctttctcaaataagcctttagcacaaaacaacaaagagaatttttaactttttcttttcttgagcctttttgctcatatttttctcttttttattccgggtacgtccctgtcgtcaagactgtttccagggattcggcacccattattttgctcacatcgaatacgtccttgtcgtcaagactgtttccaaggattcggtattcatttttttatattttttattttctttttcacaataagcaattaaaactatttgaggaataacaaggcaataaagcatatatatagagcatttataaatcaaaccatatgctagcattaacattgcatattttcttaattcaagtatagaatttaagtgtcatgcatcatctccctgaaaagcaaaatctaaatctcatgaaaagactagaatacatacaagctatgctagagacaaataaaccttcaaagtattgctagcatgcacaagaaaataccatatgcataaacaaagctctcgtttataaatttttctcattatcatattattgcttgataaaaccatgaggtacaaactccccctcaaaccatgccaaaaggatgaattatgcccaattcaccacgaagaaaagcaaagtgattagaatccaaaggcttagtaaaaatatcagcaatttgcaactttgtgtccaaaaactgcaattcaacatctcccttctcaacatgatcccgcagaaagtgaaagcgaatatcaatgtgctttgtgcgtgagtgttgaacatgattcttagcaatattaatagcacttgtattatcacaaaagagaggtactttttcaaaagtaagaccataatctttcaaagtagataaaagccaaaaaatctgtgaacaagaactagcagcagcaacatattcagattcagtagttgattgagcaacactagattgtttccttgaagaccatgcaattaatgatgtaccaagaaaatgacatgttccactagtacttttcctatcaattctacaaccaccaaaatcagcatcggaatatctacttaagcatatagaagatgaagtagaataccaaattccaaactcaagtgtatgattcaagtacctcattattcgcttgactgcttgacgatatgaagcacgaggagaagcttggaagcgtgcacacaaacacacagcaaattgtatgtctggcctagaagcagttagatataacaaagatccaatctacttctatattccttttgatcaacagtttcaccatcttcatcaggatccaacacagctgtaga

SEQ ID NO: 32569 - DNA, 1095 bp, Oryza sativa
catttagaaaagcacttttaacatccatttgatacaatttaaaaccttttgaagcagcaaaagccaacaaaagtctaattgcctcaattctagcaacaggagcaaaagtttcatcaaaatccaaaccctcaacttgagtaaaaccttgagcaacaagcctagctttatttctcacaattaaaccatcctcattttgtttatttttgaaaacccacttgattccaataatattatgtccagaaggtggttcaactaaagtccaaactttgtttctctcaaaattttcaagttcttcatgcatggcgttaatccacgattcatcagttaatgcatgtgaaacatctttgggttcaaaagaagcaacaaatgcagaatttgcacaaacatcatgagccgttaccttagaccttgtagtccgctcacctatattaccaatgatttgttccggcggatgtcgtcgttgaatgtgcaaaggagcagtgacttctgaagttgagtcacgttctgtatcagtactggtcgaagtagtaatctctggaggaccatctcgatcagcatcaacagtacccgaacccgacgatcctggccggtttgaccgtacgtcctgcgccggtctaaccggaggtgtgccggcggtctgaccggcctggcgcccagtctgaccggccgagccgacctcgtcgtcgtcgtcgtagtcgctctcatcttgaaaaatacgaccatcctccccctgaacctgtgacagtgtacctgtaatttcgggtcttgtacctggactagcctcatcaaaagaaacttcgcaagtctcaacaattttgttagtccctaaaataagtacacgatagccacgagtatgtgcggggtaaccaagaaacaatccatcggtagagcgtgcctcaaacttgtccaaatttctagatttcaagacaaagcatttgcaaccaaaaacacgcaaatgtgaaactttgggttgatgaccaaatcgaagttcataagaagtttttccaagtttagatcgcaagaaaactcgattcgaaatataacaagcagtgttaatagccttagccaaaattttatagagttttgtattcatcc

SEQ ID NO: 32570 - DNA, 2030 bp, Oryza sativa
tgttgaaacttaaaactggtaattccccgcttagagtaaactcattaaatttttgatagtttttgtgtgcttattaagttcacagaaaattgtcatgataaaaatgctctgcttccatgtcataaattatgttatacttatttggaatatttagtttcgtgtgaatttcatgattggtaatacaattaaccgtattttcatcaactatggcaaacggactgatttccattggctgtcaagtacacaataagccgatactagcttttccaagactcaacttttataatactatgccatagaatacttatttgtttagatttagttatgttgtaggaaaagaaagatgaaacgaagtacgaaatgtattgtttatattcattggatttgatagttcattggcatcgacgtgcaggccataaataatgatgagcgttcaagatgatttcagatgcaaacagcacagaacatgccaacgtaagttatgttggggatcagggagaatcatctctcagaatatatatctggtaatatactgtgttattgtgtattggatcgagagagccaaaagaaagtgcagcctgatcagaccatgggtaggctaggagatgagaatctcaagaactgaatttgtgggtgttaccccgaaatgtgtattttttttggatgataccccatagttgatgtggagatttacatggaagactattatatacatactaaaaaaacatgtgtgttgcatcaggaaaaataatattatgataaaacttagattattcaggttcaattaatcttccacaactcccacgttctccttttcagctagttggaccatatatacatatgaccctgagatagttctaggtcggacataggagcttattcgatccctaaaagctcttgtgataaagggtgtcctgcaggcggccaaattagacacccttcagctggccgagtgaaattaagtagagaggaccggagtatagggctttgttttcttgaaatgatgtcctgttgaaatactaccacatgataacaacatttagaaatatagtattttttttaaaaaaaactcgggttttaggaatgtgtaatgttccatcttttgaggcaaaatgtttcatattcaagaccaatccatcatattcatactaataggtgatgttctagtataggttgctatattttggaataaaaaacatattaaacttaacatctatgtttctccctcccactaattcatgttctacatatccaacatatgtcctagcatctgccttgcttaataggactttctcctagcacatagtatcttaagagcaagttttatatgggtggttacaatatctaatcttgtccatgtcatttccataccagccccaacacccatattaactttattttattgttttcttcaagggataaaaagggttcagaaacggaaagaaactggttctaccatttccgttttcatttttctcagaaatcaaaatcaaaacaggaaaccccagatacaaaaacagagtcaaatattatcgaatacaaaaacgaaacgatatggatcagaacgaatatttatcggaatacgaaaacaactagaaatgtgcttctcagatcgacaaagaggaatattcatcgactcattattttttctaaaacaataaatcggcattaatagcaacagacatcaaaagagaggaaatcacattaacgccacaccattatcaatattggtacgacactgtatgatgattacaaagaacacataatagcagcaaaccactgcaaagcactgattctctcacagaatgccaactcctgaccaaagcattcgctggctgtgtttagttaacaccaaaatagaaagtttggttgaaattggaacaatgtgacggaaaagttgaaagtttgtgtgtgtagaaaagttttgatgtaatggaaaagtttgaagtttgaagaattattttggaacgaaacacggcgagctcttaagaagcaactggataaaacaaaatactccctccgttttttaa

SEQ ID NO: 32571 - DNA, 3364 bp, Oryza sativa
catatgtttggattgaagccaaattaaactaatttggctattgaaatggcctatgttatataggcatgccaaaatttggcctcaatccaaacatacacaattattgttgaggttgccaaaaaattggcaagcctaatttaggcctcaaaccaaactggccctaaagaacatagataaatgtacacattgcaatcagattctccagtacctcttttgaattcattccgatgatgtctctcagatcacttagagcaagtctaatagtacagcccactaccagctccaaatcatttatagccaatctaatagccaattcatacaatagttacttactataatattagtatatggtcccacctgtcatacacacagtgtgtcttgaagtccgtactgcagctggctacaaatctgtagcccgctgctcttctctctcatcgtttatatcattaaaatatgtttatagccggttaatagcctgctattgtacctgctcttatctgcaaaagcaaaggaatcagctctgggttgcattgtcatgtaataacttctggtcgcttgggtctaattaatgcctactcccttgttgatctagagtgctcacctctttaaatagctctgccgctctggtgactcctcacgaagctcaagtatgtagtttgcccttttttctccgattccctaaacatgtatcagtgggttaatagtaagaaagaagcaatctgggctgccacgatatggttcggagcaaacctttaagctttttaattgtgtaaaattaaaggtgttttttattgttattctatgatgaacgattggcattggagattattagttttgatatttggaatttattcacgaagtggttttggagatgattggatttcacaggtgatctacaggtactgctggatgtggtccggtcagaccggcatgtatcacgcggtcagaccggcgcagcccgcggtttgaccggccgactctgtgtcggtttcggtttcgggttgtttgtttagatatccgtgattgtttcatgattatggcttctagatggatactatgcgtatgtaatactgttgtttgctactaatgagtcaagttggggatagtttggtctcggaatatggtttcttttgtttgttctatgtgtaggtgactcaagatgccgggagagtatttgcggtgatggatcgggagtcggctcggggataagacgacatccgtagtggtcagagatcatgcgggatactaaggctagaattcaatgcacgtggaaggtgaacattccatatggcatatgatggaggtattgtgtgcatatgggatgcggagtcgaatttggaaggagtccaaatttggtatgattggttatgtaaagtttgtttcttgtactagagggtttcctagggtgattaggacttctagtatgggtttggttcgtggctttaagctgcctacctcgggtataaatagagagggagcgtgaggcttcctggtatcgcttttgagagcaattgagttgagcgttgagttagggtttcgagtttagtcgagatttttgcaaggagtgctgttagtgtactttgtaaacacagagagaatcaataaagtcgttatccactttaagagttcttcgatttgtgtttcaccgggttttggcggtcagcccggcggcatcgcagcggtcagaccggcgggcacacggtggtcagaccggcggcggcgacagggagcggcagacgatctcggcggttcgaccggagttcgatctcggtcagaccaacgttcatcaggcggttagaccggcgtatacacttcagtcaaacagcgatccgtcgaatttgagggtaacttttatttccgctaaaagtttcgggttttaggtataccaaccattcaaccccccctccctggttggcttagttgctgtgattcgaccctacaaattgttccctgcaaaagacacagaaacaaacatgcattagaaatgcagtagtgtgaagtcggttgtaaagataatgccaaactcacttattagcactgttgagaaaagtcaagcattcttgaactagagatttctgtggggcagaaaaaacaagagagaattcatcaggcaaaacgattataagaaggtacaaacacattaagcgaataaaatgagtcagtgagttaaaaaacaggttaaccttaatcccagtgctgcgggctgtaagtatatccttgggatcttccgcttgctcaaatttcaaatgcacttcaggagtttttggctccggtgcaatcgtattgattcgctagacgcattctatgccccacgtttgtgccctcacgctcactggccgagtgctaagaagcttcaatgagtttgaaatctctctcagttggtcactcaactttggggaggattgggtactgctggcaggagtcttctcagcaaggttatctgggagtgccagtcaggtaatgatgtgatcatactttccattcacgtaatgaacttggcaacaaataataagagtgatgctataccagtgatagaagagcaggtcaatcccatgtcactgatgtcagtacatgaatgttccggttccatatttgacaaggcatagtcctgaacaaagtgacaggggcactacgtatttaatacagaactgcaaccagataatggtgtattccttgcaaagagatacctcttcttggatagtagtacttggtagcaattcttgcgtgctgcaatgtaccacctgttgcatttcagatgatttgacatctacggtgtttcctgtttcagaacttccctgcattttgctccaaaattatatcaataggcattcactttggaactcggctgaaaggaaaccatagtaatgtacctcatttgctaatgcagatcgaattttcatgcctactgatggctgtacttcctgcacaatgatgcaaggaggtccaagataaaataactcaagtactcaactgataaccaccaaaaatgcatagtagcactatacttcctactgtgattcttctcgccactggttgcatctcttgctacgtgtatgcgtgtggtaagatgcttgagtgcaagtgtctttctctcatcacctagtagttgatagggataatatccttgtgctattttctatattctactaaccatgtcatgcaccaacgataaatttaaggactgcgtgctcagggaggaacttgtcaaagtcctcaaagaccaatgtggagctatcaacagagatatgactgttgtgatgagaggatggttcaaacctctaccgagaggttccagcgcatgctgaatgccaatcttacaacgatcaataattgtctcgacaggttggtgaatctaaaataggat

SEQ ID NO: 32572 - DNA, 469 bp, Oryza sativa
ttttataaatttactaattggccatttttctcctgctctttcttcagagtctattgttaaagggctcatgaattttattcctttagaatgcattttttctatcacatcatttacattgattttgtatttggaggcacttctattagtcaatcttcctataaattctatacttattaataaatttgttcccttaaactcttcgtatccttttgtttgaaaaccaaaactcattttatctatgaattcttttacaggcatcattaaatcaggtgctatataggttatcaacatattttcattcatatctccttctagatagcctaaagatgttctgtctattgtgtcccatcttttatctaataaggttattaaaactttagctcctaatttctttcttgtcattcctttgattcctattatgtacataccttggtgaatatacttatatcatgaatattttaatccattt

SEQ ID NO: 32573 - DNA, 5535 bp, Oryza sativa
tatcacaggtgaaacaagattttcaaaatcagctttaaacactcttccataacgagaaatattcagcacagaatcaccacgataatcaaaaactttacttccacttttcttaaagtgaacttcaaactcttcatcaacaatttgtaaaaccgaaagcaaattgtactttaaatcctcaaccaaagctacattcttcaattcaaaattttcatttatctttaccaaacctgtagcgacaacggtacttgtagaagcatcaccaaagataatagattcagtcttagatgcctttttgagggaagagaaccaatttttatcaccggtcatgtgccgcgaacaaccggaatccacgatccatacgttctccttccttgccaccaaagcctacacacaagcagaagtcgaagcctcagtactagggttagataataataaaaacttaggaatccagtactgagacacacgaccaaaagatccaataggcatatatccacgtgcaaaatcaattttagaattttcagaaaaattcctccgaggtcggtctgaccaaggtatagtagccggtctgaccaggggccggtgtgaccgccactgtaccgccggtctgaccgatgttcggtctgaccgaggatctgtagccggtctgaccgcgggacccactgtggtttgaccggtttcctcgagggaaaaccagatttttgccactttgattttgcaaaagcaatctctctctcctttttctgtttatgagctaatctgaaacaaaaatcaacaatatgtccatcttttccacaaaaagaacaagtatatttttcacgttgtttagacacattgttaggacaagaagatttagcaacacaagcagaaacaggaggttctgcatgctcaacattggattttgaagaagatgcattcatggtagacatgataccagcagatttaaacacagttttattagtatcatgtttaatcaaaatctcaccacttctagcaccaacagctaacacaataggaggatgtctagaattatgagcataagggtcaaaacctaaaccacggttatgtgtgctaaccttagattgatccaaaatcatgttgaggttctttttaccatcagaaaatctttgaaaagaatttttcaaataagaaacctctttttccaaattagcacaattttcacaatctaccatgacacctttgcttttacgacatttggggcaagaaagcacttcattgtttttcacaacatcttccatgtacttaacacgacctaaagcatcttttagtttcatcttattcaaatcacatgttgagcaatccaaaacaccataaggttgttttaactttttagcagaaatcatgttaaacatcaaactagcatgaaaagcaatttgatattttttttgcaacaactttttagttaaaaacaactcatccaaagtgcgtgtatgcaaggccaaactacaagcaaaagaagatctatttttcaaatcatgtgcagcattaatatctctaatttttgaaatctcattcattaaaacctcacaatttgagcaatcatcatcattaggaataagagattttaatctagcaacttcagatttaagagattcaatgataaattcatgttttctacacatcttctcacacttcttttttttcactcaaaatattaatagcttcctcaaacgcacttaactcattatcttcatactctatgtcagattcaccacgcgccatgaagcaaacatcggagatgttcttccctttatcatcatctccactttcaccatctacatcacttagtggctcgaaagcggcgcaaacttattgaaaagcctttctaagattctccatcttcctcccttgagatgagcccttcgacctgttgttgttgggcatgttgttgttcgtcttctcaccatctttgtcttctcttttgcctctcccaagcttaggacaatgcgaacgaagatgatcaatagaaccacattcaaagctcctatttggaccacctcttttcctgttcctggcattattcacagctcgagcaatacggttagcaaccaaagccaaatcctcctcctcgatttgttcgagttgatcatcggatagggcattaaaagtggcaagaaaagaaggcatagatgaagaagcatcaacaaccgaagaagaagtagaagaaaccaaagcactagacttagaatcagcttttcgagaaagaacattcatctcatgtgttttcaatttggtgtaaagtgaatccaaagtcaaagtagacatattaacagactcctaaatagatataactttcatctcccaaatagacatgtcaagaccattcaaaaagtggcgagagatctcagattgaggataattagtatcataagaagaatcaacatatttaagatcactcaaaattttattaaacctagagagatagtcatccaaagcttctccaggtttcatctcaaatttaatgtactcctttttgaaaagatctcgacgaagctctttaatgttatttgttccttgatgaaaattacttaaagcaacccaaatctcatgagcagtttgaagatgcgcaacacgatcataatcagaacgagaaataccactcaaaagaatgttgcgagctttgcaattttgttcaaaagcagttttttcagcagcagtattaatagcttcaggaatcacataagcatgggaaacttttctccaaatatcataatcttcagccataatgtaagattgcatcctactacaccaatgagaaaaatccgttccatcgaaaacatgaggcttagttgaaaaacgagcgggagtagccatggcaaaaactctagatcgataaaaatccaaagaagaaaacaagactctgataccacttgtaggatcgaatgacaagaactaagccaaccagaggggggtgaatggttggtatacccaaaaaccaaaaacttttagcggaaataaaagttaccctcgaattcgacggattgcggtctgaccgaaattgccctgccggtctgaccgcctggttgccgtcggtctgaccgagattagatcttcggtctgaccaccgagatcatctgccgcttgctgttgccgccgccggtttgagcgccttgctcccgccggtcggaccgccacgatgccaccggtctaaccgccggttagttgccagttaaaccgccgaaacccggtgaagcacaaatcgaagaactcttaaagtggatgacgactttattacttctctttgtatttacaaagtgcaccaacagcactccttacaaaaatttcgactaaactcgaaaccctaactcaaaactcaactcaattgctctcaaaaacgatatcgggaagcctcacgctccccctctatttatacccaaggtaggcagcctaaagccacgaaccaaactcatactaggagtcctaaacaccttaggaaaccctctagtacaagaaagaaactttagataaccaatcgtaccaaatttggactgcttccaaattcgactccgcatcccatacgcacacaataactccatcgtatgccatatggaatctccatcaaccacgtacatcaactctagccttagtatcccgcatgatctctgaccaccacggacgtcgtcttatccccaagccgactcccggtccatcaccgcaaatactctccagagacatcgaatcacctacacatggaacaaacaaagaaaccatattccgagaccaagctatctccaacttgactcattagcagcaaacaatagtattacatacgtatagtatccatctagaagtcataattatgaaataatcatggatatccaaataaacaacccgaaactgaaaccgacacagcgtcggccggtcagacagtgggctgcgccggtctgaccgcgcaatacacgccggtccgaccggcaacccgtgcccggtctgaccggacccaaatccagcactacctgtatattcacctatgaaatccaatcatctccaaaaccacttcgtgaataaattccaaataataaaaccaataatatccaatgcccaattgttcatcacagaataataatcaaaaacatctttgattttacaagtctactaaagtgtaggtacccacgaaaagtacctcgtcagtagcttctacggggcaaacaatcggatcatacgacaccaatgcaagggtatgtgacatgtcatgaaggattgtacaagtcagcatgcatacatcgctacggatgatggtggatatgcaagttctagtgatgttgagcaagaatattctcttgctgctaaccttctatgtgaaaccaatgttcctgagatggaaattgatgatggggagattttaggagtcatcgataccgcaaactacaagaccatacttgtgctgcaagtgctaagcgttcaagtggagcatgtggaggaacttcaacaccataattcttcatcatcaaggattgtcgggtatttccctctcgggtcatgacactcttatattggaaaggtttgactcggcattgaagctgactggtgagttgaatatatggattgaaatggacaactccaagtggcatattatcttatctttctctttttttttttgctacacctctattgattactttggtcatcaaccctccttttaacactacaaccctacttttgaacagttcattgtcgacttgcaacatggacttctaaacttagatgaatccatgaataaaacataatactactaattagccttttacatcttggcttttgacactacaaggaaagacaaaacagatctaatattatgaatgatagctagaaatactagtaatttgcccgtgctaacgctatgacaatatttgttaatgcaaaccaaacaattacaaaataatatgtttttcacaatcacaatatattttccgaatcccccccctcccccgaacccgaaaaccggacatgactcaccctgaacattcaataccagacaaaaattacccccctcgacccaatccaaagattttttatcctacgtggcatacgcgtggcaacccagtcagcattttattttttaaaagatggtggggcccacctgtcatatactccctctctctccttcccctctctcactctctctctctctccctcactcggcaagcacggcaggcggcggctgcggcgtgggatgcggaggcagtggcggcggctgcagcgtgggatgggaggcggcggcggcggcgtgggatgcggcggtgtagtggacgagcggctcttgggtggggaggcggcgtctgtggtggccgcggtggcagcgaggaggaggaggacaccagcgagcgaggcagtgaggactggagggtggttgttgtggtgggcacggtaatggcggcgaggaggagcgaggagaggagagcggaggccaccgcggtaggcttcgaccaccggtgcgcgggacgcggaggcgacggcggtgcggcacgcggaggtggcggcagggcgggacgcgggacaacccgttcccctcccggc

SEQ ID NO: 32574 - DNA, 4740 bp, Oryza sativa
aagctcgccgggccacctgagaggcggctgcatcgcctcgtttaccacgctacgtgcgtcacctttgtcggtggtggtcgtggcggaactgcaaaatgggagaggcggtggggatatggctggcatctgccaccgcatcccatgctgccgccgccgccgcctcggtgtcccgcgctgctgccgcctcccatcccacgccgccggcgccgcctccacatcccatgctgccaccaccgccgccttagtgtcccacgccacctccgcatcccacgccgcaggctgcagccgccgcctgccgtgctcgccgaaagagggagagggagagagtgagagagggggagtatatgacagatgggccccaacatcttttaaaaaagaaaatgccgactgggttgccacgcgtacgccacataggataaaaccgctatggattgggtcgaggggggtaattcgtccggtgttgaaagtttagggtgagtcatgtctggttttctggttcagaggggaaattcggccgaccgcgataattcggggggtaattcatattttttcctaactagaataatagataaatttgttaaaaattgctagaaattgtttcagatattgctagataaatttgccagtattgctctaatttcagagcagtagaaattgttacacgcagtaactttgaatgattcacgagggagaatatttttctgtcacaaagttaaacacatgtacagaaagatgctaggttgatttgtatttattcaaaaagggaagaatcagtaataaaaatcctcattatcaacgaaacgaactcatataaaactcctaatctagtacagttcactatcaactccatggtgcattcaatagactgaactatcttttattttttgaatgtgacagaaccaaatcgggataacacaattctactgtgatccgagacaagctcaatgtgacagaacctagtcttgccgtggtttgtcaagggcaacatccaaagctaagaattcagcacacgaatttcttaaaccaagaacacataccacatttgggtcatggaattcttacattgaaaaggtttgactcggcattgaagctgactggtgagttgaatatatggattgaaatggacaactccaagtggcatattatcttatctttctttttttttttttttgctgtacctccgttgattactatggtcatcaagcttgctggttttacatactcaggacatggataacttttctccttcccgtaacagcatctggatgaggtccacccatgggtgttgttgacacaatgatactgctatcattcataatattagatctatttgtctttccttgtagtgtcaaaagccaagatgtaaaaggctaagttttagaagtccatatttcagctcgagagcgaactactcaaaagaaggcatcgggctgagaggccaaatctgttcatccaatatattaagatgtcaatgcgctgtttttgatctgcgcatgggattatgtctattaccgttaagcaatgaatatatattagtccaatcgttccctctcagttcgtgacgctcttacattaaaaagttctgactttgcaacgaagctgactggtgagttaaacatatggattgaaatgaacaattcctactggcatcttttctttgtcctattggcaaaacaacggcctcttttaatttcctaccatgttctgaacgaacatcctggttcctctatataagtaatttctcagaaggttagcggagcgctcttgtgcttggaagcagcgtatagccccaaaagcgagttcatcagcccttcattctacctaggaaaagaagtaactgaaattgggggttgtactcttccaaatttctgttagttctttttgtttgaattcgggagacaaatttggtactctatctgtactcttctttctttcctaatctctattcatgttgatcaaacgatttttgtgaacaaacaggtgatcgctttgctcgtaacagatgttaagaagacaaagatcaagaagaggagctagctaggtagtctgatcattgggtagaaagatttgagaaacaaatcaaggacccaggtgtgtgatccaattatctcctatatataggttaagggcaaactgaagattggacaatgtcattttaaaatgattcatgggttatatatttttcttaatatatataaaaaaccattcatcgacttttgaataaaagaaagactaatttgataactgttttgaattgcttttgtatcaacaaagtaataaactactcctagctaattatcatgcataccatctgcacatataccttgcaatatggttacaagtgaaaatcgctaagagcaagggactcaaagttcctgtgattgaatcttctaacgaactcatgatgggggtgacaactaaattaagggtagattaaaagttggattctatttcctacggggaaggaggataggtggtaccgttcatgtagtgtatggtttgttttcagattaatcgaatctaatggtttataatattggacccgccaatttaagtgaaagacaattagcatataactaagaaggtagcccgcgcaatcggccggggcatccatattattttatttgaaaaatacttctaacgggcatccatattattttatttcgaaaatacttctaacaaagtaagttgaaagtaaaatagggtatttttcatttttaattgaatgttcattgttaagttttttttccttaagaagactcgagaaacttttattgcttgtaaatttaatttttttaccatcctgctagccctctttttaattgatcaaatatacatatattatatagcgcttctttttaaggaaaagacctagccaacatgaatcgtaaaataataatatattaggaaaaaataacttttaataatattattataagaaaggctacttattttatattgccaccttagaggcttatacatgcaggttgtagagaaacccatggaagttactttaaaggatagaatttactgaattgaattataattatctgtctcttggtgtgtttaatatgacttgtatgaagataaatataaaaattttgaaagaataaaaatatcattatgatgtaaaatgagctatgtttttctataacgaagggagtatattgattcaatactatcttacgggttaagtgctccactaaaatagttttatgtgtaaaagcttcaatgctacattgcggtcttaagagtataactgtcttagaattatgtttttttttcttgctcccaatatatatatacacggtcttcaaaagtgtgtgtgttagttggtttacacggtgtgtttgtgcataatcttcaatgcgaagcctgcaatacctatacaattttatcttctttttttaaaagaattaggcattaaaacaatcatagtagtttattatgtccatcgctataagatggcctacaagcatttgtagaggtatactggaaataaaagttttactcatgatgacgtggataaatctcaaacttttttttatatcatgtgatagttttaagaagaaattgatggtcgaatgttttatttttttattttctctaattttagtgtgtcatgtggttatttagaaatatttttatgatgtttaacgtactataaagagagtatagagtaagagcttgctagatctagtcggtcgatgtctatctataaaattttttaggcccataaagaaaattataagtttaattatcaaataagaaaaaaaagaaaggaacggaggaatggtaggtttggtacagagtgagaacgccgcacagaggcatggaaagagggagaataatggtttattaatctcaatgaaaatcgacggttgaatttctctgtttttttagaactccacgtgatgaatcataagtgtttatagggtgccacgtggtggattagaagcgtatacaggaagtttaatgaaatataactatgatcatcaaagtatttaaaaacaatatgtatgtacatacataaatattgctagtagaaaacaattggtcaccatatataagtggaaattgatgttttttgttttttcttcataatttctattattttctctaatttattggagtgttacttgacggcttcggatcttatttagttgtcggttattaaaacacaactttctgtaattaaatataggtaatatggatgttatattttttatagataagatacatcatatgctttataaaattttaaatagtgaacaaccagagaaaataaagaagtgaggattgatcgcttcttttttccaaccgtaggtgcaaacttgcatacctgtatgttctttgtttattttttctgacaaatagtttttttttactcccttcgtcccaaaatataacaacttttagtcatcagaatttgtccaaaaatataacaacttctccaccaacattctctttccatccaatcacaaccctccaccattaacttttcccacctacatgcactacttatccaatcacaaccatacaccactcatttctacctactttcttaataactgtgtccaaccctgaaacttctaatattgagtatttgttttcctttagcaaatagtccataggtatttttttatccatccgtacgtttgtaggtacgtgcggggatgcttggatgtgggaaggtgggataggagagagaggtggaaaaagcaattctaatagtaataa

SEQ ID NO: 32575 - DNA, 521 bp, Oryza sativa
tgccaaaactcttggacgcttgtttaaaagtaacttaagtgtagagccctgggaggacatattgagaagtgaattgtgaaattggaacaagaggagactgacattttgccagcccttcgactgagttacgtttacctaccacgacacatgaaaagatgcttctcaatatgtgccctgtatccaaaggatcataaatttgacaaggagtttttagcagacatttgggtagcacaagggtatgtggaggctgaagatgcatcatcttgctttaatgaccttgtaaatcggtcattctttcagaaagcagctggctatagtgatatgtacgtaattcatgacttgatacatgatactgcacagctagtctccaagatgagtgcttcatcatacaacatgtgagtgacctagctaaaatcccatcaaaggttcgccatctgtcaatattcaccaagggaaatatcagctgtacagaaatagtgactatttgcacacaaaataaaaaactgcggtccctaatatgc

SEQ ID NO: 32576 - DNA, 6557 bp, Oryza sativa
  unsure (1)..(6557): unsure at all n locations
aggaagctaaaaaaaatgtaaagaaatgaaactaccatggggcccaacctgcattggttaccaacacattaattgttccccatttatcaagagcctggtagattaagtaatcataaacgagtcatagagtgaagaattgatataaaagtatatttaaaagtgcatttgtattacataaagaaactgcacttactgctttcatcatagaatccacatcggcttctttgaaacatctcccccgaaggtaatagcctgaccaccacatgcttcgatctggaaaaataacattataattatctgatggaactaaggatagtgtgggaaaccaaaagtagttttctatagtatgatttgtatatttgtaggtagatttctctccaaatttcgcttgaactgccctttttgaccacggcggtatggagaactttcaaattgatctaaaataactacatttataagtaaaagtagttaaatatggttgaatcaaccacagtagagattcatctcactgtttcttgctaattattatcattattattactatctactagttttgaaaataagttacaatgtgccaatgaaacagatgaagataggaatgcaattagattttaaattgctctgggttgacttccgaaatgtgcaattgttttggagttgcgttatcataaacgtcaagattattcagcaagatttgtaaatgataatactttaatgtattcctgtatgaggctaaaagacaggaaaatgaaaaatagaattaaggaaatccaacaatgatgagaattaaggaaaaaaaagttatccaaagcataaactgattgcctgtagtaaaactaaaatgactaacaaatagcattagatagtgaaaatgtccacacacacacacaatggttacgatttagaatcaccttagggttatccttatgttaagatttgacattaagtgacaggtaaccaagtaataccaaacaaagtctatctacaaatactaaatttgggaatcgacaagctcacctctttggagacttcttcagcctcttttgaggatcgggcatagttcaccaggacctgaaaggcagtggcaagtctccgaggttaatcttatcattacacaaaatataaggaaaaagagaaatggtcttttgcattgttgagaagccaagcgggtaggcaaaagtgtaaaattacatcacaacatgtctatccctctataagatatcaaagacaacaaattggaaagcaacacatactagaactagaaccagaattccaacacgagcagtaccgcacaacacaagtacacaaacaaatcatatcagctgttgaacaagctgttcagactttagttgtgacgctcaccttgcacccagcttttccaagagccaatgcagtcgcctttccaatccccctggaggcaccggtcacaataacaactggagcttccaactttgtagcatcttgcacaagtgcttgctcaacagctgcaacatgggtctgcacgcctgcagatagcatcgcttagcattggataccaagagtgtaggttgtttgaatgagtttgaaaaggaggataaattcaaaacacagctttcctgaagaaagctcttgaaaagaatacatttagcatatgaaaagatgtgaaaattttaaattaaaaaaaatgaccctggacacagaacaaagacacaagtctatatagatttttttaaaaaaaaaaatacataggaacatctgttatttccaaaacaaggcaataaacagtaaactccatcttgacaaataccatgcaaatgtctgtttcaatcagacttagttcacatcgaatgttcaactttatcaatgatgattacaaagtggcatctgcaggctaagcatatcatatcattgaagtgtagtgaagcacagctacttttcctatgtgctctattacagatgttactggtcctgaatttgatgatgccatatatatgttgatgatacagtagtttcagagtacctccaaaagggcatgattccaagctatcaaaaatagaaaaataactccgctgttctgtttccactttttaatacatttggatgtctattgcactgtagataattaggaccaaatattgttaatagctcaacttccactgtcaaatgacatttgacaaatactgtgggatctgtagattttgtcagaaaaaaatctttacaagtacagttcaacatttacattcttatgctgaagcatttggaatcatcatacagcttctgacaaaagattaagcttttgttgatttgttgcataattttccactaagacacaatacatataacaaagaactgacacctatggtcatcatcaattccattccatggcacgtgaataatgctagaatagattgctgcttgttgggttgctggtgcaagcaaagatacaaaagaataatattttatgaaccccaaataaaacattgtgttcttaatgcaccaattagtgtattagatatttcagtttgctgataacaggattaggcaaaccgtgtgatattggggaaaaaacaaagtgatgctgacttccctaacaaaaccagaccgcaagccacttcagctatgtaaggaactacttcccagtggactacaaagtagtttatcatcgaattaagatcccaagcacatagacaaaagaataaaatctggtctaaaacatactcttgtatttttttttagcattaccatatcctatttggcaatgaatttcatatactagagtatgttcttaagattggattgtctaaagtgaaattcattgccaaataggatatggtaatgctaaaaaaatacatgattttgaactaacagaaacataggctcatcaaacataagttgatccataaatataaggggtactcctacattttacaccaaatttaagagagctctccatttgatgtcaacttgtaaaataccagcatgaaattttaaaaatataactgaaaaataatattataccaggcggagcatatccccaaaacccacacgtttcacccagcaagtgcggatcctaggctagcacgagcagcgaagcgttcgccacggcgttcccagatctccatgcccgagctaacccagcacaacaacgactaagtccacccgccgctggagcgagacaaagagaggggtgggggaaaaaaaagggaagtgcggccttaccggagaagccgccggaccgcaccgcgcgcgagcgcgcggccgccgccgcgccgaacgagacgaaccctcgccgcgccaccgccgcgacggcggcgccgcgcggggccaccgccggggaggccactgctgctgctgcccctgcggtcgcggaggtcgccatgagtgcgcgtagagaagacgcggcggaggaggcggaggcgaggaggcggtgggccacagggagcggcgtggcgggcgcgcggggggttggtacttgtagccgcggcggcgtcggagtcggcggaggcggcggcggcggagggaagtttttttttttttcttcctgggtagctcagcgacgagagggcgaggaagggtagataaacccgtcggtgtcgttggggggcggagcgcacgaggagaggagaggagaggacgacgggaagaatactctattggagccccttcacacctactccatccctccttaaaaaaaaaacctaggtttccacatctaacattggatttggatcgtccgtcttattttaaaatattataaaaaaattaaaaagataagttattaatcatattttatcatctaacgacaataaaaatactaattataaaaaatttcatataagacggatagttaaatgttggatacgaaaactcagggtttgtctttttttacagagggagtaaaatgaagtgacagattaacacataattaataaaatattagctatgaaaactttaaaaaatgattaatatgctttcctatagcaacttttatataaactttttataaagtatgtatcgtttaactgtttaaaaattgtgcacgtgaagaacaaggatattatgagttgggaattcgcgggaaataacacagtcgagatctgcaagcgaaatgccccctgatttctcctgattttctcagcccgttttggcgggtggcggcagctggccaccctgatttgacgtgaacaaggctgatgatacagatgtatctgtattctgcttgcttttgatttcgattggatctgactccttttctcttcgtctcatccagggcatccatccagcacaatgggttttctcttctttttttcgtcagttttaaggacgaacttggtattattacggtgctgttttgaaactcatcgaagaagatgaagattaagacgacgcacctaaaacgagaaatctaatagcgtattatttagttaagttttaattattacaaactctttttttaaaaaaaggattttacattgttttctattaccacctatatcctccgtaaaaaaagacaacttctagaaatgtatatatataaaggattgtctgatgaaatatatgcttcttgcgaaaaatttctttatagcagttgctcaaaaatatcaaataaatctattttcagctttactataattaaaagccaattaaccatgcactaacgattttttttttgttttgcatgcccttccttaatcttcatccatagggccttagtaggtcatatttaaggcatttttctaaagagctaattgagtttagccactcctcatttttctgttaacatgttttttcaaacagcccttgcctgccagacgtaggccttgtttagttctcaaaatttttttttccaaaaacatcacatcgaatctttggacatatgcatggagcattaaatatagataaaaagaaaaactaattgcacagtttgaatgaaaatcgcgagacgaatcttttgagtctaattagttcatgattagccataagtgctacggtaacttacatgtgctcatgacgggttaattaggcttaataaattcgtctcgcggtttccaggcgagttatgaaattagttttttcattcgtgtccgaaaaccccttccgacatccggtcaaacgtcctatgtggcactcaaaaattttcttttcgcgaactaaacatggccataatgagacatgtttttcaaacagcccttgcatgccagacgcaatgaaattttggtcgccattatatattgccatggaagaacatgtacgagacaatgagagaaggaactccttaataatgataatatggcttggaaaataaactaacttggagattcaaaagtgttagggaacaactccaaagtgtttttattgggcatacatgtatcaacatggcaataatgagagaaaatccaagaaatatcattaacaagtgtcaaatttcaaaaaatatcattgacgagtgagagttccgtaaaatatcatcgtgcaagctattttatcttagaaatatcatcattgttagggtttcgttagtagccctccgttaagtactatatgatgaacaatacatttaatgatatgggatggatggaacactaacaatgagaatggttttttttttgggacaaaatcgcgtgtacgattgtattcttatgaaactcacactcgttgataatatttttttaattggacgcatgtcaatgttattttttttggattttctggaaaaatgaagagtccatattgcaagagcgaattgactagtagaatgatgttgagtgttctcacgcagatatcgtgcgtaatgatgtcattttgtgtgttttttctttgtgctgtttaattcatgcaaacgatcccgcgcttctagttatgcgttgattggacgattatatagcttgttggtagacgctaatagctgatgcccaacgaatttggaaccttggtttatagtaatacgataatgctcaaatgtccccactaatagatactaattgtgtactacatagcttctatatagtttaatagatatatctgagatattgtacataggtggtccacattggagtgtcaaacaaaatcggcataagttattttaaaaagaaaatcagaatgaaggataacaatacattgaattatactagtaaaacatgagaaaacaatagttttagtctgttagggagggggggggagaacaagagataatagactattcttataatataaaggtcgtaaaatatttcacccccgctagcccatttaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32577 - DNA, 461 bp, Oryza sativa
gatggaaaaattgaaagtttgaagataaattttggaactaaactcggcctacatatactacgctgctgctggtccaatacttcaagatgcgtctcatgcatgaactgtcgatgcccgtacggaagttattagatttgataagtacgtaaaacctaactgattttcttctggtgacatacacacgttggttaaatagacaagtttatcgaaatcagggctgctgctgcttctttggccagatacgttaagcaaaactcaagaccaagccgttcgttttcggtcataactgagatttgtgataattgaaaaatcaaataaaccataacaaaatttggcagcaccttcctcttttatgattgtttggcaaacaaataacataataggaaacaatatataacacactaattaccaagatggatcgtagtagtttatttttatcaggaaggcaaaaaccagccgaa

SEQ ID NO: 32578 - DNA, 473 bp, Oryza sativa
attcctgcagcccagtattttcaggaagcttaacgtcttgtgttattcttaaccagtacttgaagaaaaatactagttgtcaaggcagttgttctttgttagatacctaacattttgaccggtcactgtaaagatgtcttgtgtatattactaacattttatacttagcaaacatctgttattggtaccaaggcactctttttacttgtgtaagcatctgttattcagaagtcatctcaacctgatgctttgcacttgatcccagacatacaatcctgcggctgatctggtacttggacaatccactgaagaaactccaaagaagcctgaaggtgcttcgaagaagaggaaacatcaagagacggagcctgcaccagcagagaagaaccactaaagaggatggtgaccaagaagtgaaaagaaaaagaaaaaaagagtccaaagagagcgaggaatctcctgcggccgatgct

SEQ ID NO: 32579 - DNA, 244 bp, Oryza sativa
caggatatattccatgaaattaggagaaaatgcatgtaaaagatgtatgacggtatgaagtgtgcacctgctgcaggtactcctcgacagtagttgcttcagatggaaaaacatcctcaaatgtggtctacaaaacctcaattttaatcactatgatgtatattcaagtagtctagcaagatagagtagaaaacagaaaatatacaataagaagctgcagattcacatacagcaacagagttgt

SEQ ID NO: 32580 - DNA, 430 bp, Oryza sativa
ttcctgcagccctactcccatttatccggcttaattcttgtctgctgcaaaagattcagaactcgccggatgggaaggtgaatgaggaggtcatacgacagctaaccgagctcgccaattcagacggcggcggcgcgcagatttgggctcatcgcgaggcggcgcaggccggcgatcatcagttaccttcatggggaacaacaacacaacacaacactggacatggcaatttcggtactgcaaacagcaatgaggttgcaaccatgccgacgcctggttatgaggtttgatctacaatcttcagcatatctgactaatttgcagtgctgtttaccctatggatgtacttttgtcactgcaattgttagtcaagcgataaatggtactagaattggtttcgtagtgtccgcagaatcttcgtctgaacggt

SEQ ID NO: 32581 - DNA, 341 bp, Oryza sativa
agtcagccacagctaatgtttcaccctcacagtgcttctgcaagaacttgcgcaaacccttggtaggcttgctgtcaataatgagggttgcagcagaaagggcatcagatgtgttctcaaacttgttgaaagccttcagctcaaccacctaaatatagttgatttgttttgtcaggaaagaaaatcaactgaaaagaacaaaataaatagcagtaataggaacaaatggatagactcattgcaattcggcgtaaagtaacatgacttctgtacatgacaatgttctccacataatgtcataaactcaatgtgcacaaatttatttgtcgaatcaatctata

SEQ ID NO: 32582 - DNA, 187 bp, Oryza sativa
gcatacgtttttttttctttttttctaaaacaaagtagcaggaaaactcaaagcactgccaagcgattctacacgtctgattctgcatgtccttcgattatctcaatgcgttcatctcgtgtcgttcgactgatgatctccatgtttattctcttttggggggcgcccttggggcaatacgttttat

SEQ ID NO: 32583 - DNA, 353 bp, Oryza sativa
ctatttagtaggttatatgtaaataacaaggaaatgtatttttgaggatttacaatccactcgttggtttcggccgttttccgcggtttttctcggtgtttccgcttcacgtgggttatgagcgttgttttggtcatacgtctgctagcaggtgctagctaccgacggactgactgtcccgaggaccggaggacggcagaagaaggcgaaaaattggtatcgtgcagccgtgtgggacaatgacctataccatgtagtgttctatctaaataaatttcggcagaaatacgtgtagaacaatacccgaccggatacaggccaatgaaaaaaaatctttaagatgatacaaaagg

SEQ ID NO: 32584 - DNA, 382 bp, Oryza sativa
tcctgcagccccgacgggtgcctctccttcgccgtcgacgagctcccggttcttggcggcaagtcgccgctccaggcgtacgaggccttcttccgcagcttcgccgccgccttccatgacttcttgggctcgactgtcacggtaagcgaaatcaagaacaccttcgtctcgttctcgaagttgcagtgtttcttaatactagtttttgttggattctgtaggatgtgacggtgagcttgggtcccaatggcgagctcaagtacccttcgtatccgcctgggagcgacggcgccggcggctatggcggcgcgggcgaattccagtgctacgacaggcacatgctggcgcggctgaagcggcacgccgtggcggcggggcagcc

SEQ ID NO: 32585 - DNA, 683 bp, Oryza sativa
  unsure (1)..(683): unsure at all n locations
atgttgaatcaacctactgaagccatgggtcctggcttatttaactccataaatatgagatatcttgtgcaataacgagattattaaataaaaaaagaagaagaatattttgtcctgggagtaacgtgaaaagaaaaaacacaaacctttctcgccgagtcagacgtcgtgaactccttccataaatcctaaaaaaggatgaacacaaacgcgtagcgcaattagtccaccgaacactccacagcagcaaagcaaacgaagagctgaaaccgcggaggcggaggcggtggcggaagactcacctcgaccttgtcgagcttcccttcgtcgagcaccttgaagagggcgaaccccgcgggcgtctcgaacagcaccagcattctcttnncctttctccgcacgagaacacctacacctggatacaaacccaaatcaaaaaaaaaaaccacaagatcgaaagcttgggtcaaaccgagcagctaggatatatacaccctcaagaaaagaaaatggcgcaaaccttggctcgattggacgcgaatcgacgatggggggaggagagcgcgaggcgaaggtccggctgcggcgagatggtggggagggggagtaggcgccgccgccgccgccgccgccgcgagggtttagagcgaggtgttgtgggatgcggcgggagagggggtgcc

SEQ ID NO: 32586 - DNA, 522 bp, Oryza sativa
tgtcgtagaaaatattccacaccatgttcgcatctaccatttccatgccaagaacatggagctaaaatgggatactcattctccaagcgaaatgagggcgtgcgctgtgaggagagaggtgtgcggcgacattgtggaggatgtatcctctttgtgtctttcccaggtacttaacgctacacattaccgtgaaacttgtgtcctttcagattcctagatcgatctagctggtaagtgaggtcagcaaatatgtgtcctgtactgctagttgtcttttacgaatagatgaagtaatacgattttagccccttagaaaataaaattgttcacctcaaaacccgaatttcttatttataataaataataatccttgaattaaataaatagtaatttaattttcattttaaaaaataggttggatactgggacgaacaacgtctagtcttggatgctattacatatttcgtcccgctgtggacgttgttgtcgacggcgtccaccatatggcgggggtcagacttg

SEQ ID NO: 32587 - DNA, 468 bp, Oryza sativa
caatttccaccacctccaccaaacaagatattgggataaaaatcaaattcccattttaatctcatcatgaattccctcgtgtaaactctcaatccttttacctcaagttgccaaacaagccgttgttgttggttggagacgacgacgtccgggggagtagggtcagcgtgtcaggcgcccaacatctcgaggaaacagatcccctaactttgtgcagggctataaggcccacatgtcggtgccacaactgcaaactgcacaaagtcagcggagtctcgtccgcatctcggttggtgggtagtaccatttccgtttgtcgttttaatttcaaagtcaaacccatttagatttaatcaagtaacataaaaatagtaacaaattttaagatataatggcattaatttgatgctatatgaatgttaatgtgtttttataagtttgatcaaacttttgtataaggctgtgttt

SEQ ID NO: 32588 - DNA, 492 bp, Oryza sativa
cctgcagccctgtttcaaaatttctcccattcatccactttttgaagtatttcagacatttgatcaaagactagtagcagcgtggttttcattgggctactgcttccttctcgaaaagaacgagtggacaggataagcatgacccgaaaaaaaacagactaaaagaaaaataaaaaaaatgaatgcatacggatacgtgtgtagatgatctaatacaagatttgtcctaaaatataactacttctccaccaacatttttttcccaaccaatcacaactctccacctacctccactactcaatcaatcacaaccctccaccatttacttctaactactttcttaataaccgtatccaactcttaaaatgcttatattttgggacggatggagtagctatctattgtatatatactactcttactagttaacttaaatgcttgatgtggatattattggagctaatagcaaagctatgttattggaattgctct

SEQ ID NO: 32589 - DNA, 1138 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggccctgcag

SEQ ID NO: 32590 - DNA, 8521 bp, Oryza sativa
atactccaacagtgtgcctgctgcttgcctcaaacacgcctatggatgtgagggagctacactcacgaaaatgcaaatcctccaaggatctaagggtacttatcaagacttgcaggggaatcgatgttaacagctcgcaccgtatttccagatatgtcaggagcgtgagtccacgaaaacaactcacaaagtgatctgtggaatggccaaatttatcaagggtaacccttctaagagaaaagggtaaagccaccaaaccttgccaattgatgttagaacagttttggattttcagcacctcaaggtgataaatgttctttgactcttctgaatcacgagacgggggggggggggggggtcaaagaatgataggctctgaatgttatggcaagaaaaaacaacattttcaggcagtctggccggagccagctggggcaagattgacctaggtaagacactatttccaaatgctcaagattccaatgaggtaacaattcaatctgctcctttgtcatctgtaactgttcatcagttattccctttgtggaccattctagcaattgcttatctttatccttgttatataggaagccctttgattcaattttctttaaggaaatcagatcactgaaacctttaggatatcttttgaaaacacaacccttggcatttatagtctggacatgatataggcaactaacagatgaaggaagggtctcgaaagtagaacttcccaataaaccaaggtaacgcaaatgttttgaattgcctatgctcttaggtaactttctcactgttgaaattttaaaaatcaatacatggatactcgggagttccttgaaccaacagtcaatcacgggagcaaattgtttaatacttttgtaagattcattgcatactagggaccgcagttttttattttgtgtgcaaatagtcactaattctgtacagctgatatttccattggtgaatattgacagatggcgaacctttgaagggattttaggtaggtcactcacatgttgtatgatgaagcactcatccttggagactagctgtgcagtatcatgtatcaagtcatgaattacgtagatattattctggccagctgctttttgaaagaacgatcgatttacaaggtcattaaagcaagaggatgcatcttcagcctccacatacccttgtgctacccaaatgtctgctaaaaactccttttcaaatctatgatcctttggatacagcgcacagattgagaggcatcttttcatgtgccgtggcaggtaaacataactcagccgaagggctggcagaatgtcagtctcctcttgttccaatttccacaattcacttctcaatatgtcctcccagtgctcaatgcttaggttgcttttcaacaagcgtccaagagttttggcagccaaaggtgaacccttcaacttgggaagtatagctttacctatgcgctccaactctggacgaatgtgctccagctctgggctattgctagaactattggatctgaatgcgcatagtttgaagaaatcccagaaaacatcattttgcagtccgttgagctcatagggatcactgttgctgactaggttagctactttggaagatctagtggtgaccaaaatcatacttccctgaagaccattgcttaaagttctatgaaatattctccatcctctctcatcttttaagacatcatcccacatgtcatcaaggacgagtaaaaacttctttgcgttgacactatcacgtaaattaaccataagagtatcccttgtatcagaatgttgtgactttacaccaagagacttcagaacatcttttgttaacctgtttacctcgaattcatccgacacacatatccagattatgcagtcaaagtgtttccgcaccactccatcctcacagatttgttgtgccatggttgtcttcccgacgccccccatgccaactattggcagcacaggcaactctgtcctccttgcttcagctatagtgctgcatgccacaggcctgcttctcttgcgtccacatactcctagcttttgcttcaactccttcagttctttttcacgaccaaatatcttatctggcttgtcgaggacacgacatgtctctggtctgactaatcgatcaaacttctttggtgttttgtgaaagcctaaacccttggattggtcaaaaacctgcttaagtctattttggatttccatcactttactgaagttgacactgtccaagaactccaaaaaggtttcatgcgagtgatcttgccccaagttcttgcttgcgtccaccttcaccttgagagcatagtaattgtactcatcaaggaggtcctcggcatcatacactacatacttgatctggcgaagatgccaggcttctgtatccttgtggctatgccatttaagacgatcgattaggtcatacattgtggatgtagttgattggatcagccataggtcgttctcgagtttctgaagatcggcctcaatctggtgcagtgaagctattctgttgtctctagctgatgctgatcctacccctcgtggatccacttgcagcagatgctgctgctgctgagaacgtacggcatcccagacacgtggtgcggcccagttgaagaactcgcggaacgcattggcatcggcagcaagaccagctgctcccttcaatattccaacgatgtcgtccatagccaggttgagcactgtgcatgattataaacgcaaacaaattaagccaaaccgttaatatcacggcaaatgggatcttttacaaatatataagacacatgattgatcaggaaattctatctcaaataggcacatgattgcccagataattcaactagtctattatgtgctaaaagtctttcacttaaattggtgagtccaatattataaaccgttagattagattaatctgaaaacaaaccatacactacatgaacagtcccacctatcctcctcccctataggtgtacatacatatgtattgtaaccacgcacatctaggagtggatgtcgagctggctcggctcggctcgttatcctaacgagctagaatgctggctcagctcggctcgcttctcagctcgagctagctcgtttagctcgcgagccaatacatcgaacagatgcaaatacatattatacaaccaaaatgtccacgaaggcaattgtatctccatatcaaaccaagaaatcacatgctagctcaagtgttcaacaaatgaatcagtattcatggtagctctacctttaacaataatcttgttttctggtggcgatatacgagatcgagcacaagtgctcaacctcctggatccattgccccatgcctgcaacctcctcctgcccgaccattacaccacttgaccaagacaagaacgggagagccgtgcaggtggtcgaggcgctcgaggggtcggcggagctgccgccgatggagggagcgtgatgcaaggacgtgaggcgcagcaacaaggcggggccgtgtgtggcagaaggaaggtcgatctggattgggaattcgggatgaggggaaagaggaagatgaaaagctacactgatcaaataggttctggtctttcctttttgactgttttctttggacctaccgtgggatggattatttttctacatatgggccttggcctactaacttctctgcctatgcttctagctcgtttaagctcgtgagcagcttttatgtgtaacgagctaaaacagctgctcggcttgttgaaaaacataacaagccgagttggctatgaaccgagcgagctaactagccacgagcttttcgtccaaccctacgcacatctttttttatagtttccgtgaaatacaaatgcgtacatatgttttattttttgttagctactttgtaaagaggaaaaatgttaatgcaaaatataagtacattgtgaccatgtgatgagtaattatgtatacattgatgagatggactaggtaccacagagatttctaaaagtctgaccatttcttggacaactatctactaagctcataactcaatatcgcacctgcattaaatccaagattagtctttacaaacatgctcattatataggcaaaatttgctacaaggcattcacaaaacatgtaattagctggtggacaccgcaagaacgcaaatttgctgttgggcatcacaaaaaactgataattagctaatggacactcgtgagcttattttactatttttggaggaattggagagagaaacactcattaaagacaaatttacccctggtcaaacttgttctgtgggacctacatataagacttgtcttcttccctagatcttcctcgggttcgacgaggctagtagtgggacgatagcgaccgacagtaggcggcggcggcggagtcgagggacctgggcggcatcaaggtcgtcatgcgacgccctcgcgtctagctcctctgacccagctgagttcaagggagcccagcaatgatccggagcggcgacatagacctgatgcgtggtacgcggatccgctccgcaatgatggctcacagcctcgcactagctagcacggggcggtagtcgtcatcatcgttatcgctgttaggtttgagattcaggggcggggacaaggttagcggttggatctggccgttgtggtagagttcgccgaactcgaactccgtagttgctgtcgatgttgtcgtccatggcgttgacaaatggggtggagcagctgctgtcgatgcgtcgttctggtgccggaaagggtggccgggatgggcatgcggctgggggaaggatgacgcggatgcagcccagggagcaggtgaggctccgcggcctccgcttcctcgacaagacgtccgacgggaaggaggggtggaagtttgtcaagcgctgcttggacgagatggccgccaccccaaggagagcttcggcaagtgcattggtgagtccgcagtccgtgcttccttgctctgcgtagctaccagaacgacggtgtgatccagaaaccgtaaattcaattcccaaaaagcgattagctgttgctaacaagaacagcaaaaatatcttgggtaaatagggatgagtacttgagagaatattgtgttggagctatgcaggggtagaattgtaatctcacatcagtttctctctcgaattcttctcgaaataataaaataaggccgcaagtgtccatcagctaattacaagtttttcgtgatgttcgacaacaaattcatgttcctgcggtgtccaccagctaattacacgttttttggatgcctatagctaattttgcccattatatatgtacaaacataatccgggagtagattatgtcatcatatatattaccctttggaaacatatggaactaaattaattagctttgcaatatttaaaaataaagtttacaccattatatatttaccattgaattttgaattaataatgtaagataagtttcattttatccggtgaaactattatttcacaccattatattatctacctattaaattaaaaaaaaataatatctatattaaataatttacacttaaacaagtagagccatcttttaaactatttttttataaaaataaatttgaccatcggtttacatttaaattgatgaatacatcgtttgtatagacgatcaaatctatcttttgttaaaaaaaaaacaaagcctatgaagacctctctctgcccctctacaaaatgcacacatatgtctttgccgcctcacatacgacgaagtgtcgtatctgaggcatctatggtgatttgctaaagtgatcatgttgtagctttgccaaagtgaaggcgtatgagatcatcaatggttaacaattggttttgttaataacgtgaaaataagttgaaggtgtggtgcatagagaagaatcaagcagcgtgtgttgtgtttttgcaacatacggctctgtgtaagctgaaacaaagaggtgattacctgattataatgtactgtggtaagtctactgaatgttcatgagggcgaaaaaaatcatgttatgaatgggagtataactttaaacaatatcaatagacatcttactagtacgaggatgctacaagggagtctgattatggagttttattgcacacttcccaacttggtagaaattaattcattggacatacttttggaatacttttctacagaacttttcaacttggtagaaattaattcattcatttatactctcaaatagctataaaaaaaataagatagtacatatatttttttatacgagtcatggtgatcaatgcgtagtcaaagtcatgagataaatctccaagagctactctaattgggtaaaagaacaattgataatactctctccatccacaaaagttacaccaatttcacatttgagtttttccaaataagttattactatttgtagtctttatgcattgaagacttaaatgaagagataaattaaatgttttattagaacccaaggagtcatctaaatattcattggttgcatgcttgtattcactccttgattttgtaatatccaaggtgacttaatttctccttggtcttggtgtcaaaagtaatatgtttaacttttgtagatggagggagtacgtgtcagcatcgattgccattagacatctaatgactttctaccaacataattaatttctctctataaaataaaaattaccctctaacaataacacacacacacacacgcacatatatataacaaacacaattaaggttttaattacatgtgttaataaataacatgctttgagaaaaatattttgagccctgtatccatacacgagggaggagtaacgtggtgttgcctctgtatgtaaactaaataagtagataaagttagagtaaatatggtctatatgaccatcacaagaaataagtgagtcgggatgccattgtgcaaatagtgacaaatagttttcgagctatgtaaaagtgatggcacgatgtatcattttgtgcaaagatttctttctcttattatgagtagtgacaaagactgtgtacatccgattggatgtagaggctgggttcatcctattttctaaaaaaatgagtagtgacaaagacaccactaagaagtaaaatatgtgcttatttgcaatgaagaaaaaaacaattaggtgaccaatctttttaaagtagtcatggtatttttttactttcattaattaatcctggtagtttaaaattttttaaaaataattgaaacttaatagatagattataatttacatcacaaaactatattcttgatagagtgaagtgtacgggcggtccttaaacttgtacggacatatcatataggtccctaaactttcaaaatgcattttttccccgaacttatcatgtgtgtcatataggaccaaacagcctccaacccctccatgagatgatgtgcatgccacactaatgcttacgtgtaaatgggatccatatgtcagtaacatagaaaaaaataaaatttaaaaagagaggagagagaggattttttaattttgaaaaaataaatgaaaaatgagaggagaaaaaaatatgttcttaatgttctctacatgtgtgatatataggttctactgatacgtaggcggctaggcgctaccatagcatgccacatcaacacacgaagtgagttggagcccgttttgacctatatggcacccgagacaagttgtggagccaaaaatgtatcttgagagttcaggaatttaggtgacacacacgcacaagtttcagtaccacgaatgcactttagtcttgttgattgaagtacactacacatactaattaaatttatatattatttcaaatagatattgtttcgaagaaaatcaaacatgcaaaaaaagaaattatcttcaaacagttgatgatattttacactcccaagccaaggaatagcgtaagtaatttatatgctaacatactgaaacctttaaagttctttaaaaccatggagaaagaaagatatgaaattattgagcttctacaaaggaaacagaatccaacttttaatctacccttaatttagttgtcacccccatcatgagttcgtgagacgatgattcaatgttaagaatttgagttccttgctcttagagattttcacttgtagccatattgcatagtatatgtacggatggtatgcatgataattagttagcgatagtttattactgttaacgaattacttacttgatacaaaaacaattcaaaacatttatcaaattagtctatattttattcaaaattcgatgaatggtttttttatatatattaagaaaaacataacccatgaatcattttaaaatgacattgttcaatctttagtttgcccttaacgtatatataggagataatttctgagcaaactataatcttacatttcaacgatccatatgcccgcgcatgcatgcaggccgccttcctagttctggttaaagcaacatctaaaacaac

SEQ ID NO: 32591 - DNA, 897 bp, Oryza sativa
  unsure (1)..(897): unsure at all n locations
cctcgttggggccttcgactcgggacgatcagcgtggagagccggatgcccgcctcgacatcgagcgccggcgtaatgaccggcgtgctccccacgcgacggagggcgcctcttcgtccagagtgtcgcctcgacatggacacgaggaccagccctccgtgcccccggctggtggtgtcgcctgtagagcctttgtggcgagtcttcggaatgtccgttggcccccaaggttccgacccaccatcgttaaaagttatgcgggaacgtccacccccacgaagttcttcaggtttatacacttgggattaagccccttgggggtgatgacagggtcatggcgatnttctttccccatggccctgaaaggagataggcgcggggttggcttaatgaacttgccacccgcgtcggtccactcctgggaggatttgtgccaacagttcaccatgaactttcaaggcacatatccgcgcccaggcgaagaagcggacttgcacgcagtacagcgaggggatgatgaatcacttcgctcgtacattcagcggttttgccaagtccgaacaccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacctggaacccctccggttccggagtggcagcttctgccgcccccggatccgccgctcagacagggcagcgtgacaggaggaagaagaagaggtcggtccattccggcgacgagggtcatgtcctcgccgtctagggcgctccgcgggccacccgaaaggggaggcctgcgagcgacaa

SEQ ID NO: 32592 - DNA, 1097 bp, Oryza sativa
acgtctgggtccgatcactctgcgtcgacgacctcgtcatacaccgcgtccaaacgcgtgctggactgagcaaactctcaccaatgtgggagggtccgtatcgagtgatcggcgtcccccgcccgggctccgttcggctggccacggccgacggcacagagctgcctaacccgtggaacatcgaacaccttcgtcgcttctacccctagtgggggtcgggtatcaggtcttgggctcgggccaaccccacaccccccgggcgtgcagggttggccgggggcttatcttttttctcttccgtatttcaataaaagcattttcgatttcttaaaggctgtatctgtgctgttatttccttttgaagaatcttggcttgaaataggtcactcgtgctcaatcctaccctcgggggctcgggtcggctaaaatcgccaaacggggcccagaaccgagctgtgccccggggcgtggtgaactccggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggactatggcacagaccatcctcgtctcatacacagaacaaatgaaattgacacaaaaatttcctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgcggggattctgcccgaagagagagagagagcagggaggagaggcccccgagccgaacggcgggccaaggcccccgacggccggagctggccctccgcctgcttgtccgacggtgccaggcgcccccgaccc

SEQ ID NO: 32593 - DNA, 717 bp, Oryza sativa
tcatttggcaccatgtacagtgtcttgcttcagttaaattaggctactcaatccttgtgggactcctgttgataatccatccatccatggctgatgaacaggtatctaaattgtaataagctacagaggttccctactgttgtcgctaacatacaatacaaaggtcttttttttttcaaaaaaaaaaatacaatggccatttggttcgtgtctaacctagacatgcaaaggtttagtcatgtctagtcacactttcttagcctgatgacctgcacacttcaaaccttagggagttggtggatttttacaactcgagtgcatgcacactttgtttgcttcccacttctcaaataccaatcaaaagagttacaaaataaaaaacacttatgtaatagacatatatcttcttgcgaaatttcaagtacaattctcagtttatacaacaggcatggcaaagcgggacaacttccaagtgtaccaatatatccggttgttagtggatcatgcagaacttcacaaggaataaggaaagcaaaatggcaagatggcgataacatagaaaaagaataatataccataaactcagaacatttgagtaaataatgttgtacattaagtgtcaatacaagctagcagatatcgaacagactatatatctacacaaaaaaagcatcggtattaagttgctacatttgctttacactccaaaaacgtgac

SEQ ID NO: 32594 - DNA, 1527 bp, Oryza sativa
cctttgtgatcttggtcttgaatgttaatttcatccattcattctagtcaagacttatgagcagaggcgggacctagcctattttgtgttgcgctggatttactatgataaagaggtacggtgtccaagctcatggacttattagagccctagtgcttattcaaatgcaagtactccagtattgttcattctaaaaaaaaaatgcaagtaactacattcggaagcaacaaattgagaggaaatttgtcttgtttttcctcctacttttgttgaacggttaaacggtgttctttttcaaaatttgttataaaacagttgctttaacaaaatcatattaatatattttgaaatttaaaagaaataatgcttaattaattatcatgtgctaatgacttatctcgttttacatgtcttttcaatcttctcctaacccatagtgtcgaaacaatatttcagcaatataaaggggtagcgcacgagacttaaaagtggatggatgcggagacaaaggatttagacaggttcaggccctctcaatgagaggtgataccctactcctgtttggggatttaaatctgccgggtgtattatagatctgacgatctagttgtgtctcatgcctctagagggtctcctgcccaccttatataggatgggggggacatgattacaagatagaaatcttaaccaatacggtatcggttttctaaatctactctacaatattatcaaaccaggactttatgccattccataatatagaaggaaacgtaatacctaagacattatccgctacatattctataaatataagttagagaaaattcgatccatagcacaggaaaaaaagcggtaccaaaaaatagcacaaaaaatttccactttcgatccatagcataggccaccgatttttcttcgccctatagtacttccgtcacattttgaagtaacggtgttagatcggagtggagaaaatttttgtcggacacatttgcccttcgttccccacgttccccaccaggtctcctcttccgccccctcgtggatggcggcgtggcggccatcggcgtgcctggcgaccgccgaccgcctcgtctccccgccaccgtcgagcgagctacacacgctcttcaacgacgtgggtgcgtggctcgccgtcgccgccgacggcgaggtggaccccgtctggcactcggcgttgctgatagagggcgagcctcccgcgccggcggcagcttgacgacgaggacaacgacgatgacgtgggcggccctagcttcggcgtggatggatgtggcccgtggtggccgtactcggtgccgcagaacagcatctcccttgccacgacgccacgccgcgctggcttgccgctgcttgcacgtgacaacgacaacaacaacggggacgccggcgatgacgacaacggcgacagggacgatgacctgccgcttatgcaggcgggctgcggcgcgcgctggcggatgttgggatgattcgcgagcgggcgggcggcgggctttgtcagct

SEQ ID NO: 32595 - DNA, 2369 bp, Oryza sativa
ttttttcctgtgctatagatcgaattttctctataagttataccatataaccagtcggataactatgccgtgtgggtatagggtacccataatctccacacatagtttcaaatacacccttagaaaaagagctaatatactagctacgaacgaacaaataaacaattaacccagatttcagattgtctaccacgggacagtagtaccgcctccctgcatgtcgttcctcccccttctcacggacacgggcaaggacggtttgtaataaaaacacccgtgtcgtcccagctaattccctttcctcctcgagagcgaaccggtaaacggaagcgtctccgctgggacgacgagacgacacacgcgaattctccatgccgtctcgaggccatgttgtttcgccttttccctaataaacccaaaacggtttattagagaataaaaattaaatttacaggtaaaacttttaaatacgtgctttttttacttaaaaaccaacgaaaaaagctaggttgaaaatatctcaaaatgaatcttataattaagtttgtaatttttaattttagttttttatttggctgccattcgacgggggcttcgtacgcgccggtgttttgtcacctaaacaatgatatgtacccatcgtcgatatggctaggggacctattttcttaagctacgcccaatacagattaccgtgaaccgagtgccttgcgcattatgctacgtagaaccgcgttagtttttctggtacccaccaacttcccttagccgaagattccatccattttttttatcttcccccagaaaacaaaaaacaaaacgaaaaaaaaaagggaaaaagaaacccgtgtgacctttttgagcgtccccctgaggctgagacagacaggcacagccaaaattaaggagaagaaattccgatcgaccatggcaaaatgcatcttggaacgcaacgtacgtactttcagtttcagggcgcgtcgtcgctgttacgtttaatttcgccttgggtctctctggcgatagatcggcgccacatttctcggttaagctattagagcacgtacaatagcaggctataagtcagctataaatatattagatttgtagccagctgcagcacgaacttcaagacgtaacgtgtgtatgacaggtgggaccagatattaatagtatagcaagcaactatggtatgaattgactattacattggttatagatgatttggagctagtagtggagctatactattaaacttgctcttactacaacgtacgtgtacacggataacgcggtggcatgacatggtaagcttgtgctgttttatcgctactagctcttggtggctttcgcaggcgagcggcaaattgttgttgcggtcatgtggtggtgtcactcttgggctattgtggcctgcagctgcagctgcagggagcaaaaggcaggcatctcgtgagctgtggagtctgaagatggtcgcgcatgcatacggacgaagaagtggtacacggggaaaaagatggacgggagaggcgtcagtggcaaattggcagctgctgcatgctaaagttgctaatcctgttctagtgtggttctggttaggccagagccggcgtacggcttattattgggagacgtgatcagtccagctaatcgcacagtgacattgccgcacagggcataaccaaaccgtgtatgttgtggtcttgtggacctgtaatgtgtgcgtgggtaggagggatcgatcaaggctcttccaaatggaaactcttgcaactatttcttcagggattttgttgtatttcaggtgcttgaaaggtttgtagattttcattcaccaaaaactacacaatgtcaagcctaaaacccatggtgttaatttgtaatttaagtttatttaactacagttctaatggtatatttggtttggttttattttacccaagtttgaatattttcacatgtattttttttggaaaaaaatatgaactgtaaagtttattccatgtttgggttagaataacttatttttctaacaaaaattaactttctttaaataggtaacatgggagcaatgaggaccatgagcaattctacggtccttcaggaggtaccataaggtacaaaaaaaaattcagtgtaaaatttggtacctaatagtacatagatatcaagaggtaccaaatttacaatagaaaaaagtggtacctcatggtaccttcttaaggaccgtaaaattgctctattttgaaagagcctatttcggagaaataacaatgccgtacctaacttatttagtggaaatgtatgaaaccatatatatatatatataaatagaccccaaaactggcgcctatctcacgaaaatg

SEQ ID NO: 32596 - DNA, 213 bp, Oryza sativa
aaaaatccccatggagacgaaacgtggacaaaaatcgcagccgtcacgttcatctcctcaagaccgcggcgccaaacgggtcaaccacccacctctcttctcctcatccccatcccattcccatttctctcgcgcggcacggagcccgcgcgcgacgcgagacgcgacgcaagccatcaccaacacaaaaacatggggttcaccaccttcttg

SEQ ID NO: 32597 - DNA, 1030 bp, Oryza sativa
acctatgtgaaaacgacaagagagcccaaatcaaacctgaatcgagtacagcatgctaccaattatgtttgtgcagaccgtgctgacctgatagcaccatatatgaatgcctataactatggcaacattgaatacagtggaccttggttgatcagggggagcattcgttaagtaggcccaaacacgtcttgtcttcgtcttcgtctccggggaaggaggctcgccagtcaccactaacaacagccgggatgatcgagtcaaacgatagaaaatttattaggcaatggatataatttctgttttgtttgtgcccatttgtttgcatcttgtccaaaccatacgacgatcatcgatccctgtgggccttacaacatacagaatgtagatcgatggtcactaatcactcgacatgctaaaagcaaggaaaagctacatcacaactaaccgaaaataactcctcgtgctactgggagccctcatgcttgaaaatgtagttgcgtttcttttcagccacagtgaatatcagttcactgaaaagtttttgtaactaatcctagaaactactgtttgaccaggtttaattctgacaaagaattcgagaacacaaaaccatatgcttcgcatttggtttactgttgttaaaaaaacatgttgtattcgaaagaaactcctctgatgtaatgccctctgacatgtgggtccacgagttatgggctccatatgtcagtcccttaaagtcggaggacagtaagttagaaggtttttttccgttgtattcttgtttctgatggaggattttttttttctgaaatttcaggccagggcatacgcgagagcgatgaaggcgaccctcttgttctccagctcgacgcacaacatcaacgtgaacaagatcttcaagttcatcacggccaagctcttcaacctgccgtggacggtggagcgcaacctcaccgtcggcgagcccatcatagacttctgaagactctacacccttacactgacaaaatgctaggcaaaaaaacgtaca

SEQ ID NO: 32598 - DNA, 16442 bp, Oryza sativa
  unsure (1)..(16442): unsure at all n locations
catatagaaatncatttaggaaataatagaaattcggaattaaaaataaagaatattagaagtagagtatagagtccatatagaaatccaattaggaaataatagaaattctgaattaaaaataaggaatattagaagtagagtatagagtccatatagaaatacaattaagaaaaaaaatagaaattcagaattaaaaaataagaaatattagaagtagagtatagagtccatataggaatttcaaactaactaaaattcggaaaaaaaaaggagccttcacgttcgctctcatgatctagaaattctcacattaatcggagaaaaagaaaaagcagaatctatatagaaatacaatttagaaatagctgaaattcggaattaaaaaaaagaaatattaaaagaggagactagagtccatatagaaatacaatttagaaatagttgaaattcggaattaaaaaataaggaatattagaagtggagactagagtccatatagaaatacaattaggaaataactgaaattcgaaattaaaaataaggaatattagaagtagagtatagagtacatatagaaatacaattaggaaataactgaaattcggaattaaaaataagaaatattagaagtagagtatagagtccatatagaaatacaattaagaaaaaaaatagaaatttggaattaaaaaataaggaatattagaagtagaatatagagttcatattggaatttaaaaccaactaaaattcggaataaaaaggagctttcaggttcgctctcatggcatagaaattctcacattaatcagagaaaaagaaaaaacagagtccatatagaaatacaatttagaaatagctgaaattcagaattaaaaaataagaaatattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccggggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcgcgctgagccgtcgcgtcgccgaggaatggcctcgccgccgccctcacagttggcagcgcggaactccggtggtgcgctccgacggcggcgagggaacaatagtaaggaagggggcggcgggggctagggttcaccccctgtgccgctcgcgcgagagggcgacgcggggttgtgccggcttcgtactcttccaattgaggataagatgaactgatgtgataagtagtatgagattgtacttattttaaaacaaaatttgaatataaaatcatacttattttaggaggatgtagtatttgggacttggcagtaattttactgttcttggtattagaaggtaccatttattttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctataatttacgctggcgtccatatgcaaaaaccgccaaaaaaacataacaataggtggggggctacggaccaccagcaaaaaccaatttttgctggtaaccacgctaagagaaacgcctaaaaaaactactctatttttcgaggcgggcctcttaagtgtccgccagtttttctaggcggacctcttaggcgtccgccagcgaaaaatctcattttcactggcagtaggtaaggaggaccactgcgaaaaaagttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgatcgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacatttttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtatcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactaaagttgttggtctactgtgcttcaatatttcaatgttattaggagcttatttaagcataccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttccttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtccttaatgcatgattcgataggctacgcaatcccgtttgtagtaatgaattaaaaattatatattattatgaaccgaataaatagcttcgaacaagctaagcaatgctgatgtagaaaaaaattagtttgagaaccgtggtatattccaaagtttgtaactgtcataagctgccccccaacccacccaaaaaaaccggatggcagcaatcacaacttagcattgctgctcatggcaatgttcatatactatgagtgcgggttagttcagactacagacacgtgtggtaattgtttttttttagttttttattttgtttgttaggtggtgtttggatccagggattaaactttagtctttgttttagatactaatttagagtattaaatattgactacttacaaaactaattacataaatgagagctaattcgtgagacaaattttttagggttaattggatagatgccattataaaatctttagttttgaaatataccgttactattaaactatttagaaacatgccattacaactttttcaggtattgaaatatgtcactgtacaacctttggatgtgtttaacaaaaattttagaccaaatcgctctcgtcttctcctttgtctccaccctctcctgttcatcttctttcttccatttctttcccttttggatctggtatcttagtattcttcctccacatctcctttctcggccagcaacggcggtgttgtgctgcaccatctagtttcccttcttcccttcgctggccgcatcaccaccttctcagtttccagcctccccgaggtctactgcaacaaccaagacgcggagcatgtcgttcttgaatgtccagcacccggacgcccaaggacgtgcccctgtcggtgcagctggagtcattcgcctacagcggcttcaccatggcgtggtccacgtccaccgattacgtgctcgtcgacgagcgcgccttgtgcacagggccggtcctgagttttcaagctctaggacaaaaacttacgtggaggcccctatatatatacataaactaatatatatatttatagtcttataaacatgtaatatttaatatttgatatgataaaattatctatatataatattttaaaactttcaaagagaaataatataatcataaacacttacttggcactttcaaaagtttcttctaaaatttcaatgaaatcatccgaacattttttccgttttcttttttcgctaccggatacatattttcttgacaatatgattaatgttgtgctaaaaaataatcattaattattaagtagtacaagctaataatttttgatctataaagaggaaaaagaaagatagagaaaattaccttagacgacgactgcgaggcgcgagcagccgatcggccgatgagggcgcgccgccgggcggttggcctccaatcgacgtagtcagccagtcatgcagagccgctgcgatttgctgccgattgccgtgtttgcgttgcggtttgccgccgtttaccgtttgcaacgcgacgcgaggcgtgatcgaggcgacgggaacggagtcagatcgcttcacttttccttcgctcctcttcgtcttctgtcttcgataccatacatgattcaggactgagagcgatgctgaccctgggggcgtcgtgggccatggcccatccgccatggggccccctaaattttgggggactcgggcgtgcgcacgggctgaccccccctagggccggccctgcttgtgcatgatcctgacaaagtgactattactgtgtactcctaatctcacagcagcaagaaacgggaggaagaagatgaacaacagaacaggagagatgggggaggcaaaggaagaagacgggggcaatttggtccaaaatttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagcacgtgggacgaagacccctagtcaaaggcgtcatgtcagctaaaaccggagacattgctaccgagagagctcgtttgcacagtttgaagaaggcgtcatgtcagccaaaaccagaaatattattaccgagggacctcgtttgcacactttgaaggatggattgtatatggttttcggataaggatgaaaaacagactaagcgacaaagtaagagacctaaagtgaacttatttgagggataaagtccacttggacttccttaactataagggaataagttcacctgacgtcccttaactttaagtcgagttcgtctgaggttcctaatccacaataaaatctctacctctcaactaatcataaaccgtgcgaaaaagatcacaaaacagacggagcgatgaagtaagggacctaaagtgaactcattttgagggataaagtcacttcataactataagggaatataagttcacctgacggccctcaactttatgttgagtttgtctgaggtccctaatccgcgatagcaaaaatctctacccctcaactatcataaaccgtgcaaaaaagatcccaagacaatattgatccattttctccggttttgctgacgtggcatacggtgggacccacatgtcagcgtcctgtcttctcctcttttcttttttctttttttttcttcttggcttttctttcttctctcttctcctcttcccttcttctcctagcctgagaggccggcgggcgggcgagcaggcgacggcaggcggtggcggcggtgtgcggagcaagcaaggggtaacgggtggcgggcgagcgacggcgcctcaaagagggtgtggtgtgggcgtcgctgtgctgtggcgggcggagcggggtggcggcggtggggtgcanaggacgacgacatatggaagtgatggcggacgctgtaggggacgatggcgaggaggacgaagtagcccgggagaggatgactccgacgcgcttggggtttcaccaggagacctcgccttcaccgtcttcgtgccctcaccagagtcgttccaccgcgtcctcaggctgcggcgtcccaataacaacgttgccgatgggtgggtctcacattttccttctatttcacttacatgtgggactcacatattattttattcctattttgctaactaggatgccacgttagtgaaaccaagacatctatactgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagattgtgctgaagctgcaatgccaaagctgcaagcattactcccagcaccccatcaaggtattatttcattgtcaagactcaagctgaaaattgtcatgaatcaatcagtatctttttagatgtgttgggtgctatcttacattattattctttacagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaatactatggatggaggtgaattgaaagataggccttggtcttgtgattgttatcttagaaggtcgatactaatgtttggtcttgtggcgttagtgaaactgttttcgtagcaatgtttggtcttgtgatgttattgaactgttttcgtagcattgtattacttgttccattcttcatgcatgatttggataggttattgacaattgtttatagtaatgaattaaatattacactcctaaattattataaaccgaataaatagcttaaagcgagccaggcaatgctgatgtagaaaatttctagtttgagaaccgtggtatgcatatcccgaagttcataagctgaaaagattgcaccctaaatctaatgtattgtagttttcctgtactgaaaatgctgttggatcggacagccgtggtgattggttgcgttcattttcaagttgtagccaagttaaataaagtatagaaggatatgcaagtagcaacatcggaggagtgccatcgcagtgatcctcccaaaaagcacgaaagaaacatcttcattggaacctaagcagctctggccttttgagcccagaaaagctatccttgattcaagcacaaaccgtcatttggttatatgctttctccaaatactagcatgagtaaattgcattggcggtacacgaacttgctaggtggaagcaatctagtacataaacttataaaacgctcattttgatacacgaacttgttaggtgcatgtgaatcaaggccaaaagaaaaaacaaagctaatcttattttagtgttaattaggatactacataaacacatgtgtgagaaaaatgctaagtacatatacatttgttcaataaaaaggggttaataaggcctaaagattgtatggagaaagacacaaaaatactgagaaatagtgcaaggggtagaacaaagaataataaagcacaaatgcatgtctcatgtccacctccatatgcacatctcgtcctaatcagtgtataacttagtaaaattgattatgatgtgtcattttgaccttgtttcacatgcatcgaacaaattcatgtaccgaaacaagtcttttacaagttcgtgtagtaaagtgcatccatctggcaatttactctactagcatttgaagctaaaaggctttggccttttggagcccagaaaagctgttcttgattccagaacagatcgtcatttttggggtatatgcctcctccagaatcctaaaattctcatttcatgtaaggaaaatcgcaagtgtccaacgctgaatccatcccagagatctcagtgagcaaattgcacagcgccagttgggactattcaaggattttcagggccatgccctgtacccatcatccatcacccagcaacaaaacaagccggaccgtagtgtgtcaagcatgcactgcttctgctctccgatctaaccggtagcccccaactcattctgaaccacaccttgtgttttggaccacatcacaaaattcagaagcagcagcagcagcagcaaagggtcaagcaaaaaatctaacagctttatttaggcagatccacctctctacatcatcatagtcatagtacaagaactcgacgaattcagaagaaacattggcagctacacctagagaaagaaaaatgaaaagaaaagaagatctaatatattacaagggatccttggatatatgctcatagcattgttacatcccgagcaccgagtcgcgacttgtggcgaaaacgggtgccatttccatgcttatgccattactgcttcgcctgaaaaaatgagatgttttttttttggttagagattcagacttatgttcatgaattggctcttttgtgaaaaatgtgatttggtaaaacatgtgcggaaaatctacctgagagtagatgaaagttccgagaatcgcaatggcggctccgagggcgttgatgggctggaccggcgtgtggaagatgatgatggaggcgacaatgacggagatccgcttcatggtgttgccgatgctgaatgtcagtggtgagatctcgtccaatgacatgtaggacacttggttgtacaagtggtagaacacactctgcgccgccacccacctacaaaaccacagagaaatccatggccacatgaatcagctggattatcacacaaaaatatcatcaaatcttttgatacttcttatttctctttcagaatgaactgaagaagatattgccgcttaggaggaaatgatagtgataggacgatcctatatctatattaattgataatggttctttttgtatagaatacttgagtgatgttactgaaagtacaaagtgttgcatgctgaaactgtttgaaagcttaggtcaagcacttatcactagaaattttttgcccaattgatacccaaaaatctcaactgacgtgatggttgtgacagtgaaacggtgagaagtggtacaaagaaaagcatgtgaggctcaccagacgaagtttggaccgatctcggcgacggctttttgccagccggcagcccacaccttgggcccctccatggcgaaggcgaaagggaggaggatgaccagcgagagcatggagaggcaggcgtagtagttcatcccgctcaccgacttgcccttcatccccttcttggagaatatgttccggaacacgaatgccaggttcgagatcatcgcccccatgaatcctgcatcgaattttcagcaatacacgatgaacagattgatgtgatgtgtcaggtttatgaacaaattgtgcactttttcgtggctggtgtatatttctttatctgacataagaaaacatatctttggttaatggacagttcttgttctgaagaattcttggagataatatctatttttttaatcaaaaagtgaggatatttctggtgtatctgctgcaagtatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgaggaagaacctggagacgagcacgctgaacgccggctcgccgctcttgatgatgtgggtgaacgacaccgccaccttcgccatgctcaccgtcgccgccacgtgcccgatggtgtgcgcgatcgccacctgctcgtcccacaacgagcaaaaacgaatccccaaatccaacgaacgcgtcagagattcagaatagaacagaatcaagaaggaggagacgatggtgtccatggtcaatgcgatctcaccggagacagggccttccagaaatcgaggtcggtggcgggcgcctcggcgatcctggtggcccaggaggcgagcatgatggcggagccggcggcgagggagagcgtggacgtgagccacgggtaagggaacgcgttgagcaccttcttgttgtagatgttgaagatcacgttcagcgcccaccacgtcgcgaagtagaccccgatcttggcccgcctcgcggcttcctccggcgccgcgcccggcggtgcagcctccaccggccgggcgccgtcggcggtggcggacgtcggcggcggcgccggtgacgcgacgcgcgacgccaggaataacgggtcctgctgccggtacagggggcgcgccgagagggagagggtacgtggcccggcggcggcggcggcggcggcgaagaggggagggaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggttgcggccatagagaccgctcgcatcgagtcttcttcaatccgactataacaaattgctagctagttccacgccctccaacgcccttttagggaaggaagcctcaaaggagggagggccgccgaacaatgtggttgaggacaatccaaggaaaagggtggagacgaagagggagctggacaaaagataagtggtagaggggggaatcctacagctagaagaacatcaaccgcgtcaacagggaaggctgcaagaatagtagccattcaagccaaagaaaaccgtaggcactaacataaaagacctgacctaatccatcaatcaaggagcatgctaaaaggagatctagagagagggagaggcactagcgaatcctaattgatggatcagagccaagcatgttatggcaaggagctcgttggctagctcaagggcgcctcaaagaggagggaggaggagggatggggatggaagaaggtgttgggcaaggtcaccagtcccgcgggggagggggggtccgaggccagagcctgccaccggtgccacggattcgaccagatccagacgctaggagcgcagatctgcacgccaccagtcgggggcgccgggcctagccttcatcgccggctgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgcggcaccgcctccacacgccccatcgcgccaccgcgcacgg

SEQ ID NO: 32599 - DNA, 1198 bp, Oryza sativa
attgaacttaattaattaccttggttaggtccctggtattgcacctccttttagggctcaattccagctgtgtcaaagcactgacctgaaagatgcaaatcaaacaggcaaatcaacaccaactagctagtaatctctaatttttcttttctttatttcttttttaaaaaaaaaacaaagactctctagctttaagccttcatagcaacaaaaatatatagggaattaagctagctgtaactaccttagggctatttactggagagcttgcggtatcctccagggaatcatcatgatccagggccttgaagaccttcttcttgagcttcttcaactccttgtacctatcaggcaacgccgcagccgcgggagcgcaagacgcggcgtcggagatcatagaatcttcctctccttcctcctcctccagctccttctgatcactgcaatcgccatagacgccatctccgccatgggagcagtatgaagaagcaccatgatcttcttgactcttcttctcctcctcggacatcatgaaatccacaaagtagtcggtccaggtgctctcctccggctgagcttgagcagcagcagcagcttgctgatcttcactagtactactgcagctaattatggcactcctcatcacagatgagccactaactaaatcctccatgcttttgatgttacaagcaaaggtggtgatagctaaagctgatcaacttaatcgtacaagcttctatgcttgtgttgtacccaatgatcgaatggatgaattaatggatggctttgcaaagatgcatacagcctggctctctatatatataacaggagagagagagagaaagagaagagagaggtgtgaatctgcatgacatcaccttgagggaggagaaaaggaagattcaagtggatggggtgttaaaatcaacaaacaaggggcactggtgccggaacaataacaggttagaaaagaagctagaaatccatggctcctttgccgacgctgagtaaattttaggtgactggtggtgacaatgagtccgtgtcgagcgctgattttttcggcctttagagcgagatttatacaatacaatttggcatgagattggattgcttttagtcagcctcttatagcctaaagtctttgagtgactacatgacatatcatgtaagttgctgataggtttccagttttccc

SEQ ID NO: 32600 - DNA, 2820 bp, Oryza sativa
aattccgtaccatatgacagcttatttaattaaagcctaatgcattcgatcacagcctaactaggttttcaaagatggatatcagtactagttaagacaccatgattaattagctctcaaaaaatctttgcttgctgatcagtacttgatcgggccacggtcgacaacgtgcagaccaaaacgtgttgtgtgtatgggtaggagtgatagatttatgtccactgttttgatcttttgacacaaacttgagcctttttaatttcctatggattaagaagaagatcaatatagtttagtaacctcgctttgaaagtgtagttaattgatggtatcaaagccacttcattataataacaagtggcatgcattttgcttggtctaactagattacaagcaccggtttcagattttcagcgaactgataattaatttcaggtcatgggagcataacacagtggcccaatccccatcaacaacgtatcagctacggcattttgggtgatgaccacatgacacagggtgctataagtatgtagcctaattacctatacaagattaatcgtagagacaggatggctgacatgctgatgagcagtagagtagtactaaccacacctctaatggatgattgattggtgcccatgtgttgtggttgacaaaaacttcttctttgcatggcagcatggcaccacatctcctggttttctgcatgccctctggcaaacagacattcctctggaagaaaaggaaaagtgagaaatagaaaacaaaacctgtcccttgaatgagtactgagaaggcaaatgtacaacatttagaatctgttctggagtatggactatggaggtacaaattgcacctaaaaagagagaacatttcaatagtaaacttgaaagagatgcatgcaaacaaataagacatgaaagggatctgtcatggttgctaaaacgacttcacatagacataatttgcttattttatcggtactatatttgcaacgtttacatcgaattttaagtggcctagactgattaatattctgacttgtgactgaaacaaaagatagagcagcactgtaaagcatttagtttcttctgtagggaatagcgagttttcatctaaccgatcgagtgataaacaagtaatttgtttcttctctaaagaaacattgttggctcgttttcatctgcctgttcattgtctgaatgaaaattgatgttcagattatgtgcctcacaacttctgcacatggcttgtgttttcataatagctagaatgattatggtgttgaaagttatacctgaattcgtttttgacggcgtaaatcaaattagcacttctggggttccttttgacatttcagagccaaatcattgagtttttccctactagtatgtttgaagggctaatagaatatggcccccatataagaatccatggcacgggagcattgacttattgggacaaacatattagtgccaccgtacctgccatgacttgcttacaagacctgaaataaagatgaaaatgttcagaggtacatgaatcaagaaaacagaaatattgtatgtgcaagaacaaatgtaagggtaattagggaacaaaaatcctttgagaagactaacaggctgtacagaaaatggacgaatgtgaattgtaatgtgttatatagtactagtacttatcattatcctagtaaatagtgggaaatgtggatctcagctggtgctactaatcctcgcttccttggagattctaaggatttgattaatgatgttgtccatgttttaagctcagtggtggcaggcaaagcgcaggaaaaactccagctacagcttcatgctagcctgtctttgggacaaaaatcattggaaatgcaactattactccaactagtcaacagcaagaaaaggctccaaatattcagtgcagataattcaatataagaaagaatatgctgttcaatacaagacagaaacttagcagcatttctatgctgggaatattaatactatgggggttgacacatactaagtatgatcttagaataaaaccagagagatgtatgaagttaatggcaagccagttcataggatagcacggaataataatactatcaagtatgtcctaaattgcaaaatcattaaaaaaaatgcagcggaaaatagctttttgtacctatcagcaaaatgcagggtccagcagtaactggaatattttatgccacagctcatagatattaggtgctatctgggaacaatctaggtggaccattagagagtttagtctttaggtactacaaactagatatatagaaggtagctaatcaatgtgattgctgaggttagctgttgcagccaatttagaaacatggataattttgtatgtattatagatatactccaagttaaaagatagagatgcctgagaacaattgacatcaattgcatgtctccagaactcggaagcttcagaactaatgtacctgtcagattatcaattggcaaaaaacggagctgataatcaacttaaccatatgggcatacagggagcaaactaaagaagttaatatgcaaatactaaattccaccaaagaaacagcattgtacaatcaggtcacatggataggaaatctctagacatatagatatatccaaatttcactgcactaacagcaaacctagtataaatagtatgtcgcagtttgttgcaggaaggaacataaaggagaagcataggtccaaagtaagcaatctgggtaccattagttaacaaagattatttgcagcaacagcggtgagaagatggaatctacataac

SEQ ID NO: 32601 - DNA, 1794 bp, Oryza sativa
gtcgcgggcatcatagggaacctcgtgaccacgagaccgcatcccgcacgagcagcaatggcaccatcacctcgcacttaccaatgctgtgagttagcacgcgcgcgcgaaggcgagagagagagagagagagggcagtggcatcatccatccgatatcgccgccgcctcgttttctcgcgcgcgaacggcggcgcgggaggagaagggcggggacgcggggagccttggattggaggagagcggaagcagccaaccaacggcggacgggccgagaaactgagaaagagacgtggtgggctaagcccaggacgaagcgacttgatgggctggaaatgcgagaggttttgggctccgaacgccaatttatgggcctgttcgggactccatacaccaggccagattcggaaagctaacgcgcgcgtacgcgccgctagcgcgcgactccatttaactcgattagcgattccagaggacgtaactaactcaattagtttaggttaatgacggtaattaataaaatatttccttttctccggaattttttttactaaaaaaatctggaaatgctctttgccggtcgcccggtgcggagggagccggatcgggcactccccccgcgccccctcccccacgtgcctacttaggcccacctatttatgctcctcttttttccacaaaagatgtttcacataatgtatttacaatgtttcactatttatagatctaatgttgtagtaaattaaaatactcttttgcaaaaaaaaaaacccacatattttagaaactctctattaagggaattttgtttattttttgttccacccaaaatgtttcacctagtgtactcataatatttcactatgtatagatctaatgttacactgaacgaaacattccattgcaacaaaaaacccacatattttggaaacccctattaagagaatttggtttattttttgttccaccgaaaaatgtttcaccgagtgtactcaaaaatgtttcactatgtatagatctaatgttgcagtgaactgaaacattctttcgctatttgctgaaacattgtttttatataaggtgaaacaacacccaatttaaacgagtgaaacattttcgatctacttagtgaaacaattctgatatatctggtggaacatcttgcaacatttaaaaataattcaataataagataaaagaaaatttcgtcgaaatatatccatgcgtggtcttgttttgaagatttaattgcaatgaatttaatagtgcaatcggatcatcatttggataagtagtttaagagataaatcagtttaaagtaattttgcatgtaaatcggacgctgacgtcagcgcccgatttaccctctcctgatcggacgccgaccaggagtcatccaaaaaaatctatacgtgaaaaaaaattctcatttaaaaaaaaaaaaatttaactcaaaatttgaaaatctaaattcaattttttaatattttaaattagaaatttaaacttttaacttagatttgaaacctttcgacttaagatttgaactttgaagtcaaaatttaaaaaatttcaacttaaactttgaaaattttaaactcgaaatttaaatttgtaagacaaattttaaaaacttcaagtcagatttgaaaactttcaactcgagattgaaaactttcaagtccatatttaaaaactttcaactcaaatttaaaaactttcaaattttaaaaaaaagaatgaaaaaaatatatggaaaatacgctgaggggagggaggcaaaagggaaaaaatc

SEQ ID NO: 32602 - DNA, 868 bp, Oryza sativa
tcagctataatcctaaagaacacatccagaaaaaatgaaaaccacacgattatagaagaacaatgtaccaaccttattccatttccttgccctctcataccaatctataacactgcatcaagcaaaagataatataatcaccaataagtactacagatattgaaagttctaattactcaaaatctgatccaagattatgatgctgtgagactgataggaacactaacttagtaagcgtgcaccggctcgtgagatcgaacatgtacaagatcgccacggcgtccttacacgcgatcgggacgtggtcgaggaactggctgtctcctgcattccatcacacaacaaaaactcatcaaacaaagcaagtttaggcacaccaaaaaaaaaatctgattcttcaaccaatgcaagtataaagggggaaacaaatcctgcatttgtagttcatatgcttgtgcaaattacctgccacatcccaaatgctgaaggcaattcgagctccccgaactgccaaggtcttgtccatcagattcaggcccgtcatctgcaagccgttctgctcctcgtcgtccccaacatacttaacctgcagaatcaattacccaatagattaatttactttttactatctggattgactattctgaattcaagaagaaatgattcttgtgttcgattgctgactcgagtttcagaatttgattgcttcttggttgaaagaggaggaggagatgggagaagttaccatgaagctggtcttgccgatctggcaatcgccgagcaggctgaccttgaggctgacgacgttctcgacatcggccgcgtcgcggtcggcggcggcagcgtcgtcgtcggcgtccctggggag

SEQ ID NO: 32603 - DNA, 2942 bp, Oryza sativa
  unsure (1)..(2942): unsure at all n locations
acgattgatcagaggccatgtaacttagtaagacattagtattaattagtatattcacaattcacaaatgagtgaatgactaacacatgagttacagaacatgtcaatgctctacctttacatgcatgtctctcactttttgttcgatgtaaaataagtgttcccaaccagccgatgccactagcttatcagcatgatcagatgggctatctaccaactccttttaattacatcatggatgtacctgttaactcagttacctgatatgtagctaattagctatagctattactacccacgagtagctaattaattagcaaatgcaatgctaaaaatttagggttatcttgatgctaaaagaatttcattctaaggagataagtggataaacataaaggcagcatatatgtgcaatgaccatgcttgcagcccatgaacaagtagtggttagggagtagctttcatgaagggagaatagttaagtgcttgactgttgccaagatttgaaagctaaaggacttattaacaaaccaattaaatttttaagggctagatgacctccccctaatttggcacctttagcttgtcccttcatgcatgttaaaacattattttctttcaccatctttcgtagccttatcaatcgatcttaggagttaggtttgcaagcatgaagtcttgagagctacacctatgtatagccttttcgtttgtacgtctcatgcatggttcatcttgttactgtctgaacacttgactactgatccaaataaccaattgcccgctgtctagatcaaagaaaagaacgaattctacgtcgtcaactactgtgcgatgttaattaatctgagatttcgacattgctaataaatgaatgtgggacatcatatcgtgtacttaaaatgaaaaaaaaaaggttttgagaaatatattgacatgcaattcttttgcgcattcgcgaaaaataatgactgaaagtacatgatgttattatggcaaagtaattgctctatcctcatcacgcttggaggtccctcaataacgacatgttttttttcttttgatgtgtctattgattaacatgaattattcaagagcacgcagctgaattcaatatatagtttctggccggttatcactgtagctcattattcattcttaaaatatatagcgagaaaatacatgtagtggaaaccacatgtgtagtagtgaatcctggacgtaggataagaaaattgatgcatgcgattgttcacgtcatactaatttacttttactggtcacatatattttccctagtgtaaccgggcaaccgaacctttcaaaaaaaatttgctgggtaagttatccagcataactaaatttgtatgtttttaactgaacctgttgccccataaagatatatgaagagatcagattaattagcatcttaatctaaatgttcttctgcatttttcatcttatgagttcttatatatgaacaggaaatatattaattagcttcagaacttaaaattagtatttttagatgacagtacttcaaagttaaaattagttgataccctttcatgtgtgctaccagtttattttgatagaagccttttggtggagctccagctgcaagaattctttgcaccgcaccatcttgttcatattttagatcacgaagaatagatgcttaaatcattatattttaacctataaactccaaaatctagaggtttgaggtttgccaaacaagccctaagaatagtacattgcacttgtagatttgggccatatatgttggcctgcatgtnnnnnnnnnnnnnnnnnnnnnnnnnnnnnnnnnnnnnnnnnnnnnattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaatcgactctcagaggatccccggattatggatgccgatataggcttttattctttttttcttgcctatgccgaaccggggagggggaggttttttaagtggatcaacaaatactttttgaataaaaagtcaatgtatctaaccaatattttacaggagtatcttattcgcgaagccgatttcataatcaaaaaaagtaaaatcaaaatcatttaacttattctctcaatttcaatcgaccgctgttagtatatctaatatgaattggccatcataacacatatggatagaacttctaaaaggttctcgaaaaacacgtaatttttttgggcctgccttctttttctacgtatcactaagattcttaaccgtttgggccttccacttatctttgtaaaaatattatatctttacttccatatcaacaaaatctttttttttcacagggggggtcggaatgtctttctaacggaatccc

SEQ ID NO: 32604 - DNA, 667 bp, Oryza sativa
gagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgatgggtaccgagctcgaattcgcctatagta

SEQ ID NO: 32605 - DNA, 2262 bp, Oryza sativa
gccaaaaaaggaaatcacgtcaggaggggtgatcacgcggggcgatcaatcgcccattagaaatttcgcaaaccacacgcattgctattgcaagtctcatatttatataaggacaaaattctctatgttaaataacagaaatttatgacccctccaatttatgacacaaatttaacatacactatacactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtaacaccaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaagattcatgccatccgtactcaaaccaaaccgtatgtttcgtgcgtcctttccaaattctttaaattttctgtcgatgtttcgccactgcgaaccatcggcggggtgtctcagcatcccgtcctgttgacgtttttcagcgtgccatcgcaacattctagcattccccttgttcttgaacaaacgcttaccgtggtattataggaaaataccacatcaccttagcaggaattctcttctttgttagctgcccgtcaacttcttttggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgtaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctcgatttgtatgtaatcaccaaaataaattcaatagaaattttggcatgacctcacctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttgg

SEQ ID NO: 32606 - DNA, 3928 bp, Oryza sativa
  unsure (1)..(3928): unsure at all n locations
agcaaatttgctgctccaaggaagaaaaccaccagcataggtggctccaagtagattgttcagatcattcacggactctctgtacatataggaaagaattcaaatgatcagctaagaggcaatagagttgtgtcactgtgaaactacattcagtgaaatggttgcaataagaataggcgaatgggtagaatttgaatataaattagaacaagaagaaggaacatacatattctttcccctccgccaaaagacagtaccaaacacaagaccatagagaagcgtcataacataacgcatagcattgtagggtggatccttccaataagattgaaattgcttccatgtatttgccacacactgatttaggaaattctgggaatatttggtaggaaatgagagatcctggaagcctggaggtggaacactcagctgcttaataagttcttgattgctcctgaacacattgacggaaataatgtaagagctatagaaaagatacttattttgtctgtttgaccattggaagaaattaatcacaactgtcaaagcaacaaaaattgtactactaaatatttgaataatattgcgcacatatttaccggtaaagtgcagaattggcataaacttcagcaaagtctatgtccagacgagcctcagctagagaagagctaacttcaagcatccatgttgctgggttatatccttctgtgatttttgggacccctggaattgcctgcaggagaacgatatacattagaagcaagtagcctttctttctttcttatttagtctcggattgaatacggttacccaagttctcttaattccatgcatgttccccatgctcttttaataaacatttgttctaggcattgagatagtctccactaaacatttgaacgttacttttctaattatatgttagcaaataaaaaaacacaacggtatataaatactgtcgatgagaaatacactaatattgttttccgtgcgatagatccaagcacttatattggtattcaagttttattaattattgctcaaaacaatagattacaggttacacatattctgaaatagcatttgtaaaaagagggactacagaattgtatatcttttagttttacaattacaaattacttttatctgagatattagtttttgaggtggtatagttgccctttgcctcaatgtcattaaaaagagtttgttgcacaattgtacaagcagttttgaagaatcaaccttagtactatagaaaaaatatttatgagttccaacaataatgtgttctactccctccattattttttacttctgcattcagagtctccaatgcacatgtttgatagttgcattttgtaatcatataaaaatcattaaaaagatgtaactatatgaaagtagttctcgtgaaaagtctatttgcatatgctattgatttaagatggaaggttttaactgcacatgttctaaaatgatacagtcatggacaatgaaatttatgcctgaacatttgtgcatcactagaaagggcctaaacgaccttcaatagttgatagattaccaactagtattcatacattcactaattaaaaaaaatgcatgtcttcgggctactaattccatccaagtttgcccaatggaatttcatgggtcacaatagatgagaagtattaactgattttagcaatacagatgggtaacatattgcaaattggttatcatagagactgaaatatagtatcaaagacagttcacctcgaaatattcgactagtatttgtgaatggagaccaagctggccagcatatataacccgtcctccctcttttagcaacagaagctgaaaaaacacaatccatttttcagtataaccttacagcgctgaaaggagaactaacggacaaacaaacaagagcaaagtagcaaggacctcatcaaaagactcaaagatatcaatgctaggttgatggattgtgcaaaccacagttcgtcatgtgttaactgtatttctcacagtacgcataacaattgctgcagctctagcatcaagacctgaagttggttcatccatgaagataattgaaggatttgccactagttctactgcgattgtcagcctcttcctttgttcagttgacaacccactaacaccagggagaccaaccagagcatcacgcaatacatcaagctcaactagtgacatcacttcctccacaaacacctacacagtggaattaatttcatcagaaataattagtattttcaacttcacaagataaaaaaatgttgcatctattcttcaatatcatgattgtcaaaaatgccttgtatatgtatactccttaaaagtctctattggtggtggcaccccaccgctgtttacagtttttacaaattggcccctgatattttctgatatttggaaatagtctacatatttggttgaaacaagtgaatactaacatattcaataaatatttttatctattacatatgataatatattttattttatccatagcaaagcagagtcattttgttgttactcataaaaaatggcaaatgacagtttagtgtgctgtcaggttcctaggaactcaacgaataagtgtgtcttgcatgtggacgagattcgggtaatatacaagcctacacaatcgtgtggcctcttttggtaggtgtaatatataattagtgaccaataagtggattaaattaatggacagtacacacaatcaactacaattaacacgattttctgatttccccccaagaaacatcatgagttattgagtttactaaatggcatccaccacaaaaataataggaacacataccttcctggtgttcttatcaacttctgaggaaaggcgcagccaagcagaataaacaatggattcatatacagtaagatttggtgaatgtatatcagtttgttcacaatagccactgatgcgagcaaaggtttcttgttttttagggtaaccagaaagcttgatatctccctcaatcgttccactagtctttcttcctgccagtacatccattagagtggtttttccagctccactgacaccaactagtgctgttagaacacctggtcggaatgcaccactaatatcagatagtagttggaggcggctttctgtgaatccttgtgctttcatttcctacaaggtagaatttaaattttcaagttcatacttgaaatgcaccccttgattcaagattaaatcactactaacttagttcaataaatggttaatgaatgacaactagtaatttatcagctagataaaatacacatatttaatccttaacaaagttaaatatctaagtgcaacaggggacacaagagaaccccgtgccatcacaatcactatgtacagtatgataccaatccaatgatataataaggaaaacagtcagacaatctagattatatgataaaggacattgttaatttcaacaaggtatagctactacatatttctgtagaccaatagaactaagtaaagcaagtagaattacaaactttctatgttgaattgcaaaaagaaatcactgcaagaactagtagtaatctataagaagaataaagtgaaattaattccaatattgaggtatgttttgtcccgtaagctttgcaaacttcctatgttgaattgcaaaaagaaatcactgcaagaactagtagtaatctataagaagaataaagtgaaattaattacgatattgaggtatgttttgtcccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32607 - DNA, 1780 bp, Oryza sativa
attctcagtgagtgagacattttaattttaggattaggatgccgctattagcgacatagtacataaattttagaacaaacacaaacatcctttttaattctaacatatttaaccttacaaactagcttagtcacactctttattagaaatccttttaaatttaaatttatgaatattacacatatttaagtgggctttcaatagaaatctcaataggaatctagtgagataagggatgcaccgcttgtttgcttctctttagcttgtgttagggccaggcgcatttgtgggtatatgagtgtagtgttgtgcatatgcacatttgctgtgtaataaaaaaaatctttttaaccgctaaaaaaaagaaaaaaatctttttaaatttgattttgatttcatgccgtttcctttgatccaaagatgctatagctagcatttggggtatatattttccgcatattccagtgaactgtcaccgattacctgaagaaaccattagttttaggatttactcagtctcttacaatggacataaaaaaggttgcttcttctgttgcctcgtagcgacggtgggatcatcactgtaatctgttcgatgctatctgccagacaaggtgagtatagttagcacgatgattacaccctcagatcagaaaactaatcaggctagcaattaagacgcatccttcctgatagagccgatcgatcgatctgtttggccagttaaactatgctctatgcagaagccaaactgtacaactgtcatgtccagacaaaccggaccagaagagagagagagagagaaatgaaaaaaatttgtgccggcaggtgaatcttgtactgggttccggttgtcgatgcaaatgtgctgtggatctgatctgatctgctctgataagtactacctgtcccaaaataagtgcagtttaacactattcacgtttaacgtttgaccgtccgttttatttgaaaaatttgtgaaaaaattaaaaacatttagtcacacataaagtattattcatgttttatcatctaatagcgataaaaatactaatcataaaaatttttcaaataagacggacggtcaaacgttgaacatgaatagtgcaaaactgcacttattttgggacggaggaagtatgtaaaagttgatttaaaacatcatataaatctattttcaagtttgaaacaattagtataacttaattaatcatcactaatgattttctcattttgcgttcctgtactcaatcttcaccagttgatatgtcgaaaggggccttagaggaaaaagaaggtgattttaaggtgtattaaggattttaaaattaacattagatttaattctaagtttttttaaggttttttttaccttagtttatttttgtaatatttgtttttaaattgctaataatgtatatgtaaaagctttttttaattgtttttaagttcttggtaaaccgttatggtttgtgatcggcgtaagcggaaggacgaatgtggaaactggaaatgttgatctctcgaacttttctccacttgttcagcgatctgggatcctaaaaatgggcacatgtcctcaaatggtttctgcacaaaattgctaggagaatttctcatgattgcatcctagttttatttcgagtccacgttttctttaagtacctacatttggtaatcacatatttcgtttggtcgttggggagattttggcattcgtttttggtagggatagccgaaagcacgttagcagctttaccaaatatgtttggattttggc

SEQ ID NO: 32608 - DNA, 885 bp, Oryza sativa
gatggcaattggcaagcgctaagacaaatccgttgattttttttaatccgatggacaggcggcaagatgattaattagcatgtttgtttgtgtcttcgatgatatctttccctattcaatttttgttgttgcagggtaccccgcgctcgccgtttcatccggtgagcatttcgtcgagcagttggtacgcggggggagttccgggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcttgggacaaagttgagcgttataacgcaggataccaattgcagtggctttcttggaaccatggaaggttagggcttccttcttttccatcaatttttcttttatggaattgtcctaaccaatttagttgtaatttacacattattctctcgctttcagtgtgcatttgcaattagcatatttcccttttatcctctgag

SEQ ID NO: 32609 - DNA, 547 bp, Oryza sativa
tgactcttctctcttttttttcacttcttcaagattcaaaagttatggtttattggtttataatttaatttggttagagtttggtaccatttcaggtttagtttttctaccatgtttttcgcgcacagtaagtgtaaacatgaaactagccaaaagttttttttgggatctcatagtccagattcatatccttctatcggttgttttacacaggagagaacacagttagtgcacttggtagatttgtgcggcttgtcgggctgtttgttgtgctcattataaactcaagctacacggcaagcttgacatcacttcttacagttcaggaactcacatcagggatacaggggctcgatagcttgatatcgagtccaagttcaattgggtatcaagttggatcttttgcgagaagctaccttgtacaggagctcaatattgccgagacccgatgggtaccactaaacagcccgtcagattatgcaagagcgctagagttaggatcaggaaatggtggtgttgatgcaataattgatgaacttccatacgt

SEQ ID NO: 32610 - DNA, 2139 bp, Oryza sativa
ccgggactaaagatcccgggggggcttgacaggtcctgacagcattcgaaccgggactaaagatgatctttagtcccggtttgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaagatattgtatgaagaaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtgtgggctgtcccatcagaaggtcattcagacggcaaccatacaaatctccgtccatttatgaaaagataggataagtccccacacaaaagagagagaggggtgcatgtggtatccccttgaaatataaaaggaggaccttgcccatagggagagcaggcttgggttgggactggaccttcccagatcgggaacccagaaggagggagaggctggctgatactttgtagctccttcatacacagatccaccaaaacacaggagtagggtattacgcttctcagcgggcccgaacctgtatacatcgctggtgtttcatgctctttcgagaggtcgcgatctttccacatatagacagagcttgggatttcaccctgagcccccggccgacccggcataggggggcctgtgcggtctcccggtgaggagcccccacactccgtcacggttggtaacacaaaccgggactaaagatcaaatatgcccgttacccttttgaaccgggactaaagatcatctttagccctggtttttattgcatccgggactattgtggaaatcggccgaccgacgaaagatggtttctccaccagtgatacatgccgatgtactagcaacgatataaatttaacatacactataaattgttgcattgcgtttgtatatcataaccagacaacacagagaggcagggggacgtagttttttgtatggctgcgaatcagttttgatatatattactatctcatataattatttgatggttggaacaatataaatggcttatgtttatatatagacaagattatcttacgattcgcacagttttttatagggagtaattttcacgcctcgtgtttttatatatggataaaaaaatactatatgaattggaaagggcatatttacggtgactctaatttacaggttaagtcatagacttatgagcattcgtatttacggctatttatccttttagtagtaagacggcgtatttgtcaacaacgagatgtccatataacttcgtcaactagtctagtttttttaatatgcttataaagatatggtgtgtgtatatgttcatatcggtaagtgtttgcgttgtactgtgtaattctaaaaaaaagtgagctaggtagcgttacgagtatattgttgggaaaattgatctctcggtttgaaagatcacgctagaccgttttccacccgttgtctacgcaaaatcagagcgatccaatctgttaattcccgattaactatgcgccgtgatcggtggcacccaatttatttctattgagtcgcccccgattccccacagtgctaaatataaaaggggaggccggcccaacagtagatgacaatctctctcggtctcaatctaaacccaatcaacattggcg

SEQ ID NO: 32611 - DNA, 716 bp, Oryza sativa
tactatatggccaattcgagctcggtacccatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacatttagggaatttaacctttttgggttttttaaaaaatttgggggggtttttttggggaaaattttcccaaaaaaaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactc

SEQ ID NO: 32612 - DNA, 523 bp, Oryza sativa
tcggtacccatcctggacttgaaccagagacctcgcccgtgaagtaaatcatcgcccctaccatccaaccaatttttatataatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaaaatcctttttcaaacctgctctgctcccatttcgagtcaagagatagataaatagccacatcccattgcactgatcgagggcgctcgtagtgacttaaggagtccaaaaccaagaagtggcttatttataccaagcattcctcttatggctagatccaacctcctggtccctgcggaaaagaaaaagaatttcacgttcttcctttcaagaagggaggattaaggaagtcctattgattgctgctttct

SEQ ID NO: 32613 - DNA, 77 bp, Oryza sativa
gtttccagttgttgttcccctcccaagggcaggttcttaagcgttactcacccgttggccaatggaaacaccacttc

SEQ ID NO: 32614 - DNA, 1089 bp, Oryza sativa
ctcacgttgtcagaaaccttctcaataaggtcattgtagctgggattcttcaaaccatctccaaataaaataaaatcgaatgaaacggggtagggcaacaagcctactgcagctttgaaaacatcaactgaaaacccctttactccatcaggtcctttatctggcatcacaaactctttgtagctcgtgcggagaggaaccccaatcctcaacggcttcccgtgatatggaaacacccagccacgaggtttctcagacgtctgaccaggccagataacaccatgaagctctatattgtttgttgaagagtccagtggttctgaatgcaacttttctggagcaacaactgaaagatcagaaatgtttgaccaatacccaatggttctgaaacctgtaccaccaatattcaagatatcaaaagctgggtggatcagatctcgttctgcagtaaattgtaccaggccagaaacccctgtgaaatttgtgtgccaaactttctccagtaatctttctccattgttcaaacttctgagggaatctaactgaaggttacttccttttatatcttgcaaatttggatcagcagaaaaagataccgcattcccctcactcaaaaaatcttcaacagcacgagcaactaaccatacagaatcataagtacgcatactgtaagaactaaagcttgaatgacctccattcctggtcagattgttccatcttgaaaccaacgaatgctgaatgcagaatcagaaacatgttgccgaagcataataaccccctgagtaagttccattctgtcagtgctaatatgatcagatgaatctaacactgcaaagagccagtctgttgctatccatgcatagccaggactcatcattcccaaagattttgcagcagcaaaaactgcctggccagagtcagggtttacatggacaacatagacgcgagactgcatttcattcacatgcatcaacatatccccgagggtagtccctgaagcaccaggtggcaatttggctttgtaggctatcttaaacttttttttgctagagcatcacctaatgctgtgatgccacctctaccataggc

SEQ ID NO: 32615 - DNA, 6471 bp, Oryza sativa
cttacatgggtaattttaaaacttatattgtaaatatactaaaattacatttgtaactaccacgtaactacattgtaattatagtgtaattacatttataactaccatgtaactaccacgtaactatagtgtaattacatttgtaactaccacgtaactacaatttagctacatagtaattacatttgtaactacgatgtaagtaccacgtaactatagtgtaattacatttgtaactttaacatgatatatattttactaatagactggtgcattatgaaatattttgcaacccatatgtgtattattgggttcgttcatatggaggtccattagatagttactatagttgtttattaatatacgttggattctaatctaatgatcgataaatccgtgtgatatgggctgtgaaatctgtcgaaagacagctagctagtcccatctctagcactacgaaatactttccccactacaattacaataatggataataatatatatctccgtctaaaaaaagataaaccctggtttccgtgccaaacacttgaccgtccgtcttatttggaaaaattatgaaaaaaatttaaaaagacaagtcacgcataaaatattaaacatgttttatcatctaacataaataaaaatacgaattataaaaaaatttcatacagtcaaagttgtacacgaaaaatggagtacttccgtactactccctccgtcccataatataaggaattttaagtttttaattgcagcgtttgaccactcgttttattcaattttttttttgcaaatataaaaaacgaaaagttgtgcttaaaataatgtagataataaagtaagtcataaataaaataaataataattttaaaaaaatttaaataaaacgagtggtcaaacgttacaaataaaaactcaaaatccctattatgagaaggagggagtaatataaaaatgagttgcacgggaatccctaacgagcgactggtcgcgcgaccagtccgctcctactacagctgctgctactgctcttctactagtagtactactactcctactcctgctgctgctgctactctgctcctgctactgctactggcgcgcgctgctgctgctgctactacagtagtagtactactacaacaatactactacgatgtgtatagtgtgtatatacgtatgtatatactttatatacactttgtatacacatatatataaactttatattaataaaatacaaagtttatatatgtgtatacaaagtatatatatacgtatataaaaaaattatgtgtactaaaaaaatactttacatacgcgtatacaaactttgcatacgaatatataaactttacatacacgtatacaaactttgtatgtatatattaaaaaccgagaaaaaaacacgaatacatactttgtatgtgtacaaatacaaaatttagtatacatacgaatataaactttgcatatgtacatcttaagaaaaccggaaaaggaagagaaaaaaaccggaaaaccaaaacacaaaacagaaagagaaccgaaaaaagggaagagaaacaaaaaaaaaccaaaacagaaagagaacccaaaaaaacggaagagaaacaaaaaaaaccaaaacagaaaaaccgaaaaaaaaagactcacgcgcgggcgccgttcgccgcctccttcgcgtgcgacacgtgtccagttgtgcaggggagggcgcgcgcgactggtcgccgattagctttttcgaagttgcacccctccaatcctaaaggtgaaatcaccccatctcatctcattcgtccatctgccatcacatctaatctcatcaggtccgggcgccctagtggttcgagaattttttttaaaagtaatatgattttaatggaaaatcgcaaaactataggtcagttaggcgaaatcgcaagtttagcaccctatcgaacaaccgtggttcgacaaggtacctatcgaacaaccacagttcgataggggtacctgtcgaactgcggtagttcgacaggtgattaaaataattaaaaaaaagagaaaaatcactgttgcacactgttcacaataccctatcgaactaaggcagttcgatatgtgcctgcgagcactgtagcatcactgtagcacgctgttcacgcaaccctatcgaactttggctgttcgatatgtccctgactagcattgtagtgatactgttcatgtaattttttatttgtttttggaccacctaccctgtcgaactcacgtagttcgacatgtacctgtcgaactgtggttgttcgataggtatccctgtcgaaccgcggttgttcgacagggtgctaaacttgcgattttgcctaactgacctatagttttgcgattttccattaaaatcatattgcttttaaaaaaaattcgtggttcgacgaccctatcctccccaccgctcgcactcctgtcgcgatgactccgcctttgcccccgcgcgctgcgatgactccgcctcctcccgtccccacgcgatgactacgcccccaagcgctactcgctccctcctcccatccccgcgctacacctcgctccgcgcttcctcgcttcttcccgtcgtcgcgaccatggtctgcccccaccggcaccggggtggttccccctttccactggagccctgcctggactaccccgacggcgccggggtggtatgccctttccctggactagctgcggcacacgccattctggtctgcgactctcctcctctgaagtcactttgatccccttcacaagcctgagcaacccatgtgaaggacgacgcctccggctacatcgcctccaagccgtcgactgcggccggtatactggaggtgatgaggagaccagaggataggtttgtggtgatttcttcccaggtgaaaaagaagaatcccctttatatatactccattaggtttggtttgcttccattactggcgcaccgagacatgatattttgattttctcaagcacctacttttggttcgactggatgaggcaattagccaaacaatagcagtggtagggatgcaagccatgatagccatggaggcaagcctatacctctctgtctcttttatatcattatatatttgtctgatagagtgtacgttagattcatctacaactcgcacatagggggaatcatttgatctccgtgttgataattttgttttatttgactctattgttgagatgtattaggccatggtaggattattgtatataaaatatgtagtaatccatggtcaactctaggtccgcaacttatttttatgcgtgacaaacacaggaatttctctggcttttctgatccgaatatcttaaggatatcaaggcatgaaactttatctcgataaatttcttggttggtgtgtatgttagtaatcatcgtactttacatgtgaaagtaccaacattcaggttcgttcaaaataagaaaatgctaatttcaccatgaatcagaaaattaatgtttggtatttgtttgttaatggctatgtaggtttagtggactaatggtatttctattagaattattcagaagagtaaatttcttggtggtaaattcaggctaattgcaatgtactgctttctaacctctaataataatttttcccagttccgcctcaactgttgcatatttacttacttagcttcttatcctgaatggatgttttggtttttagggagcagcatttgatcctcctacaattggatcttcaaaaacaattgttaggagagtacatacccagacctttctcagctttgtaatggtctaaatactaaatttgttgttttttggttcctctgtttcatattgcaggctatttcattgctgcagcccactactcttctagctctgccgacaaccacacctacaagagctacaactgaagcatcacatagggcagatgaggcatcacatgtctggcttggattcaatttgatgttgcactttgtataactatatgcagtttcagtttcatcttctgtttctaccaccttgcaatgtgagtaaatcaatgttatattaacttgaaccgaaattttgatgttacagaaattaaataaatctcatctactataaagatttttagtggccatgtttaatgaaatcatgaggtaagtacatattcatgtttttttagaaaactagagcttcacatagacagatacctaatttgttgtcactggtaagcatgttgtcgttagaggattttacagttttctgaagtttgtaattaattcggttcctttttaatgggtttctcattgaaatcgagagggaaagaaccaaacaagcaaacaattgaaattaaaagtaagcttgttttctgcttcacttcatcttttatatttctatggtaaaatccagccatgtagataagtaagaaaacatatatatgaacatgtattttctatttctacagttgacctaaaaagtaagcttcttttctatttatacagtaaaatttggcaatgacagatcatgaagataacatatgaatatgccatttcgtaccaaaatttggatataatctggaaccggcgattcacatggctgtatagcaaatcactgttttataacaaatccaatatgaactaacttccaacagtgggaatacttacagaggagaatagagaagtgatgccttgtactagaattgtcaaacaataatagccggcaacgatttaagtgtaaacttcttaatagtcatggcatttcagctacagtagggaatatttagacacaggcattggctatttaattatcttttggccttgatttggcatattgatgagaattctttattttgttttatggtggcactcttgaatcattatgtatagatattgagcttgcatatacagggactaggaggattctacattatagggaaccatctttgccaggtgttcaacaagtttagtgataggaccctatatggcttacatatattcaaagacattatagtgaaccatctttggatagggcttcgcgtgaagtttgtgtcatatggtgtactgatgcacaagagtgtcttgcatttgcaattctataccataatcgtgctccacgacatagccgttcattctgattactttcaatggataatgtacgaagccctacaatgcaaaattgtgccacgacaggtactattattttttgtctgacatttgatttgtttgctacctttattttacttgcagaaaatttttattggcctatagaaatactcaactgtagtgtgtgtattaaaaagtgattttacgagacttgttgctgggcagctgactctcatttttcatttctgaccataccctcttcatgccttacttgctgctctttattttgttgggttaggactactgcttgacgttcctaatatgactgccacttatctatatcttttgttgtctaaaaattgataaccttttgaaggctaagaaagagctcaatacatctgtgttttcattccactgaatgatgctattctataagacagttatggtctctaactggctccctgattttaacagttaaaccctctcgataggtattccaaatctctctgtacatatcgagtatatgattatagcgctaccaaatattggcccatccccatcatcacttgatcaggcagaagctagctgtcgagctctccataagggtacaaatctaatatatcctgttgatcatgtatttgcctcagattgaacctttcagtaggtgtagaagttagagtaccattgaccacatgtcatgttttttactgttttttcgtttgtattgtatagattatgcgaattgaaagcagatgcagaatgttttacataggtaactatgtgctttgctattaatatggtctgtcagtctgaagattaaatcaattgagatggatcaactaatggccttgttgcctgtttttaagttgtatattacacggacatggatggtttcagttcaacacagaagtaattgataaatggagcttcgatttttctattataaacagtgcatgtcatggcttcttttttctgttgatgtacttttggctttagtaaaacctgcacctattgactgatggtaatttgatatctgcaataactgcatcttgccgttccagaaaattgtgccaaactaggtctctgtagctttctcttggcccatgtttgcctctttttgttgacgttacgtcgcagttattatatgaattggttgattgagtaaagattttttttagataatgattgagtaaagatgttatatacttttaatggtttgttattcagcacagatagttgtatatttttattgccttaagagggaataccaatagatagaaattgcagcaaagagtccttgcaaagatatggctcttactagatgataggtatgtcttatggtgggctgttgttttcagatgttacaatttgcat

SEQ ID NO: 32616 - DNA, 33472 bp, Oryza sativa
  unsure (1)..(33472): unsure at all n locations
nnnnnnnnnnnnnnnnnnnnnnnnnnnnnnnnnnnnnnnnnnnagtaggattttgttggaggcagggacaaatttgttgacaacgttcattgatccatagtaaaaccaaccgaatgcaataccttggggatgagtgccattagccaataaatctgcggtgttctgctaacataacctttagcatgtggtttatgtaattttcttgtttatgtgttatttctcttgattgggtaatatagttgtaactttacttttcttgtttcttggtatagattgttgataagcttcattgctacgtggaacctggtgacacggtatgtattttttagtacaagaatcacatgtttattcattggtagattacatcctccatatgatgagtgtaatacaataaaatggctgtggcctaataagctaccagtagtgcctgcacttctatagtagtagtgatctgtctaatttggcaggttatcttagttggtgctctttaaggaatgattagagcttttatccatatcaatattcaattttgatacgtttgtatctggtatcatatgataattgtacacctttatattgatataaatatttgagtatggctcacctttactgttctcataaaaatcgagctgggttatctctgagttcttctgttgggtctttcgaatggtgtatggatggttgtccccaaataggtccctgtgctttcagcctgccactgtaagctggtgtcccgtgcaaaagaaacttgttccttgcagcttttaatagaagctggaccatatggtctttggtctgaaaatattgttctaattaaaaaaaaattatcccttgactgaaacagatatataacattactagtccaatgctgtgttttacaccagtccttgatcattttaaatttaattaactgtagatagtggacttctgctgtggtgcaaatgatttcagccgattgatgaaagaaaaacttgacaaagtccagaagaagtgtcatttcaagaattatgatcttatccagccgcaggtaaaatggaggccatcaatcatttttcattcaattttccttctggggaaaaaaaatctgagttttatgatcctttggaatgccattgctttcttttatattaaatagaactcctcaatgcaaatgcgttagaactcagccagttccaaactctattatcatagccagaaagtgaagtctattagcatttaacaggtcatcatgcacattctgataagcatgcattgtgtatgtgttttgcagaattgcttcgccttcgaaaggaaagattggatgactgtacggccaaaagaattgcctcatggatccaaactagtatgtttaatttggacattatttaactcaaatttgctaatttaaaataattataacatctgattgcttcttgattagataatggggcttaatcctccttttggagtcaaagcatctcttgcgaacaaatttattgacaaggcattgacctttaagcctaagctcgttatattgattgtcccaaaggaaacaaaaaggtaaccaacacgtacccattccttagaaaattgagttgaacttgtcttactaacacatggcaaaatatcaggtgaagatctaaagtatttaatgtgaagcatctgatcgcctgggccaaattggggctgattggattttaactatgttttttttaaaaaaaatagatttcacctgatattgctttcacataatgacataatatcacttattttggtgtaacgtatgttccttacttccatatctgtctccactctttggccatcaggttggatcaaaagaagacaccttatgatttgatttgggaggatagtgattgtctttcgggaaaggtaaagaccgtcaggaaaatttattgaagtttaaacttcccctttttatcatatacccgttcttcctaacatttttcttgtaatttaggcattttatttgcctggttctgttgatgttaatgataaagtagttgaagggtggaatgcctctgcaccacctctccatttatggagccatcctgattggacaaggaagcacaggaaagtagctgaggagcataaccacactagcatagggaggatcgcttcccatgttgaagaagataatctatcagataacctccctatgatgaaagaaactgaatcttatggtatacataactctagatcagggaaagaggagaatgcaggacaaacttcatgcaatctcaaagggaccaatctatcagatctccctgtgaggagacaggctgaagctggcaacaaacgaaatgttggaccaggcaaagagaaagagactacagagaagacatcatgcgatgtcagagaggttattctatcagatgatcgtcctgtgaagacacaagctggatatggacaagtgaaagctaaagagtaccatagatccgatagccttcctgtgaagaaacaagctgagactaattaccagcaaatctctcaatcaggaaaggagaaagagcatagcatggatgaaagcaatagcactcataacaggagcaggaaaagaacccctgatcaggttgatgggagcctccctccagaaaaacaagtggaagttgcttatgaggaaagaatggctattcctatcaagaagagtactcaccaagaaaaacaactagatgcaggagacagattaaatgctcatagaggatcagagattatgggtgccaaattcacagaacaagcgaactctgacatgagcatgtcatcctctgactccagtaatgctcaaaacaaatccagaagcggttccccttttattccaattggacaccctgctgataagagtacaggtcgagatagttttattagttatcctccaaaagaacatcttgtctctaagcaggctacttatcagggcagatatttagcaagcaataatgaatgcaacaatgcatttgaagggaagattgatcctccatttcataccaatatcgatgatatctccaggaagttcagccctggtactgacttcgaagtgaacaggcagcatttcactgccccaactggcaacgtgtacagtttgcaatctctaagagatagtgacaggttttataggacgcagcgctcagaagacaggaacactaattctcttgagagcacaactggtgatgcacctttgcatggacaccccacaaggtacagtcgacaagttggtgatgataattatctacaaaccagtagggtcccatcaacattgcatgagcaggcacatccaagaacgcatgttggacatgctgatggttacttacagacaagtcaatactcccttggatcttcaggtgctacatatggtcagcaaacatcttcatatggactccccggtacgagtacaccatatagcattatggacaagtatgctcctggattcttggctccaagtgcacaaagaagctcagttatggacatgtacgccctggttccaagtgcatctggaagctcggttatggacaagtatgctccacctttagaggatacaaactacagtgcacgaggggttccacaatacccgtaccgacagctaggctcttctggtgggggttggcctcgtagctgaccacacttcagtttacctgatcaccgttttgaatgtcattgacggctgatgcagcgcttgctttttttttttccttctgagagatctgctgccatgttatttctgcgttccatttgatgaatactaaagtggatcacttgtacaggaatagaaatctcaccctccaagaaaatgagcaagatcctagcttactaatgtagtgtacactgtgaccctagactgacgaatgcccagattccagtatgctggttgttgggcaagtgggtaatccatatggtttcgaatttttgtgatatttcagctctaacaatcctgcctgattttttccccctgaagtttcgtgtatagggagcgactttggctgagtttgcagcattttgaatggaatgttaacaggctttggctgagttactgatgaaaaactgaaatgtcctggaccaacttgaaacttgtagggagggagcccttctgtagattggcacccttcatgttttaattttattcaaaagattcctttttaagtttatcttttagtctaaaatggtcccttggcccacttaaagcgtcatgtgggtttgtgaactcaagaaatatttacccttgatggcaaaatttctacgaaggtgtgttatttagtccgtatttatttagagtatgcacatgcgtacatgttcattcaacagataagaagatatctttgacctccaagtttctctggcgtgcacagtatatgcgtccttggttataacttatactaaaccaaattcggttaggtgacttcatatgtagtgtttgacgttgcaatgttggaaaatctccatgtagtattgtgattgaattgctcaagaatttccgggcaaaatcatatcaaatccaagcatccttagtgggacataaactagcagctatataacctattattttccagaacgatgaatttgtatcgctgaaaggatgattggctaggccaattatttcaaactcacagaaaacctataaccattttttagggggaaaaaactgcataacataggtaacggtgtcatccgtcactccccaaaatctcaagcgaatattttatctaaaacaattaaagctattattttttgcaaaccttttatctaaaacaaggttaagaacaagccttcctgctgctacaactactcccctctgtttcaaaacataagcattcctgattcaggacaagcatagccagatacatagccatgcttataacttggaacagatggagaaattttacacaacatggtgccgatcttgaccagacaaagaaaaaaaaaatctgatgacactatttagtagaaataacttgaaagatggcatgtgcctcagttacagccatgaactgagcgtccactacaaaaacgttgctacaagacaggccaaagaaggcaaaagatgggacacagccctacttgagctctcaaaggttgcacacacggttctttaaatctgttcagtcattctccagtcttgcgatgtacttgtcgtagaacttgcctgctttctcgagctcaccaagctcagtgtagcagtcggcgatcgcaccgtaggcttctgtaacacctgcgtcctctccggtcagcttagagatgttcaacaccatggagtggtactttatagcttccttgtacttgccttgtctctgcaaagatgctcctaaagaatgcaaataaaaaacgaacatcagtagattgtttgctgttttcatttttgcaggtcgcatttcttgaatttttattgaacatggaaaaaagatccttcaggaatcagcataaatatgaacatgtgtctcattatcgagcatttcaaaaacgttcattcataaaaaaagcaatctataggggattctacaacaatcaaggtggctattataacatccagtttcaaacgtgcatggaaaaaggcatgaaagtaaattattgatgggaagcaaacctaatccacgtgccgccttcttctcttcgacgtgatcacccaaggattgtgcaagatcaaaagcagccttaaactcaggaaatgccttatcaggggcttggtttctcagatagttcttcccagccctcagatatgaaattaagcgatccttctggggatcaacaatgacttctgattcaggtatcttactaccaaccggtgcatagctcaaagaaggagcataagattcaatcttggcttgtcttctcagtgctgcatttatctgacgtagctgatcattcaatcgtttaagctcccctctccgttgtcttgcaaggagccctacaggatatctaaatttttcaacatattaagaaatagtaaaaccaacttaaagaggatgaagtagtatgatgtaccaactatactggcccacatagttgcatagataaatggaaacatgcgaattgaataatctgatgatatcacacttccagtttaagactttataactggtactggatcagaaatgaataaaagcaacaataagctaaaaagatatatgaggcaagacatctagaatacacacagatagatgatattttttacagtcaaattcacaaaactctgggttttgaggctttgaggcatctataatgcatattttgcaattttattaaaaaataagattaaactcttttttttagcatatgcccacattggtgagcgacaattcacattctcagcacatgcacttattaatatttctctaagggtcgtgaaatgcctcaagcctaaagttgtgttatttactgctttttttttacaattgtaaataacaatatattgaagaaacaaaacaagattggatgtttggaacttaggatgtgtgtaaatgataaccatatgaatcggtctattctgtgtactatacgggattacatgtcaaacattaggtaaagtgggtatgcctgtactttaaatattaaccaatcaaccaatcaaatatgaacagttaatttgaaagtattagcttttagttgtgtactgtacatatgaactcctttggaattattttattgaaattttcattaatgtacatttggtgtaccaggtatgtgtttttcaaaaagtgaaaggattgtacgcaccacagtggacttatggggataaacacaataaaaaggagggttaggacaccatggctggatgggagggactaacaagaggccaaaacaaccttcagggagacttgagtaatggatatttggagatatggtctatgtgttcatagcaacatcctcaatacaaggatgatggttaagaaataataactatttctcttcttcaatttgctatatctcaatacttctaattctctcattccaatttgtctctcactctcttctattaccttaatcttcttcaaaccattctgcacaataagtatcatgccgtagatatataagaaaattgtgtactggaaggctgaatgttatatccagtttgctatccacaacatgtttctacatgcctccatcatttctgtacttcatattgtaatgatcttacctccaacggtagctccaatcatggcaattgcaaaaagcaaaggcatgttaggtagagagtactctggctcacacggttctgcgaaacaactgggtggtagaacaagcatgacagaactgagaagacatgctttcccaaaacaggaagatatcactttctgaaaagaaaaaagatgttttgatgttatcagtaaacattagcccaaggagtaaagattgacttgtactaaaaatcgagatgatacaatactattttaagaaaaataatgcaaatgaataaaggggtattttacagcattatataattaagaatcaggtgaaacataacaggataaaaatatatatatatcatgggactcaccatcatacctgaaggtcagatgtagacttcataagaaaatggccgtgtccattatcttcatggatgtcatcacttgtagaatggatggcatcagttgatgacaagcagcatcgaactatagaacactgcacaggaaacggacgtcttccaaccttgccaaccagtaaagggacaggaaatgtttgctctgcaaaacaagtggtagcacatgtcagaaagattcaaaacaattgttcgctcttcagaatgtgtaagtttctatttgatatttatacggcgcaacatgagtgtccaccggccaggcggccactccattatcaatcatataaaattcgctacagtgaattctatgatcaatcccaactacatgaactgtgaacttgggttcctgtttaccatgtgtactaatattgcaagcaagaaaaacaagaaagcaagaaagctccgcagcttatgtattcaaaccactgcaacaaagttagcttagcattatcagagaatcaaccaaagtagggtgaaacacataaattggcatttcctatttgacaagttagcttgttgtgttaagcataaaaaattatatatgggctaactcaggtaagcttcctgcacctataattccacaaaacaaaccttgaatggtagaactccaaattgtgaaggatttattatcttatttcagttgaaaaataaatgttaccaaaatagaaacggaaccagcatgtttgtcgtaggaaaaagtggcaagcaaaagctcagaaaaaaaaacaaagtaccctcaattttcaacaaagatgctcacacaaatacatacatgttcaaagtaatccagcaaattcctacgagctcgcatcgcaataaacagctcgaaagatcatccaagaaatgcttccaagaaacggaaagggagaaggaaatgggcacgcactagaggttcccgtgcgggagcgggagcgggagcggcagggtttggttctctcgccagagctccgccgtggaatcgcccacggcggcggaggggagggacgcaggaggagctccatcaagaggataagggaaaatctcttccctttctgtcgttggatgctgctgctgctagtagctcatatcgtcatctgctctgcggagagccgagccgagcctggctttggctcggctaacatagcagaccagctcgtttactgatgcggcgatgcgtgcgtgactgcgtgtggctggcccgcagaaatattgggtgcaaccgtgcgagattttagatagaaacacctttttttttcaacaagcagttctaaataggaaagggagaaaaaatatttgaagtatcctcatcaatggcggttttgctaattcgcgcagatgcgccatatgcttatctcgcatgcacacggcagatcaactgcgcatccaccttggtcccacacatgcatgtccctacacacgcatgcatgcataatcttttattttaatgttttcatcttaattaatttaggatgtagtgaaagttaaaaatttctattatactatctctgtttcaggttataagactttctagcattgtccacattcatatatatatatatatatatatatatatgtctagattcattaacatatatataaatgtgggcaatgttagaaaatcttataatataaaacggaggaagtaagatatttttaatggaaaatactttttataattcaaaaaatctgagttgaaagttttcaaatctcgagctgaaagtttcaaatttgagttgaaagttttcaaatctcgagttgtaagtttccaaatctcgagttgaaagttttcaaattttatattgcaaatttaaatttgagttgaaaattttcaatatttgagttgaaagatttcaaaatttgacttcaaagtttaaatcttaagtcgaaagttttcaaatctaacttaaagttttcaatctattagaaaaaataaaaagttcttgtaggcactaattatgattagcactaatcactaatcacatcatcattagtgctaatcacatggttagcgacggggcacagcgtacgcgtcagcgggtgtgcatgacttatgctcgcggcgcatacgcgcgcgttaggaacccccatgaatggacaggttacaactgacccaaaaaatattgctcattgttttatttcttagaagagaatagaaagtttgtacaacaaagagcgggaggacgtgagacccctctttgtgagttcggccaggggatagggcacgatgatcaagagcgtaacctcgccgtggattaggctagcgtggtggatggcgatcaagaggacgacgagagattatccaggttcgggccgctgggaagcgtaataccctactcctttgtgtggatttctgtttacgctattacaagagatctcaaacccaagagagacggttggctagtcttctcctaaggctcaagctcccaatagtcaccctcttgctcggtgggcaaggtccttcttttatagttcaaggggataccacatgcaccgcctctacacatctccttcctagagaggggcccacatcaacctgggtcgagctaccgcccatgccttaggccgaaagtaaggtggccgctcgtcctcaggtgggccccagcgtcgtccttcgcctgacacgggggacatccctgtcattccttcataaattcctgtagacttttgtgggtacatgcgcatgggatgcaccggtcgaacatcgatcctctgccgttgatgagacggggcataccttgccccacgccgcctgacacagggtaggacgtgggtgcgatgccgcctgtcccatctgccggtggccggtcagagcccggtcaaggaaattgatgcacgtcaatcactgggcggcgcacgaccagccacaccgcattaaatgcgacggggggcggttggggcgccgcccgtaaatacgcctggcaacgcccctatctccgcccactcgaccgccacgtggcaaccgagtgagggcctcggggtgcgacaggataccccgagccccctaggcggactcgggcgcctcttggctatttattacccacgcgtctgaccccctgaggggggatccgggccgctcggccacgtggctgggggaaaggactttttcccctcagcatgggtaccccggacccatatgaccaacaacttcaataagaacactctaaaaaaaagataaagggcttcaccgaagcgatgcgcaacaactccattaggagctaagctcctacatggggagtgaccggaccaagagttaatgaataggctctagcagtacaccataataaactctcttggcacagcatccaatacggcagcagtactaggtgtggcattgttaaagacacaatcattcagtgtttccaaattttccaagccactaagataattagagagtttagccatttcttagctttcttagaaacacctctgaccacttgggatcatcagttagagaatcgccttgaggaagttagagaatcctagaaatacaatgattatgggacggatgtaagacacaaggatgtgttgtgggttaccctgatatgcttgtatagtcacgtatccgtgtcggatacggcaacggatacggatacgtatcggatacgctccaatacgtatcccgtacgtatcccacatatttgtgatttgcaaaaaaataaataaatcaagatacgccagcgatacgcccacgaccttcctctgtcttcgctcgcatctgggatgcgccaccgcacgagctttggcccaacttgatggctgatgtctctcgtgcatgcccggcgttgccgccggacgccggctgcagccgcgcgcgtcgctgccgtgcatggggccacaacgtcccctccgcgagacgacagagccgccgctgctgggcggcggcgcacctctttcgccgccaacctcgacagcagaactttttctttcttcgcttgaccgcctggccgggtaatccattctcttcaaaagtttcatgcttgaatctgctgcgcctttcttgttttccttaggacaaagtactaccgtttttgttagttacaagtggtagtgcatctagcaatcctagtggttactggttagtgcggctgttaatgttgatgcaaagtcatcaagaaatatatgattgaactattaatctttggttttggggatcttaatcgcttcttaatttgaattgcctatagaagagaaaattgcagaatattgatatggaatcggctacactaatactagtattatatcactatttctttacaaaagttccttgatttttttgtatttttaatatatataaatacaatttccttaattttttgtgtgtttttaatatatatgtatatgtatatatatatatgtatatatatgtatatatgtatatatgtatatatatatatatatatatgtatatatatgtatatatgtatatatgtatatatatatatatatatgtatatatgtatatatatataagcgtatccccgtatcgacgtatcgcgtatccgtatccgtatccccgtatctgggtaacgtaggtactgtctcctcctgttgatcacaaagatggcaaacatccgggtgtgacatcccaaacttctcaaggcgatccgatgtctaacatcggttattcactaccaataaaaaagaacttacatttaagggccgcccaaatcatgtatgttctcttccgtagggcaaattttatgagagaatcccttatatgccactagaatttgaccagtttccttatatgccactcaaaattggcttctcccttatatgccactaattcaagttttttcacccttttaagcgactcccacagttgactattagtcaaaggttagtttttttccgtaaatggccaatatgccctctcaactaaaaaagtgtaaacttcaaaaaaatcataactaatttattttaaatccttttttagtgaacaaaattttgtcagaaccagtgaaaaatgctctttatattaaaaatattgttggaaaactgcatgtttcatgcttacattgaaaatttatttgtgatggtaatggctaaaattgaatgtgatgcagaaaaaatcaattttcatatgttgtatctggtagctatattagtactaaaatacctattattggttgcatactaattctaaagggcaaatgcgtctttttacaatgaagttaacggtcaactgactgtggactgacggcaatggcataaaagggaggagaaacttgaaccggtggcataaaagggagaagccgatttgaagtggcatataagggagccggttaatttagagtggtatataagggattctctcaaattttattgacctagtgaaataggtgcggtaagtaaacttactcgtgtaagctcctatgtccgaaaacttccaactgcgttttcattattatttcagcaggcttatttggttcatctatgattttcaactcaaagcagatgcccttaaccatttacacgctatttgagacattgtcttatcttctattcccttcgtcccaaaatataagtatttctggctatatgttcagattcatggccaaaaattgctatattttgggatggaggtagtagcaacttcactaatgccaaacctcttttaaaaatttcagttttactatggaaaatctagaaagctagaaatgaccatattttcaattcaaaaacttgtaagcttttttaggtctgtaacgcagcagaagctatggcaaaaacttatgaacacattatgcaaaaccgacaacaagagcaacaggtaatcaatcaagaccaaacacttatacattctgttcagcccttacctacaggtacccgttgctatgtttacacatattggaaggacaatgaagcatgatttggaattttttatctgataaaagcatattccaaaaactatatttcgtctttgcttgctgaacttgtaggaataatcatggcctatcagatatgctctgcactttctatgggaaccacggtattcctttccgattgcgggatcattgttcaaactttgcaacaggatgactatacttccagtaaaactcaacacaaatcattatcaaatggattccaagagaagcaaacaagcacgctgatagccttgcaaaaaaggctagaaatctcaaagccaactttaaactgatctgaattgtcataacaatagacatacatgcttattatcctccaagcagtcccattttgggaatcctttcaacactccctttgggagatgtaatcatcgctcatgtaatatgcttttaatctaatcttcaataaagttcatgagttttaaagaaaagcgccagagtgagccactgagctgctagcgacttcggctcatttggcatgcgactatgcgagccaagacgagcctgagctatattgcattctaaaacccctacttttgtttaaaaccatccggattctatatcactaaacaaggttccttatgttgaagatttgtgcaactaacaaacagtgacggatctagaaagaaatagcagtggggtctgagcaaactagctagatagagttgcagtccctcctcctatctacctatggtaaaaaaatttagtgggctcttcgtgggttctctcatagtcttcacggcagtattgggagctcgagaccccgccgccctcatgctggatccgcccctgccaacaaatgtattaggtagtgaaatagacactcctaaacggatatcactttatctttgagtaaattacataaaacttcagaataaatgccttcaaagtaagaaattatgtcttttttcacagtttttgaggtgaatttttatcacaattttatgtggaataattacacaaatctaataaatttttgaaattaaatttttaaggaaaatcaaatatatcaagtgctaacattttagaaataattatttcaaaaatcatttttcatgaaaatatttcaaaatcattggtgatttatattaacaaagttcattttttggcccttaaaactttatttcaaatccctttcgtatttaactacagaattggtcaatggtcatcgattctacattattatttttgcgtgaaatccccattccatattagtcaaattttttcctatattagattgagatcccacaatccacatacttctctttccaacctacaatcaaccctagttcctatctacctcccaccaagcctcctgcctcaatttcagaggcaatcgttgactgctccgtgccatgtccacttatgcctagaatgagccggacgatgtgctgtcctctatctattgccactttcttttccggcctcttcttctccaactctgggaagattctcccacactgtcattctctcttgtctccgccaactccagccgtcaaatctactgccactgtccattgtcacctaaccactcgctggagatgcccaccctccaaatgataatgttagactagagaaggaggtcatggcatacaaattgtggagtatgtatgaagctcacaaaatagtaagatttgcattgattctttttttgtcaaatgtcatttagcaaatatgttatttttcttcagtttttaaaacacacgtaacacagtaaactactccctttgtgccaaaatataagggattttgatcgaatgggagaatttggacagtccagatatgtagtactaggatatgtcccatccgatcaaaatcccttatattttggaactcagggagtattcctttatggtagtagtcaagtacttctattaaaaaaatatcccacatgtggttttgtcaaattctaaaaatatcataaatatcttggactgccaacactggttggtagatcaaaagaaggtgcttttaagaacatcaagtaaaagatgtgggagaaaatttcgactcttaagtggcagggtttgtcgaagtcagggaaggagaatttgataaaatttgtactattgacgataccgacgtcctttctctgtaaaaaaaccaacctcgtactacaacgaatctggacatagagtatgtcaagattcgttgtcaagattcgttgactttttttggactgaggaagtactctgagtgtgtttcagatctccaaaggcctatgttctcagatacggacttacattcaatgatctcagatttttggtggggtgcaaagaaaggacaaaggaagacgcactggatagaatggcaacgtacgtgtcgaacgaagagaaatggtggatcgggatttcgggatttacatgatttcaatcaagctctgctggctcgtcaggggtggagactgctagttactacctccgtcccaaaatgtagctatttttagcacagtactttgtcccaaaatgaagctatttttctacctaccttctcctctcaaccaatcacaaccattctttttcacctacattctcttttcaaccaatcacacaccttcttcaattattctcacctactttcttaatacccgtgccagcctcaaaaatgcttacattttgggatggaggaagtaacccggaaccattatgtgctggagtattaaaactccggaccatccctcaactgtggcggaaagggtgttgttccagctggaagagtgggcgaacctgagggagcagaagaacctcaccattccaagtccggcacaggggtggacgaagccaccaaatgggtaaatgcggacaggggcggagggctcggtagggcgaggtatggcgctcgccataccttctcctcccgcctacccccgggagttcaggtctgcagagtgcgagacgcagagaccgcgacgaccgcgagacggcgatagagcgcaggctgaacaacgctgcgaccttcgagatgccaaagccgtgtgcggcttgttttcttgtgtaaattaggctctttaccatgaaaccctaacccaaatttctctaatccccaatccccgatccatcctcatcggcagagcaggcgagaggcggcgctgcgggcgacggccgacagggcgagcgccggcgctgcggcggcgcggcgagccggcgacgcgaggcagcgcgcggcggcacggctgcgcagggcagcggcgcggcgggccggcggccaggcaggcaggcaacaccgcggcagcaggaggcaaggcaggcggcaggcagcaccgcagcagccagcaggaagaaggcaagcagtcaggcagaagcaggcaagcagccaactagccaagcaatcaacttatcaaccaaaaaatggatagaaagagaaaaggaaaagcattggcttcacaaagatgtacatattcttcaaatgttaacaatttcagaatatttttgtgggtttgaagtatacaaatttgatactaaaattgcatttgtgtaatgtattttgcagatttgaagagttactgaaacccgggcactagttgtgcatcttaagcagaagatcatgggccacaccgccacacctaattttttttccgtcctccgccactgaatgcggatggtgcattttcatcaaataaacataagggagcatcaggggtggacatgaggaatgctttgggaattttgtggctgcaacaactagtttttattcacaggtagcaaatgccacagacggaagtgttggcatgtaggcaagccacagaactgactatggagaaggggtggatagagtgataattaaaatagataatttggaggtggtggggatgctaacacaggttggagtaaactgttctatgtatgggacaataatccaaaacctcgatagcaggttaaaatcgttccgggaaatgaaggtccaattggtgtgacgatcagcatataaagctgctcacttgataggcaaggaaggatgcgtgatgggcgaaacatcgaattggctgtcagttccattggcctacatcaaccatattttaaaggaagaatgtaattttgatagctatattcggtagttatttttgtgaggtcttacctaaaaaaagaaaacttggaagtaaaaaggtatagttcttttagttaaaggctaaaaaaataaattcacaacaaagtttaaatgttcaacagactgttgttaaaaatgtcaaaacacagagaaggcctctgcagctgttgctgctcccactctgcatccctattgttttgttcggttctgcagctgctaacttatgtaggaaaaaaaaatatcatgagttgtgtatgtgacctagctaaaccctgaaaattaaaaagtatttaaaaaaaggtaagtctcatatgggtgatttttttctctcgttttatgcaaccttcatcaacgcaaataatacattggcattagcacatgtcaacgacaactctgcttaatcagtaaggttcaaaaatgtacatatgccataaaatggcgcaccagtagagcgtaataaaatgtttacattagataaaattactacaataaacataaaacttcaagaaatcagcacataaaatattgcagcagcaagtcaccaagcgattaaatctagcatcagagatcactacaagattcctagacgtcaatttcagtttcaagaattccacaagaccagcctaatggtacaatgcatattacatagctctgaacactatgcatttgcttcctacaaaaagaacgatatctctggtggttgaacaaaggagaagatggcttcaccgaatacctcgtacaatgaactcaacagatgcccagcattttggtcctccttccaggctagcctcagcactgtggaaactctttgcgtgtggttgcttccctgatccctccgaatcacacctgatgcggtgctttccaccaattgcccagaggatgaagtttgcgtcatgctagggttgggtaattgggtggagaagccatccatggttcctggcatgggagctgaagtcatagaattcatcgcaccatctgttgtcatcttcttcagaggtggctgggatgtggagagatctgtactagacttccgtttatctgaaatttgaattgaccatagccttactttcacaccttaataatttcaacattttgcagtattatgtatctgagaagaaattgttcagccgataaaataaccatttttatttgttgtgcgttgccaagcaagtagcaacacatatattatatagaagtaccaacttacttgggttgttagtcacgactctcttattactcctcaaaagaggccgtgttgatggagaaagcaaattaggaaacaacttgagccgatcatataagcattttcctgcagcacactgaaaaatacattccacaggtaagaagctggtgcataaaaatagataacatgtattcattgaaagcttgtaatctaaccagcagggcaccataaacacgccatgcttcctttcttttcatctcatttttctgcttatcaagttgtaattccggctctaaaagctgcatgtatgtctcgaggttgggcaaaagcagaagcctaatctggtaaagaacaaaaattgtgagcaaaattttgctgaaatataaaattagattagcttgaacaggacttactgcactgggccccaatgcagatatcccttgaatcgcaccatagtgttgtgtcaatgatttctgaggatcaagaaatccctggaccaacgtccttgtcacccgggtttggatgttgtgatacgcatgaccaaacctacaaaaagaaatgtttgtatttcaatgaaagcaacatcaaaaggcaatcaatcagcacaagcagcagaaaccaattaacctctagccacagagcaacttaagtaatgttcaaccattcgcagggacttcataacagaagtgtgttaacataagcactcaaatacatgacagctaatagatccacaaatcctgttccctctccaaatcaagcacacgccctcgggcaaagctgggcaggccgtgcgtactcgcgtgaagtcaaccgcggtctgtggcatagatctttctcggtaaaaactgaaccccgaaaaaaccgaaccgatcttcttcggtttattttgctcggttgatatttttctagaacttccttcggtttacattttacgaaaaccgaattccaagcaacccgaaaaacccgatccaattaaaccgaggaaaccgaacgcccacccctagtaattgtgacaaagctcctccaactaaacataaatctaagaagaggtgctatcacacatagtaaatccgtaaggaataagcctcaagcaagttcctgccccacatggaaatatgtttggttattagtttccatctgtattaacactctccagtgtccagtttcctagcttttatgatcttgtagaccttgttcttgttgggtcttgaaattttttgtgctttattatctactgtatgctatatttctaagtggggttctcccctatcgtttctctaaggggacttcacatgagacaaagtcaccgccaactaaatatatgcatcgagataaagcgtggagcttttagtctacatggcctagaaaaatgcaaaaatcaatgtaacataaaacaaatactacctaacattctatttattagtagaattatgcaagtgaggaaacggttccataactgatggtaattgttcttgtctcgccaagaaataaagggataagtccattctacttgcctttgtctaaaacacaccactgaacttcaaaaccaggtattttgcaaccccccccccccccccccccgaatttccaagcgggtaaattgtatggtattggaagtttgggggtgtgttacaaaggcaagaattgagggggataaaatggacttatcctagaaataaataactgacacagtaggaaatggaggtcaaaccactattgacttcccattcatccagaagtcagtgcagagagtccgtacaccattcatccaaaaatgaaataacaaatgtcatgtataagagaatggagggaatagaagaaatgaagaactatgataatggtgtggaaatgattctaaagattatgtctagaaactgtaaccatcaagaacagattagattctgataacattcttggatctgagtagaatgaggttagatagcacatattactatctgataaaagaagctactcaagtctttcttctcgtccttctccagttgagtttctctacaagtagatccttgtgcatgcagctttaaaacttctaaaaatttaaaatttatgatatatatttttgaacctagtagtggtaacatcctgagttagtgggatattttcatattctgtggactatttgatcattcgcttgtatggcttgtaacaagattaattcacgaaatatatacgcctttttcatattttttattacttattatatgtctatttgaagcccattgcgatgcataggtatttgagtagttactcttcgtgttcactcaccttcgacatactgaaccaaccaaattagcagagaagtctctaagctcccaatggttgtctgaaagcctatgcccaagccttttcgcaaccatgcaggtgataattgacggcatcaactgatgcaactggcaatcaagagaaattttgtttctttagcagaaatatgctgcaaacataagtgtgcaatgctaaaaacaaaacaactagaaagtagaagcatcaaagttgactgatcaaccacttacatatggttcaatatgaatgtggggattgtgtaggaggctttggactacacgcatgagagcaaataaaacaggaagatcacctaaactccgggtaacctgaaattataaggatatacattgtaaggcaatgccagctcgcacaatatagactctaagagcaagataacaacctcatcggcgatgaagtaggaaaagtaaggaaccaacggatgaaggcctgagtctcttgataagctcactaatgcttctctaaaaactgaggtttcagatctactcattgtaagctctgctattttatcaaaatacatctgcaaacgaaaccagtaaagaagaatataaatcttatgtaaggctctaacaatatacagtaaccacaatacctggagttctctagataacacatgcttaacaggaagcttgatgtcaacaggaagtccatcatctttcccatgctctgtccttttattctctgttggtgctacgatagctgaagtgaaacactaattgtcagataataccaaaatctacaaataatgaacaagcaaggaacattataaacacggatttaatcacactaaggtctgttaatagatcccacaactaatctcttcctcacccaaggaacattgtatacataaagcaggtaacaatatgatgtaagttttgtgaagataacttaaaccgcaaggggtcaccggaagcaaatccatatacagataactagaaggtatttgtgttggaatggatccaaatatcctaactaaatgttagttctagaatataaaatgcaacaggtaattaactatcctccaattgaacaccaactaaccacctcgtatactcatattcaaagattcaatatttttctataaaaatctcacgaataacacatacctacatatttacagccacaaaagatcaacgtgggggtgggtgtagaacctagcataaccccccaactccctcttttaaagagtaaaataagataagatatatgagctaaccatctacaggaggattctctggaattgcaggctggactccctcaatggctagccagtgagctacaactgctgtatcaagaggagctttaggtagaggggcctcaataatctgcacagagccaatgaataagaaaattttcaaattgatccctataataaaataagtacaaaagttatttgattcatccattagtagagcccctacctctttgaagtctacctccctgtcatcaatatagaagagatccttgtgtcccacagctctcttaaaccgcaaggggtcaccggaagcaaatccatatacaggctgtgtgaaaattcaaagcaattaaataaatgcactgaaacaatactttttaatgccaacttcaccataacatagaaccaccataaaaactaatgtcaacaaatttcctaccagcggtgctgcatatgcatcagtttttgtggtaatagattatgatccaatacaatgctattatttttagcttgtgtcttagacactgaaggcaatcatgtcccacctaaactccactacagtaacattttaaccaaaataacgaaaatatgtagcaaaagtaacatcaaagaaaccaacctagcacgctaaaccaacccagtgataatattgagagtgccaaaaaggacattatgttactcaaaaaaggaggaaacgcctatatatggagtcatacaaaacatataaacacattggcaatgtttaatatatacttctcagttcttaatctgaaattaaaagaaaaacagtttcacattttcccagttctaacattgagcgtggcaaaggggcattatgttacttgtaagcaaagtaggaaacttttacatacgaagtcatatacaacagcatataaacacattggcaatgtttaatacatagttctcagtccttgatttgaaacaaaaaacataatcatcaaattctaacataaagtgcatttagcttagcacaccccatttgacatgaatacatatctcatattttattttgtattttcacatggattatttcccccatcttacccagcgtacactattgggcttcatcctacttattcagctttctctcattcagttccacgcaaagtaaaatcagcatcctactggactgcagtaacctcacaactagtgggtgtcagagaaatagggggctgaatggaaggatatggtttctcccctatgctcagttcagctgttcccttgaggaattacatgtcaagctttaaagacattatttgttttctcgaacacacaggagagctgtgttctcaaatggaacagaaggattgtatatttgtattaaagaagaagagaggggaagaaaccaccgaatacacccagacaccaaaagcctctaccaattgcagtatcagttttcaaacaagagatgattgcaatggcatttatatgtcagggaacagacataccaaaaacagatacaggcatagagtttgccttatttatggctaacatgtctccatgaaaagatcgtcaactctaagtttcttaaacatttatacttttagcttaataatgagctgattccgagaaatactgagctcgactatttagctatccaactcagaagtttgatgcattcaagcatacaacagttactagatctacaaaacctttatttagtagtcctaaaaaatattgtcaacgaaatagaaactacctcaacattcctgaggctgagagcactatcaacatcatcggcagtcaggactgtcctctttgcatgccgcatacacttgatggcctcctgtcacaatccacagcataataaaatacatatagtgcctaggagaaaatggaatggcatttctgtgactgaatatttatatgcttacatacaaattttgcagatcaacatatacttccagaaaattatcgcaaaacaacagatgtaacaccaaatttataacttaagcaacgagattatagatctacagataaagcacggactttatgagaaaactacaatttatgaaaagttcatcacgatagatgaaacctgtaaaatttgtagtttcatgataaaatcggtgctaaatcgataattgtgtgatatggctcaaatatgtatttttctggtaatgcagtgttaaatttgtattttttgtgacaactctgtagtttgtcaatgatagttttccaaaatttatgagtaaagatcagataggaataacatatttccaagattcagtaaagaaaacctcaaatgatgaatttatcgtgtaaatagtggatagaacgcaaattcttagactcactacctcactaaatatatacaaattaaaaaaaatggtgataaaacaggaacaaaaccccaacatatgttaccagtaagctatagcatgcaatcgaatgagagaagattgaacagtccagaaactctgtaatggtgtgcttcaatgcttttgaagagacaatagtgaacaaaaaaaacaaccatcttccgtccaatatattgcattgctatgaagaccgtccaatatattgcattgctatgaagaccgtccaatatattgcattgctacaaaaacccagtgaacatatattgagcaggacacagttaagcagtcagtgtgaaccagcatgttcaaacaacaagatggaaacgcatctcgtccagcaaactcaaaacccattggaataggtctatcgcaaatattccaccacacaacttagcacaatggttgagcatagcaatcaattgagagaacgaagaacaaagagcaagcaattgctccctgcggtcccaaatcacccagaaactacaaatccacgcctcgggggggcaggcaattttcctacgaagggaatggtggaagttgcctcctagtcccccaaagtgcacgaaactaaaaccgaagggaagcgagagattcgggagcgcgggggggacggacctgcatgatctcgcggaggcggtactccacgtcgggggcgagcgcggcggagacatcggcggggaggttggcgatgccgacgctctgcccgatcacctcaatcgtctctttgggcactatgctcatccctcccccgctctttctcctcccccccccccccccccctcttctcccttcgcctcccctcgctcctcgctcgccaaattacccaaaccctagctctctggccgtactgctcccttctagcctccgcctatccgccactgctgcagtgccctcttcgctggttcgctagcatctaagcgctcgccgctgcctcctcgccagcgtttctcgccgccgccgccgccgctggcatgcacgccggagccgacgagaagaggatttgaccgagtgtggctgggaaacgtttgtgaatcaagaatttctcgtaaaatagaaaactacttcgtaggatatattcctagcttagggagcaattggttatatacttctctctagggtgtttacttgcgaaattcttatctgccgcacacgcgtcagtatggtcgcgcatcagcccaccagcccacgtgctgttttcacattttcccgtgattttcggcccaccagcctacttgttgtttccttttttcgccatgattttcggcccacaaatccacgtgctatgtttccttattttcgactccactcgtttccttatcgtttttttatttttcgaaacattcaacttaaattttgaaacgttcaactcaaaattgattcaaatttgaaaactttcgaatcaagtttcgaaaatttttaactccaatttcaaaacttttaactcaaaaatcaaaactttgactcaaattttgaaaactttcaattcaaatttcaaaaactttcaactcacaattaaaaattttcatcgcaaaaatgtaaaacttttaactcaaaattctaaattttcatttctaactgaaaacttaatgaaaacttccatatcaaaatttaaaaaaaattaactcaaatttaaaattatttatgtattttgaaaaatgctaattatgataattaacagtaattactgtaattatcactaatgactataattagcggcgggcgtcttgcactaatcgcgcgcagggtgtgggagaggggggcgttgcccgagttaagcagtcggcgtgtgcgcggccattagagcaaggtcaatagtgcagctagtagtaggctctaaaattttatcatgtctcaagtagagctaacttaaaaagcatctcatacaacaagctaactacaagttagctataaactaccttggttcaaacgaattaacaagcagtagaacccacaaacaaatttttttattgtatctcctggccgatacagcgtggagcgctgtacaagcgccggcgccagaacaagcgacggcttctttctcaatcactgattttctttccttaatctcgttttagactgattaacaagttttggagcgttcctaatagcactattgtacccgctcttagaaaccaagttttcttgctaaaacgaaaaaggttactatatttgatcacttagagcacccgcaatgttaatgtaaagtgctatctataaaacatgtacatctcagcaatagactaaattaatagtaaatcacttcaatggtatgtctacatggatatctatagctctctaatctattgtctcgtttttctctatagactatctccagattagtagatagctatactctctctctcttcatttaatctcttccaagtaggaaaatatgctgacatggatctcttgtagagagcctatagataaccattgcgggtgcccttattacaatgtgtcggggctagagagagaaactagagagagaggagcagagcagaggctactactaccttcttccagcgaggcgaggaggagacctgtgtcggatcggatggtataacggtatggaggaggcgccggggacgtgtataactcaaaggtagcatgagtcttacatgcttgcagacatagagccatgggttccaaaagatgatttggatggtcatctgcttcagattcgcaatcatctgcaaaatgaattaggtgttatggttacccattgctctcctcatccttttggggttggttttttcattgttagatcaactttaaccagagataccctggtagaggcttttggtttccattacaatggggttaatgtggtcaaatttagaaatcatgacagaggctcaattggagggcagcgtatgtagatagggttgggtggatcatgttcctggctgcccacttgattttcacactacaagttatatatctagaggagttgggctctttggctggttggactattggcaggaagttgacgttattcccgacaaagttatgatgagggctttctttgatgatgttgatcaggttcctaggaggattgtttttaagcaaatcccgactcagcgagggcaaggagaatcttggaccttttgtgtttttgtcctttataatgattttgtggatacacaagcgcaagatgaagatttgccaactttgggtgctccacctccacctccggaacaacctcctcattagggttcaacctgggatgaccaagaggagccaccacagcaagatgaaggttggggcaattggaatcaccaagcagaaaaccagcaggcaactggtgaatctggtgtgagctctcatgatgccaatgagggtcacaagcacataattatgtatgcagatgaaaccccagaacaacagctcacacttcctcaatcttctatctctgaagacatgcagggaaaaattgaagagttggtgcttaaaacacaacttttgaaacaactttgtggatagggtggaaggggtagtgttcaaagccaactcagattgcaacccctttcattcagcttttgtacccaaagaggaatgctccttctgatcctcccgctagtttttaaaacagaccatttggatgaggcctctagttgggccgtgcaaacaagccagcttattgtggatgacgtcatgatgacttaagacctcttgatagagccaccaactcccctggctattttgccaccagtgactaaagaatcggtcctagtcatacatttgcagctctaggctatacaacagcagccttcttcacttccacaaatcaactcagttggcccctaggatacccagatacggctcacaagccacgtatccgtattggatacggatacgtatccctaatcaccatgatataaaaaaaagaaaattactcggatacttctccgatacattccccatgcgtctgaactcacaaacccacgctcgcagcacagaagggcagatccaatcctcctgtagcgctgcttgcatcgctaccaggggcacactgcacaaggcctccaccagttggccaccgggttccgccgccactcgccacctgaggagcagggcctccaccgcccgccgtgcgtcgcgtcgccacccctggtcccctaggcgcagggcctccgccgtcggtagtcgcggcatctccgtcaccaggcgcagcttctccgccggctaccaagcccaacgcgtacagtccatcatcaccggctatttggttctttccccttttaagtctcgatctgcactggttgttttgttatgtgtttttccttgtcatttagatccggtgaattttggaattagaagcttaaccacttatctagcactagtatgtactgctagcgcggctacaaattcatcaggatcacttgtgaccaggcatgggagcatattatttacgaggggcaagctacatgatgagcttgatctcctgggatagtactactaaaagatctggtgcatgggacatgtctgggatgtagctctttcagccacatcgcttgctatgaatgcaagcagctcttgaacttctattgagttgagcttgatatccagaaaaagttttattctaattatctctaatgatgtcatgtaatttgtataactctatttgcaggcttatagttatttatgtgttatgtttttcatttgaattttttatttttttaaatatatatagacgtatccctgtatcagtgtttttaagaaaatgacgtgtcctcgtatccccgtatcgcgtatccgtatccgtatccccgtatcagagtaacatattggcccttatcctcccaggaactccagttaaaaagagggatggtaagactatactctttaacctagagaggaggcagagtgcaagggtgagggcttcttctgaaagttatcttgagcaagatccaagaatgggtattggaaagcctaggggaatgtcggccaaaaaacttaaggaactagtaggtattttgcataatcttctagcagtatccatacagaatctgattttgattgtgatttttactctgatgttgattcctcctcttcttattgttctatcttgtttctgcaaaagatgggagttaatatgtgtggcctatctcctgacgaggtggctgagggcaaactgggtggagacaagatggaaaaactcccaaggccaactgaggatgatgagtagcaaatgttcattatgttaatggcagttgtcttaaagataatgtgtttgcagtggtcctccttttgtgaatctatttatgtcgtgcctctaaatatgttcagaggatttaagacttttattgtaatgtgctagtctagttttattcagacctgctttgcttgttatgtgcttctctttaactaactgtttatcaatgaatatccatcaagttcgtagttggaatattttgtgctggaacataagagggatgaactcagaggacaagtgagatgctttgaaacaatgcattgatgatagcaaatgtcaggtcatatgcttgcaggaaactaagagagaatcaattgacataaatttcctcaaaaaagtggtccctaagagatttaattgttttcagatcataccttctatgggggcctctagtggctctatgatgtgaaaatattttgtgggttctttagttcttgctaataattattctttatgcttgaattctgtctcaaagcataattctgagtcttggtttatggcttccatttatggcccatgtagaggacaggaaagagacaattttgttgactacttgagaaattttcatatgcaaagtgatgaagcttggatcctccaagggaatttcaatttttatagatccaccaagaataggaacaaacttggagttgacatgaatgatattatcattttcactgatattataagttctttaggcttagtggaatttcctataaaaggaaaatcttttacttgtagtaatatacaagctaacctcttgttagagcagcttgactagcttttaacttccaatgcttggacactaagatatccaaagtcctatgttcttaccctaacaagagcaatatcagttcaaatgattaaaatactcttctatccccatatccaatgtctttcattttgagaattattgggttgatatggaagggttttttttatcatggtgcttggatatggaacattgatccaggttttattgaccctgctagatgtatcatctataagccggagctactgagaaaattcttaaaataattgagtaagggtctctccaagctacttcagttaatctctatctataataagggtttagactttctatatctgatagaagaacgcagaagtctcactatcctaaaatggaattttagagaagtggtcaagaaacaaatctcaaagctctatctttttagaagattatattggaaaaggagatgcactaatagacggatcgagttgggggagaaaacacgaagttcttccatgcaatggctacaaaaagatttggatgatataattgctcaaatcaatgatgaaagagtaacgttggtgtcttctcaccaacataagacttctctattttttaattcttttcaaaacagaatgggagtttcttcacaccctgaaatggttttcaacctgactgaattatttccaagactgtagatttcaagagtttgtgaaaggaccttgatgctgcctagaggagggatgaataggcatttaaaatttttaataaaatgcagaagctaaactttttagatatcctagaatttgttcggatatttcggaatattttcggatattccgaaaatctcatattttcaagcaagttagcaaggcaagcacaatgggatagccacacatgtagggaaaggattgttcaaacaacaattaaactactagcagcaccaaatagcaaagctataagagtgtgagagagatatcaccgggattcttgcaagtcgatgtgttaccaaagttcaaattcttgaggggattctactctcctttgaagagctcacaatgagccgagtcttttctgaccctatcctctgaggctgcacaaatgcactactccttccaccaagagtatctcttcccttttgaaggtgagatccgaccttcacaaactccttcaatgtccaactccttcacaaactcctgggcaatagggccaagtggttcagaagtaaactcaaaatcatcaatgtgtatccaactcatacaaaattatttcatctagagggtgagtaaatagtttgaaaaacttcggcactgtagaacccatctaaagttaagatcttcttgcaacttctctttcacaataaaattcaagaaactcaagaaaagatgccggggacacaaatttttgttgttcatcaggtagatttggatggtcattagcctctgggtttggatggagtggcatccccgattctcatgcttggggtgtggaaactatcaattcagacttttcttcttcttcttcttcttcttcttcttcttcttcttttgcagtttttgtttcgactaattggactacaagaaataagatggacatagagaagaaatttgtctcacaaccctactgttgtgctttacatatgtaaatgtatttcactagtggaggaagacagcatgcaaggttgatctcatatgctccatggtgttagaatgacttcgctgcttccagtcatgatttaagcatcttaaagtttcagcttttgctatgttctccaaaacgccgatcttcatgtggttaggtgataggtcctgttagtgctcttctcctgtggactgtggtccttggatcatcgaatgcccaattattcaggtcatggaaaacctggtactgcaggccatacgacccatactgccatgtatccccatgatttttattgcctatctgaatcaggtctaagcaaaatcatttcatgaatcctctcaattgtattggtctgactggatgttgggaaggtggagtcttgttgttgggattgaagtcatccaattgcttctcattctcaggaaaaagttctctggtttgcgaggagtggatgaaatgaacaataaggctgcgacagagtatcagcaactttgtcgatctcactgaatgtttggactatgggactgtgaccttcttggttatttgctgggattaatgcttccaatccttcctggcctgacttgcaacgaatcacaaataaaagttccaatggagtaatttaatatccaatcaagtttaacaagcttgcagttcttaggacgaatatcgcacaagttaaaataaggtgcgaaacaaggaaataaccaaagataaattatatcacaattctttggagaataatcggatttcaacttcttttttcactccagaaatctggattgttctatcgattttgaacaagttttgtcacagccgaatctgagaaagtctgtacaggcagacatcacacaagtacatgacaggaggaacatgggaatcctacaacgatgcagagcaagcaaaaagaaaaggtgtgaaaaaaaaaaagaaaactaataatgatgttttcctctgttcttgtttcacttctggcacgaaaccaaaactgtctactatcagctaaaagaaagctcgcggctcgcgacgccgcttctcacgctggcagctcgagccgcaggccgatgcgactcgactccgcgctcaagccgctaaggtcgcagcgcgcctccgccgacgaaggcctcctcgaggcgcgcacgacgagcggctggaacccgagcgtgagctccagcccgacctcctcctcctccccctcttcgtgctccaccggcacggggctctgctcggcctggctcacgtgtgagccggtctcgacctcggtatcctccgatcccgcccgcggcggcgtcacgtcggcgatggccatgtcgttgttgtcaccgtcgtccacatggtcgtcgtcgtcgtggtcatggctgccagccgactcctcgtggacctcgtggctcagcgcagggtggtggtg

SEQ ID NO: 32617 - DNA, 21639 bp, Oryza sativa
caccgcctccggctccgtctcgtgcgtcgggctgctgctgctgggggacgcggcgcgcttggcggcggctgctccggcaagcttggcgccgtgcttggagttggagctggaggaggcgcgcttgaagcgggtgcggccgccgcgcgcgacgcggagcaggttggcggcggcgtcggcctcggcgtccttggagacgtggcggatgtcgtaggccctgagcggcggggtggcctgggcggcggcggcggcctcagaggagacctgcacgacggggtcgcccttgaggacggcctcgacggcggcctggcacgcctgccactggcccgaccagagcaggccgacggagccgtagatcgggttgacgatgcggccgcaggcctcgtagaggagcgagcggaagacggcggggcggaggtggtcaggcccggcagcgagcaggttgagaagcccggcgcggccgtagaacttggcgaggaagacggtggcgttggcctgcgcctcgggggtcttgatccactgcaggcacggacggatggtgcacccttcgctgcatcccttgcgcagcacccggcaaccgttgcaactcatccgcatcttcgaaatgcttctgcaaacccttatcaactgggcgccggacttgttggagatccgaggtggtactattcttccttcttcttctccaagcctgtgcgaggactcgactcgatactgccttgcttgttggagatgagttgagatggagatgtttggtgtgagaatgacggggagcggaggagagagaggggtgcctgttttataagtgggttcggcgccagtggtttcggaaggccgggttcggcgccgcaccagaaaaaaaaagggaaaagaaaaaacgaggcgaatcaaggggcggggcccaccgcgtggtttaactgcgggcttgagcgccaagccgcgtccgaggaatggattctagctccaaaactggaggcgccccggccgggagatttcggtggaaccgcgtgctatctttttccctgttgctcgcgtgccgctactaccactacccccgcgcgcgtcgtcctggagtacactagcagcagtacacacttttgctactattacgtgttggtagtactacgtatactactccagtttatttactactcctactactaccatcttccagggctgctttcattccagaaaggaaacaacggcccggccgtccgttgattttacagtaaaccgcaggttgtttgacgtggcgatgactcagattctgcaaagaacccccgcaaaaaaaaaggattctgcaaagaaactagtactccggctccacttttttcctcccttctccaatcattctactctgtaaaaaataaatctttaaaagcacggtaaaaatcgtggctagtagtactagttactgtgcagttgtgtttatgattaacctctgtcctctgacagttggcgtgaagagagcgaacagatccaagactccggggggcagtggaccccacggcgcagggaaaggagggtggtcagtggtgcgtgcccgagaggcgaggaggaggaggcgggccgcgcggggcagcacagcgcagcgcgtggcgtccacgtccccgttggggcccagcgaacaggcaagctagccacagaccgcggcgccacaccaccacatataccgcggaaactggaaaggggagggggtggggtggctctggctcccggttttgtggaaatcgtacagcgacggcccctgtttccgctgcctctgtgggcgcgcgcgcccaataccgtgggcgggtttccggatcccgcctcccgccaggtccccccactctcctccccctttcagtttcctagtcatccacccccaagaaacccacgtttgttttttcttctcctcctttgctgctctccatagtttttggctgttgcacccgtgcctgtacccactttatttgctttttttttcctctccctctctcgcgcctcctctcgtgcttatctgttgatggagtcaatcaacgttaactaaatgtggttagcagtttgtttaaggaaattggctttttgggtcgcccgcttgaagttgcgctgagctgaggcatgcatattcttcgctttttccagcgaaaatgagagccaaactttcgaacacctacaaatcgagtgcctgattttaccaaaaaattaaatggtcaaatatttcagttgattatcgagtgaaatattaaatagtgcatggtgaaacagtcaaaatatctgtaaaacacggtaaaaccacacgttgaaatacatcgctatcccgtatgaaacaatgtgttgtttgaaacatatatttttatttcattgaaatataattatatgatatattgttataaatatttaattataacgaattcaatggtgtgatcagattgtggattaaataagtagttttagcaaaaaaaaaatattttgaagatcactacatgcatatatgcattgatagagtatacagtaagctatgggtgtgtttggttcctggtcaagattggatgggatacggcggtccatattttgctggatatggcggtccagttttttgtttggttgtgtgaatatggcgatccaattttttatttggttgtaaggacaaaggtagatttggtgatccaatttttttgtttagttggaggaagtatggtggatttgtgggtgtggtcacctctcacttgagatggtgaatatacctcatcaaattaatacataatacacattccattataaatacacactccattataaaaacacattccattataaatacacatagaaaaaagaaaaaagaaaaagaaaaaggaaaaaaagcagcgccagatctggcctcgccgacgccgctggcagcctcctcccgccgccggccgcctcctcccaccgccgcggctcgcctcctcccgccgccgccgccacgctcgtcgcccacgccagccgccgagctcgtcgcccctctcgccggccgccacgctcgtcgcccgcgccggccgccgagctcgtcgcctctctcaccggccgccgagctcgtcgcccctctcgccggccgctgcgctcgtcgcctcgctcgtgtcgtggtggtgaggggtgacgcgagtcacgcaactcgcttgcccggctcgaccgagcctcgggcggttgtatccggccaaatcggccggatccctctatccagcatctggagagaatattcccctctgggccgccctatcccactctcgcccagcattcaaacaccctccaaaaagcggcggcctatccgggtatatcccaccaaccaaacacaccctatgtatatcagccatcgatgaaatattaagttatatatggtgaaataaaaagtaaacattgaaacatttgaaaaaaaatttgtgtaacacagtaaaaacccatagtgaaacatgccactgttgtatataaacattaagttttaacggtttgaaatctatgttgtaaagatttaattataacaagtacaatggtgtaatcggattgaaaatcagatgattgaaaatcagataagtggttgagaagaaaaaatattttgaagataaccacgggcatgcatatttggatggagtgagtgaggtctggtttagtttctaactttttcttcaaactttcaattttttcatcacatcaaaactttcatatacacacaaactttcaacttttccgtcacatcgttccaattttaatcaaacttccaattttgacggaaaaaacacaccctgagagtaaagcaatgtactagtatggcaggcactcctagttcctacttaagctgcgtccaattttctctctttcgtcaggctactgataggatgtgttatggtcaaactttcatatggacttgtcaattctcactgttggttcacgtactactagtagaaaaagaagggcgtggatgtataaaatgtctcaaattcttaatttcaagtaattggatcctcgtcgttgataataaaacatggaaatattcaactcaaactttgatgcacaagagaaaaaaaattgtatcacaacttcaatgaattggatctcactatgtaaatttggttttaacggacaatcctcaactcatgcctgcggtatgctcggtccttcgagggacaagtgcacgtgtgcgaaaggagttaactcatgcagcacggctggccgtctatgtaaaacccccatttcatagatatatagcttcaggcaagcgggtcagccatccatatgcgataatctactttgtccgtgtagaaaaacgttttgtatagtagtgtcttactccgttttgttgttccatttaaaataatgtatgtatgttttctcttaatatgtagatcattttttaagttgactttcataaaagatcttaccccaatcctacgaaatttgaaaaagtatgaaaatcgcaaaaattagcccgtgcgtgcagttgatacatgactaaacagcggaatccgcgaatgacctacccaatacaaagttagtgggagttatggaagaaatacaataatggacaaacggtgggccttacgcacaaaacatgaagagctaattagttgctaaatgatgacatctttatgtagaacgataggatcatatatgatccggctgatttgttaggatattatcatatatgattagtttgcagtttatctctaggattactcatttacttgagatctaaaccttgtagctctatttatatcgacgcttgaggcttaatataattgatgaattgaaccataaatgcgtatacatgttctcgtacaagtttccacaaataatactaatcaaaattgccagggaactattgttcaagaatcaacgttactaaacatgggtttcttttataacacaaagggagaactgagtgcttttctttacaaaaaaaaaaagactttgttttgtatttttatcgaactcctgcgaagatgtcgttgaatttgtatgttacaaatggagcctaagtgcataagcaatttgtatcctaaaatcacatgtttatctctttgccaccgttgaagcataatgcaggctcatagagttttggaatattctgtagcttggagatgtgagctatagaattaaacatagttatgtagaacttattcttatgaacgtaatttattcataagtttgacactagatctgcacatgtatattatatatactcctacctcccatagttttataaagcttaccggcctttcgaaacaacttctataaactacagctatttttctcgagggaagccttgaaagaccaaccgtgtgtaactgccagcatctctactatatagcgggtatgaatgaaaaaaaaagaaggctcaccggccaaagatataaaaaaattgtactaggattgttaatccggagaatgctctcacccctaaccggtcttcttgaatccaaggcgccaggttcgcgtaatccaggagacagccccgcaccattttgcccagttgatcgtttgtttaagccccactcccttacctatgttcagttgttcacacacaacacaccatacacccccaacacaatgtacaacagtctaacacacccataccagcataccgccgtttgaccagcacaagtggtactccaggacaccggtgctcccactcgtcggacgcaacgcatgcgaaacagggcagtaatattttagtacagggcaatattttgattaaatcttaacaaattttggcaatgctaaaattttagcaatttgataatattactaagttttgacaggatttcttatctatttaccagagtttgataaaaaaaactaaatgaatacacgtatttaacaactttatcaaaaatggtactccctccattccaaaataaaagagcacccgcaatggtaaagtaaggtgctatctataaaatatgtacatctcagcaactagattaataatataccacctcaatagcatatctacacatgggtatctatagctctctaatccgttgcctcgtttttctctatagactatctccaggttagtagatagctttgctctctcttcatttaatctcttccaagtaggaaaatatgctgatatggatatcttgtagagagcctatagataaccattgtggatgccctaaggcataaccacccataacccaaaaaccaagaaaataattattatcttgtagtttggatcatcctaataaatacaatacatgcatccaatagaattagagaacatgagagtggatgaattaaaaaagtactaatttaatggagaaattgttatagttaattgtctacatgcatgcatgacttatattatagaatatttaaaaaaagtggttgtgacttatattatggaatggagggagtatggtttgaaattatattgggcctgttcagattaatgacattttcaaccatattgtttatttggtaagaatgctaattatgtggttatgtttagtttgttatcaaatattggcaatgtgcatagaattttagcaacattatcaagataattctaataaaaaatattagtaatattatcaatttatcaaaattttggtaaggtatattttacccatcaatctcaaccacaccatagccggagcagtaataatggagataaccagcggctgcggataagcggagtggccgtgctcacaacgcagtggtggtgggggtgcggccggtgacgccgacccggtgagcgcgcgcatcgtgattccatttttgcagcgatgtgaaaatcgcgcgcgtgccgtgcctgcgtcccacctggcacctgtcctaggagaggggtactggttactactgtagcgtgatggcgtcgtgattgtgcgcaattatattccctagatttccgggacgactcggctcggccgtccgtcgccatcgcgggtccgcgggggcgtccgaaacagccagctgcgtccgcggttttgggagtccaggtttccggttttgttggagtaggagaacgagaaagagagagctccaacttcccggccatcgtcctggccccaccggcgcatgtgtgttttcctccccatggaatctggatacaggtggctacttctggggtctaccatttctttgaggcctttattgattgtcgtgagaaaacacaaacgttctaaaaaaaggaaaaagaaaatcacacagcagcatttatactcgtataggaggagaacgttctgagaggagttatatatggggctgcacgaatcctttcagaacttttggtgcgtttttcccatcgaaaagaaagggggaaaaagaatctttggaagcgtttactgttaatatcctcacagaaaaaaaatgtcctcacggaaaaaggaaaaataactgtggaagcgtttactgttactagtactctttccggaacgataatactccctccgtttcaaaatatttgacaccgttgattttttagcacatgtttcatcattcgtcttatttaaaaaatttaagtaattatttatttttttcatatcatttgatttattgttaaatatactttcatatacacatatagttttacatatttcataaaaaaattttgaataagacgaatggtcaaacatgtgctaaaaagttaacggtgtcaaacatttcgaaacggagggagtacttatcgtcttgacaaaagtacggtctctaaaaaaaaattaacacttattttctattataataatatgtataaaaatattaacaaatatatgattttattaaagtactatttaaaaccagtctatacatgtagccatcatatttgaaggacaaatattttaaaaagatttataatcaaagattctaacgtttgacatcacctttatataaaaagacaagtattatcagcccagagaatgtatagctcaattttagaagcaataaaaaaaatccgtgtgttctaataaatgtggtataggaatagcattatcttctccggcccaattttggaaaaaaaaaagatctttggtccgcaagcatgcatgatgccatgatggtatgatggatacaaatgtagttctatcgtgggattcttgtgtcgctttcttcaagctgttgggaaaacgtcaagtgggtgttctacgacaaaataaaatagagggttatgtcttccttttcttttatttcctgaagacaatggctcagcgcccccttagcatgaattaaaaaatgggtttatgtaatctcaattccacgtcacaggataacacaatctagataaaagatatatatattaagtagagatttagggacttcattccaacaacttactacgcagtactaactattaattccaaaatttataggtttactctctccgtccaaaaaaaactcaatctaagaggagattaagtttttatgggacagaggaagtaatttatacatactagatctgaattctagctagatttataagactcttcatcatgtacaacttggtatatatcaattgcaatttttaagtatttattgtataaacaataaaaactagttatgtaatataaaaattaatttgtaaacttatatggttttcaacatataaaaaatttggaaatagttattcaaaaatatatacagataattatatattatataattgaaataaaaaattattaaccagtgcggttatatgtatatttatcccagtaaattgctattgtactccttcaagattaatgaaattttcagcaaaaagagacgtggcaaagcacacaaatacaactgatgttcccaatcccggatgaggcttccctgttccctcggtggtattcccatccgtgttccgttggtatcaacggctgagattacaaacagcgggacccacaccttcttcttccttgagaaccggctaatggcatcaaccactaaacaaactaattagattcagtatcgagccaccatctcttccttccaaaacaaactaattagacttggacaaacatgccattactaataaaattggcaagccgacgacgaaacctctcgtaccatgatcaacttgaattgtatcaaaaagttgaacagaaattgaatatatcataactaagattctcaaatatatttgtaattcaactatttacgagtcaagtgccatctaattttcataaaagacaaatattcagcgccatggagtcatcacgtccatgacggcatgattttgtttcagcaaccatctagtgggtaattaaacacgattataaatctagccgcgtgcgggtgatcggaattttgagggatctcccatgtttctttactgtgaagattccttttcttgtgagttgtgatcttttccgatgaatgaaattaaagggcactgatcatatatatggatagctcgatgcaataaatgctggttctcaaggaagaagaaggtgtgggtcccgctgtttataaactcagccgttgatactaacggaacacggatgggaataccaccgagggaacaggaagctgcatcccccaatcccacgggccacggctgggccaaaggaagattttttccaaaactctgggggccaccgtctctacctctccaaaccggtcggtttcgcacaggttcatgcatatgccacccacggattggagcgattccagcattttagagagcccaagttggctgtcaatccagagtcaaaccagcgaggaaaggaaggagaacaaccgcccgcccccgatgccttgggcggtgcagcggttttgcttggcggggagaaaaaatattgggcgagaagcaagcaaagcaagcgcggccgcggctcgtgacttcccaacggctcccacttccgcggttttcctccgtgcaacttggaatggaatactgtgcttattttattactactactgtttggcggaaaccgaagcctgatgaggaggagatgagagaatccggggcccgtggttggccgcctcgccagctgattcttacggatgatgtagtatagtacgtgtgaccggatcacgtatccggggacggacgaggcgagtggtgcgcgggcgccacttgcgtgccgagttgccggagccgcatttttttttttaagggaggaggggggtggggtgaaggaatccatggaccatgggcgtctggttacaggttacatccccctttgctcagggttggaacccgtacgtcgctctcaccgttggttggattggcaaaagactcgcgggttgaatcctggattggctagagagtctgtgggttggtacgagaatctagcggcgggcacttgccgcgtgatatgacaggttattgggcggtccgaagaagtgggcggcgcgagctgcaccgccgcgcacactcagctattaatccatttgttttatttttttaagctagttcttaattaatcacttcccgaacacatgatgactcattagcacgtgattaattaagtattagtttaaaaaaataatttattaatatgattttttataacaactttcccggttagcagtttagtaagcgtgtgcgaaaaaaacaaaagagtgaagttgggaacacagactaaggctgccttcatctccttgggctggaagcgctacctctggcacggaaaacggagtggtccattagcgcatgattaactaagtatttgctagtttttttaaaaaaaatgaatcaatatgattttttaagcaactttcgcatataaactttttgcaaaaaacacaccgtttagcagtataaaaagcgtgcacgtggaaaacgagtgagaggggttgggaatcgactggaatgaacatagcctaaggctatcccaactcagaaactatcaagtaagtttctatacttatcatgttatataaacactatgttgaaactatgtattcaatagataatatcttcaaattaagttctcatccaaccacatccattccctccccttttattcacataaatatccccttttttcattcttggttcttgtgtagagatggtttcttccatgagaaattgtttctttacctttttacccctctctctcctcattaactctttttccacataagatttttcttatgtggtaatgtatttaatgctatggacactagatgacatagagggttgggtggcctaaagttgtgttagtcaaggttccaaaccactactcactcgttttccatacacacgcttcccaaaatactaactgatgtgtgtgtttttttaaaaaataaaaagttattgtaaaaaatcatattaatttaacttttaagtttttagctaatacttaattaattatgtgctaataaacaacctcgtttttttacatgggaaaggttcttaacatctacttaattaatcatgtgatgtccgaattttgtaatagcacataattaataccactactagtattttactgcctctatccctaaattataggacgtcctctttttaaagaaaattaaacttgatagattttgactaataatcatactaaacatatatatgctaagtattatgtatgttatatcactagattcatattttaaagtacattcatgtgatgctagtttcatatttattggaaacataacatggaataaattaatagtaaaaatatgtcattgaagaccttataaaaaaatatagttgggacggagggagtatttactgcacaaaatttacactccctcccacataggcacaccagtgtcaaccagagtttctacaactaccgataaccgcagtaaccacgacagcgtgggggtatagaaatttattcgagttcaatcttaaaaagaaaaaggaaaaatctcaaaacatttggagaaatattacattatttgtaatgaggtatggtgattttttattttttgaaatattctaaggctaacttcatattttagcataacaacaaagctgcattgctttaaaataaagatttgatgctcgtggatagtatattatgttcacaataatctctgtggttatgacagttatattatggtttatttttgttgttgtcaaacgtgaggttgtgatttttatttttcttagtggctttcattatttaagtcacaaataccacggttatagcatacggttaccatggcttatcgtgcacaaaccactctcctatgttagttacgctgtgccctgacccgagtccccacatccacatttatccacctgcaacctgatgaacacaacattagagccaggaccgtagaacggaaatgtcttctaaacaactcgatagaagaaaaggggcctatgtatttgtataacccctacggatttgaccttacctatacctagaacaaatcccctagcagcacgctgtgaataggaactcgtgtgtaaccttgaatttctagcgtaacagcaacttgtactttcccagtgagtttataaggattgacacccatatcccaggaccatacaaacccgttacatgaaatttgccaaagctaaagaaagccacccctacaagaaataaatgaattccaaagatattggatgaaatccaaagaaggttttcccgtatgctcatcacagaatatttcgaggtcacaatatacccacggtgaaagctatacaagtattatggcagcataacatataggcctacgctaaggtcagcacacccgtgtgatttttgaaaattttgaattcatttttttagatgaaattcatgcggttattgactgttaccacagaaactgcaagaacggtttttttttctttgggggtagtttaacctctccaaacggtaaagaaaacatgggagtagcatagcttgaggactattgttttaaatatgaaaatataaacttttacatatttttttaaggaatatactggttttcagaataattgtaaaattatacccgattcgccaattggattggctaatccatcggatggcgctaatccatcggatggcacggcatggtgttgccaaatggcttggaaacaaagggacatggcttcgccaattcctctaatgattcttgtgtaattcttttcatataaaaaaagtcaattttaccctcaactatttcattggatcacttactaactattattttttaaaaaacttatttacccctccaaaagattaaaaatggttcgctttactatctaacgttatttatctttcttgtttcttcctaacgttgtattatacacaaaaatttttgtagaatttttgaaaccggtgtacttttgcaaaattacgaaaaaatagtaatattttcaaaatataattcgaagactttgcgtgtatggcagtgggggccggcaaacaacaaacgtgcttgcatagcttgctagatatgactgattagtctatgcatattgaattagatggcagacactaaaactaagtgcttcccctacaccattatcattttttcccttgataattcctccacaaaattgtataaaacatattttatattagaaataagtctatgtacacccacatctataaaatgaaattgtgttgtctagcatttttcttaagccgttcgatatagaatatagggtggatgttgaaacacacataatgtgctttggatctgtatatcttcaggcccagtaaatgcttcctgggttcgggctttgtgggttttatttgttttgtgggctttttgtctctgtggttctctgtcggcctttagactaacaaattggagtatgtgatttttctgtagacttcgcatcagtgggcctgtgcgtgctttttttaaagagaaaatgtatggcttcttcttgcaaaccaaggaaataataagttcacttaggtcatttaatttgtcgcctagtttgtaattcgtctcaaaaccgcattactagatatgacgcgtctgtcgactcctaaaaccagagttgatgtggtatttcactaacctttttcgagatctgatttgttcctgacgagttcacatctttgatcccaagacaaaattaatgttcgaaataaaaattatctatcatgtgttgatgcaccaaaagttgggaggatacaactaatacctgtgcatgcatgccatcccctccccaccttaggatgcaaacaaaaaatactgcaaaaaaaaaatgaaatttagtacgtaattttgggattgattgttgtatttattcctacagctataatatttgtcacgagaggcagttgtcacgttggcttaacgattctcgtatttacctttatgcaaatctcaaaacgacttccttttttggctggctagagagagtacaagaataaccaaccaataagcggcaatagacatcaagatgaacgagacacattgtgaataagtaacaaaacatacacacatatcacatatatacacaagttgggtgttcatcgtcttcggttctgcaacagatgccagctacatggatgatactcctaaaggaaacgcccttactttacagcaacaagaagcggatatttatttgcaagataatcttgactatttacacaatacattattcagttatctgaatatcatctaatacggctttgtttattgcattgttgaggataacacatcgacaatacacaaagatttttattgagattcggaaagcttatttactcctgcttcttcacaacaagaactgggcacttcgaatgatgcatacagtaattgctgacacttccaagaaacaacctgcagcagcaataggcaacagttagataatccacgatgagttttatgtataaattggaaattaattcatgcaacaagcaattgatttatgctatatccttgtcttcgataatgctatatctggaatcaggagagctttatataagtaactgaatagttgtctgatgtaatcagagttattcttttacttgataaaactgttgttcaagaaaagatagttgaatgcaaagagttggtatcaatgtcattgtagaaatgcagaatgtccgatatgtattaggcctttggaatttataaggaacataacaaaacagaagctgttgagttgagaaaaacaaaagaaaggaatggaactgaaaagaagggcaatcactacatctgcgtcactcaatgataaaattattagaagtaatattttatcttcacctgtaaaatatattactcttatctttataatgtacagagtacaataaacttaatgattatgagcagtttataaagagcaccaccaaaacatgttcagttgacaacgattaatcccataggtgaaactgaggcttttctttgctgaagctaatggaggttttctgccagtccatctagtcttgctcactaaaataccatattattaggatctacacaaaaaatattatttatcttcacccataaaaaatattactcttgtttttatattgtgctcctcagtaaaaccatgattgcaagcggtatataaggagtcctataaaaacatatcagctaacagtaattatctccataggtgctaggtgcaactgtggatttccttattgatcggaaggtgttacagtcttgtaccaatccatttagtctggttcatgaaaagatcatatctgttggctgtgtacatccgtttggatgtagaggccggtttaatccattatctaaaaaaaatatgaaaagatacaaaaagagcctaatccaaccataatacatacaaaaagagcaacatgttttcagtttttcatcgaacatataattctattttgattgttcatgcagaaaatataatctatcaactataatctataaagaaaccacgatatttcaaactatacctttgtacaggtccacggctgtgactcccaacgatcagtaaatcaacctttgattcctcagctgcttgacatatcatctccttaggatctcctactttgatcattgtctctacagccacctgaattgtaggtacaatattacaaggattacaatcactgaacactaatccatccacatagcacagtgttgcacggaataaactgaagatctcctgtgatttgccttatccttatgacctcacgctaatttatttttgttagtcggtcatacgttgccattcgttataaaataacatagacaaatttacgacaatccaaacaattatcacaattctaccctccctgatatgatgtgtcgattgtaaaatataaacccagtccatgtggtctagagcagggttagtagatacaaatgtagtcaaatgtataagatgacgagacagacaagagccaaaccgatcacaagctacaagctagtatctcctactatttgtaactacaagctagtatctccagttacctaattgcagttgcaaacacatgaaattggacacctatggcattttcccttactgatatggccaaacaacaaaaaatgctgaatatcttgaactagtaacaactaacaacaatgtgctgagtagttgagcagcgaccaaacaaacacaagaggtcattcatactgatgtactgcacatcctgcttgataattcaacttctcacaagtttaatgaggagaaattatggtcatagtaggtgcggaaacaagcacataatacataccccatgctgcgcgcagatctgcttggccttgtcgaggagcgcctgcgagagctgctgctgctgctcctgcatcgccttgatcagctccggggctacaacgggggtgcccactatcacacacgcggagcagaagaagcacacaatcccaaaatcaacaacggattcaagaaggggaaaaagggatcaatccggtgaaagaggaggaaaaagggatccgcgtcacgtacgaggggagccgaaggaggcggcggagacgtagccgagggggaggagcggctgcacggtgagcacgagcagcggcggcgcgatggtcggcgcgaggttgcgcagcgcccactccagcgcgtggtggctgaactcgctctcgtccaccgccaccatcgccttctgcagcttcggccccggcgctgacggcgaggccattctcgcaaccccttgctacgctgacgctgctagctactaccactgctgctgctagatcggtgagagagtgaggagtcgatcttgctggcttggccgctcgctcgctagaatgctcggtcgatgagatgagatgagatgatcaatccgcttggtttgctattgatggcgaattggttggctgatgagtaggtgtgacaactaacagctgacaaatcacgcgcgacttggaagtatcaaaatttggctttggatcaatttggatgtgcctcatcaggtccgagcttcccgaatgcggtggacacttgcacgacacgagagctccgcgacgaccgctgcatagccacgtggcacgacgatgcagtagtacgacattttgcgtgtcgacgtcggcacgatgaagtaatcaagtggagtttgcttttctcgatcagttttagttagggtgtgataaagtgatgatggataaaattaagtttttgacaattattaagagtacaaataaataaattaaatattagtatcgtgggaaatgacatttagatgcctttgcacatattagtacagtggaaatgcccttataaaagtaaactctttgtagcacgaaaaaaacaatttacaccctttatctcaaaataaattaacgttttacctatacatctaaataagagttataactaactttaacttattatattttaggccagaataactttaggcgtgcccatgctaatccattgtcaacaaagaacacaataacagctgttttcgtctgttaaagttcccaactacccgcacttagtgtacatgtttttcaaactgaaatggtgcgcttttaaaaaacattctatatgaaatgaagttgctttaaaaaatcatattgacccatttttcttaacaaaagtttagctaatacttaattgaaccgttttccgcgctgggcgcccgaatacagtagcatccacaccctctgcaattagtgctttcgttgaaatatttccctttccgtgcttgctaacaggcccaaaaaacacatatccaggttaaactaaggagcagcactatccagattaaattcaggagcagacagcagtgctattttgccgagagaaacacgggagccattatcaagatcctaagtgaggcattgctttgctacagccattttagcagtaaaaaaaaagttcgcaaaatctaaatggcagaagcaaatctaactgccgggaacttattacagaagtggctgcatacaacattcgtaacaaacaaacaatgaaacaaagcgaatgcccatcgagcttcagaaattgccattcatgcagcatcccagccagaagaaaatgaccaaaaactcactgaaaattgaacaagcttcccaatttctccttgcattgatatgccaatcaacaaagtatgctctgttgtcatagctgacagcctgacatgttcatgtacctatacatatgtaatggaaaaaaaaaacagaagtgagttagaagatggacacacgagagaaatcagttgatgaaaccccaccaataaaagagcagatactggattttagtagacagtatgcactagagatacaagatagtggttagcattttattggatgtgagattaaacttaagcccagtttctagactataaaaacatatgctagattagaggatattgacagtagacacaggaaacaaattagtttactcagcttgcattgtgtctaatgaaaaaaaaaaacctgtgcagttttgcccattcatgcttgcggtcagagttccaaactagtttgtctatagaaagtgaacaacatcaacacagtttgcttgaggtcaaacttcccaacaaatttgtctaaaatagcacacgattctcaactcatgttctcaagctaatttctggtagcactagaaactaacacttgccaaaatcattatatgtacacattgctacgaattggattaagttcatttatcttccaagaggacttgtacattactaatataggttacagagtaaatactggaaactggatggtgagctattgaacacactatttcagtaaaataaaatatagcaagcattgcacatcttagtttactatataaggccaaaagcacaacttaaataattacctctagataccctttcctcccttgaggtaaaaatcagcgaagtttctccttcacagaatacttcttggcagcatcccgcaccttttcaatatacccttcaattggtggcgtgagtgttgccatgtatcggtttgcagggaatggtgtcatgtcaggaatcatagcagcagctcgcagcttctcagggagtgctgcaatggcctccttcttgagacttagaagagacgattctgcagtttgccgtgcgcggtgccgtcgcattagcacctgactgtattgtttggcaagtcgccggccatcttcgactgtcagctcgtatttagggattgcgtcctcatcaaccaatccaagactgatgtagtcaagacctggtggacccatcagcacacggccaccatcaccctcacgggtacctttggacttggctttagccttggctaaatcaagttcacgttgacgttccttagaaatgagtccaagctcctcacgtttggcctcacgaagacgctccttgggggatagatggcgcagaggagttgaggcattcagacaagactctgcaatctgagtaatacgctcaatagcctcacgacgaccacgcccaccgccaccacccccaccagtggaaggcgcgccgcccttctttgctccaatggtgttacgcttcaattgttggccagacttgagcttagccttacccttggctgttccactcactggcgcatgctgttgaagctggtgatgctggcacgtcatcccagatgccaatgccgggttgatagtaagtcccttgaaaagacgccgagacatgctaatggatgaacttaaagccattgcaccacctaagctgcatgaatcaccatgtgtaaatcattttatcttttgtgtctttcatagtgaaagggtgatttttttttcaagacaggtggtattgtcaattataagaatgctaaatatatacatatatttttaaattaaactctaaaaatatcacaaaaaggaacaggtaagagaacactttaaccctcgagttttctgcaataacacaggttccttttaataacacagaaaagtagtaataaactaacatgttcctcaaaaaacatagatatgttatatacttgcaggctgcagcaagtaagatagctaacgagaacataaaagttgcccaaacaaactgcactgaatcaactgcacaagagacaattttacattcctactcccttaatgtgccacagagcaagaaacaatgaagatgactaagcattgaaacagcaacacaaggagaacatgcggagttgcggcggttaatctgacaaagcaatataaacgcttgtaatcatcaggactcagggggccatgggggtgggcccaccggcccaggattgaacttggttattcgcaatgggaagagatcattttttttttacaacccaaagtctaatagttgtataatatatagcggtataagcataatttcataaagtcatagataaataaaattgaccataaattgaatgtgcttagcatatgaaagtactaaactactaattgacaaaacatatcaaatttatagaggatggaaaatggcaaaatgataagaaaccatgaaccatgaaccatgaaactactaattaaattactaaagttcaattgttcaaatatatgcaataaatcaaccatgaaccatcccctggattcaaatggtaaaaaagttcctaaatcctaaattcacagcacttagcactaccatctaacagtaggcattaggatttaggcagagttaccttcggcctctcggctctcgggacaggaaaagtgcggtggtgaatggtcggtggacgaacaggacggcagcgcgccgacgccactcgccaggcccgggcggcgtcgcgggctcgcggggcgccggggcggtgcgggtgcgacggcgagacggggcgacggcgcaggccgcggggcgccggagaggtgatgaggtcggctacggcgcgatgggcgacgggcgccggcgcgtcctcgcctggcggcggctgtcggagagagctcagagaggagatcgatggggagaagagttagggttttttggttttgggtttttttctctctattgggggttaatgggccggaaacgacgaggagagaaggagggtgggaggatggcaagcccaattaagtaaccgttcttttctcaaaaaaaggttggatgaaaatgtagatatttatagcacgatttcaaactgcttgctaaacggtatattttgcatgaaaactttctataaagaagttactctaaaatatcagatatatatatatttttaaatttgtaataataaaaactcaattaatcaaacgttaataccacattgttttacgtaaaacacttaatcttcatctacatgaattttaaacaccaccatatctatgtgcatattaaatatatatacttttatgaatacccatttgaatacccatgaattacggtgggcctgccttttggggattcatttgacttttgggggcaaaaattatatgctatcagtaagttcaggcaaagagaaaag

SEQ ID NO: 32618 - DNA, 4845 bp, Oryza sativa
gacggatactcaccagcaaacgacgagaaatagcaaggggggggggggggtgtggcgcccgcattgctgctcgcgagatggagatcggctccggtggtgggtgaactcgcgaggccggcagcagtgggtcgacgaaggtgggatgcttgcctagagagtgccttggtgtttaggggctgttcagattaatgctattttcaatcatatcattatttttttaagttgtcaaaaaatttttacgtttagtttgttgctaaatttgataaatacataggaaatcctgtcaaaattttagcaatattgtcaatttgccaaaattttggtaagatttattttggctacaatctgaacaggcccttagctttttatctaaaaaaacttacggcaatttatttaaaatttgccaaaaatataggtcgacagtctaaaatatactataattatatttgaaagtcttcttttaaagaaaaacttgcgatagttttttagcaaattcccaaaaatagaagtcggttggctggaaatcacaagtgtaacaccatatcgaataatcaaagttcgaacatgttacatcagacggtcaccatacgattagctggatgtgtgatgtcaaaagctcgtctaacggttgtcgatagagttgttggctagactaaaaaagtgaaagttcagaatgcgagtgcgtgtagggtgcaaaatctactccctctatttcatattgaaaaatttcatccactcaaaccttttgaaaaatttctatggattgaaatgtgcatgcattcctatagctctattttcatagattgtacacttagcctagcgatgccccatgggatctttttccttgtcggcacccaattgccgataggttactgattttttagaacttggtcctttttcttttttttttttgcaaaatttcattaaattataattattcgaaaaaaaagtattgtaagcactatgcagcacctcaccaaaacgcacaacgaataagcgctccctgtttgccagtccaaacgtcatgcactactgcaccagcctcttaacacaacgggaatcagctagagtttcctgcatccatgtaaaaataaaaggggaaaatatcctctgcattacaatctaaatttgactaaaagaactacgataacatcttgccggtatgaaacttttggcccgtttgtatcttttccgtgatagctccaggactcaatgcccaaaggataaaagaaagggtgaaattacagatcctgatcaacaggacgcagggaaatatccaaggcaacatgttctcattctccagaaaactataagcaccacagccagatcacctctcattaagcaccgcagccttgttgaccaagctcgtatagcgaaaggacaagtggtcgataagttatgcagccacaagatcaggggtctctgcctcaactgacaacagtgtagtgtgaacttttccgacccatgcgtccagccgctcacgcaaggccttcacctgtggaattccaagtactctaggctggacccatgacacgtgaactgtgctgtccacctcatcaattatcccttctataagatgaacctgcagtggagaaaatgcatggcagctgatacactagcgactaaaataatttcaatatttgactactccctccgtttcacaatgtaagactttctagcattgcccacattcatatagatgctaatgaatctagacacatatatatgtttagattcattaatatctatatgaatataggcaatgctagaaagtcttacattgtgaaacagaggaagtactagatagcctgcttttcagggtgagaatcatgtactaatgatttagaaagaaactgtaatggaagtctgaaaaaggtggaactggaaagaacggtaatgaagctgatgcattagcactaggaatactggctgatgcattgtgcaaacactgaaatagtattaaggcaaaaggaagtgacatgcaacaagaaaagaaacagggctgtgatcatccaaacgaaaagacatgaatcacaggactagttgaactgccaacacactcgtaggtcattactcaccactaaaggttcacaaaacaaaccataaagaatcaccaagtaaattacaagttaagaaagtcaaggaattgacagcagtgatatgcatcacaagttatcaacaatcactattccagatccagctgcaacataaaccggcagcaactcccaagcttaaaatcaatttatgcataacaacaatgaatttccatgaaaatgcaaataatatcttatggaagatagaaagtaggaaatgcagttaccgagaggctcttcataagaagatattccacatcactgatagaaagcttagtgcgctcagctataacacttaatgggatagttctgtcttctgatggccggctacaatatgaaaaagaacacaaggtttagaagaaagaaaacgatggaatagggcatttgttcttgtcatataaaagcaagtagcaaagtcatacgtaaagattatctccatcagacatagaatgttgatcttctctagcagttttcgttcattctgcaccaaagctggctgtgcactaagagcagcgttgtggaccttgcaaagttcttggtagagagctaggttgccagtgttgaatgcttgcaacatatgatagacccactccaccttggttccaattagactgttgatctaaggattaaaaaatagcagtttcagaacagagatgtatcaaattgacaactatatgctgacatagatttaggggccattcaagcattaaaaaaacaccttgtacgcatttgtggaataattctgtttgggggctgaaggcttccacaggtcaatatcaattttcccaacaaaaaattagtacacctaagttaattttcaactaaagatggtttgccgttaatttatgcaaaattaagtttacgctgtttccattcaaagaaagtacaaagcttccgtaataacaattcagtggtttacatttacattattgaaatttcagccaaaaaacaatcacaagttatcacatgatttttcattgtattttatattcgctacatagcaaaaatcatgtcaatcttaactccatacattcaactcatgaaattactgttgccaatttagcaataaatgttgttaatctgcgtacagaactacaaaaccacgaagcctaactactataacacacatgcaacttctttgggagccctgcagttcacattacaaagcataatttgtaaactgattattcctgaggatgacaacaagccgcatgtaacgtttatagaggcaagtggagttaatgccataatcaagtaatcaactagcacaaatgatatgactaaatgaaaggtaggcagtgggaacaaagaaatcatgcccaagaaaagcccaacttacaatcgggtgagctaataattccccaaagttgtatatgttatcaccaagcaaggctgcaagggagagatcaaatgccaaatcctgacacatgacagtgtcaaagggtaaattatcaatacaaacaatatgcacagtatgttgttattaaactaactaatgagaggaggaaatgctattttttttctgttatgtaattggcattgttaataccagcttgaatgactcagagagcgactccacagtagtgtaggccagataaagaagagcattcttatagaattcagcgaattcttggcaagccttatggtactgagatgatatccaataaaagctagcatggactgtgggatcaacatcagtcatgctatcaagggtggatttcccttcatccaaaagcttcttgcactccttttgatctcccttctcaaggttaattgcagctatctgcatcttgacatagagaacgggttcatcgatgcgccgttccctcgtctcgcgcagttttgcggttaccccctcgaggaaactaatcgcggcatccttgtcagggtactggcgtgaagcgatgaccgcgaagtgggcaagtttgagaagattgatcttcgtctcgaagtcagagatgaaattgttgtagagctgtatgatggtgtcgccagtctgtgggagaatgaatgccgttagaattgcaggattgcccatcagttaaaaccctaagcatatggttgttgaagtaatccaagattgaaacattcagctaagtctacacaaagtggtggcttcttgcggcggccggatcggtatcagggcagggccaactcaactagggctgagatcgagcacctacaaacgcggcgggtagggtttgcggcgagatccgtatggggggcagtggctaacctagaagaggcgcatctaagaggaaggggaaaagtgcagacctgggcggcggggagttggaggaagtggtcgagcttgagggtgagctggtgccagagcttgcgctggtagaggtcggcgaggtcggcgtaggcgtcggcgaggtcggggcgcgcctggcgctgtgcctccacgtactgcagcgccatgggaaagcttggaggagggagggatctgtactgtagaatcaactcttgttggaaggaggaggaggaggagcagagccggaggaacaaggatacttgcgccgtgccgtcctgggctcctgccggaggttgggatgggattcccgtactgggcccggccggcacgaagttgcagatggtaacacggcccggactggcccagcccaccatcaccatggagttcccgtgggaggaaattgattgattcgaggaccgctacgcgcgggtggcaggagccagtggctcgctccgtgccgaccagcctacgagtctggttcgaccccctagactc

SEQ ID NO: 32619 - DNA, 76426 bp, Oryza sativa
  unsure (1)..(76426): unsure at all n locations
ctatactactcaatcaggaataattaactattttccacttttacgaatggtcataaaggatttgccattaaactcatatgttatagacacatgatggtacacatgtcataaatagtgagtgttaaatccgtaattgtcacatcttaaaaaaggcaaatagttaaatgtaacactcaatcatacttaccccatcccataaaaaataaatatagaattgaatgtgtcttattttaatataggacgtgactacatatctagtggtaattgttttgtctaaatcaactaccacatcatctatgagaaaccctatccatctatacttgaaataaaatcttctcttaaatacttatccgatttatgattcgattacaccgttgtgttcgtaacaattaaatctttataataaaatctcacatggttatattttgatgaaaaattataaattactttataatatatctaaattacttttagatttcactaaattacttcttagacatataaaagtaaattcaataaagcctaaaagtaatttacatatattatagaagtaacttataacaaagagaaagtaactttaatgcatacttttttcattgtggacgtgactacacagttagtgatagctggtttgtactccatctaatgtcacattttaacttgaaaaatgcaatagtatgtatctttttctaatccctttaataaattatatattttaaatcacatattgtttttaagatctatttgcatcattgtactccacccaaaatatgtgacaaaacgagattcatattgattaggaaaacgtacgaattaccccccctccgaactatcatggtcgtctgaattacccccctgaatcacaaaaccggacattcttcacccccaactatgcaaactggacgaattacccccctcgacccaatcgacagtggttttggtctacgtggcgtacacgtggcagtccagtcagcgtttctttaataaaaaattatggggcctgcctatcttactcttcttcctctctctctctctattctctctctctcgctcgctcttttctctctcgcgcagcgcgcacggcgaggacgagctcggggacgggcggtcggtgtgggcggtcggcgaggtgaggcgagcgtggcggcgcggaggcggacacatcgttgattcgattggcgaggtgaggacggcggcgcatggggggcggagccagttgtgggtggcggagcgggcccgaggacgacggcggccaccggaggcggaggccaaccgggtgcacggggacgcgcggtggccggtaggctccccctcctcgttgtgggcgcacggggacgcacggggacaccaccgccactgcagctcctcctccgagccgtcgcgccgcgccccatcccacctccccgtgccaggatcggcgatggagactggcggacgcggttccaccgaggacgcaggcgtgaatggcgaccgggaatcccgctccaccaccccagatccaaatgcgagctcggtgatgacacatggagcttgggtcggcggccgcgcgtgcgtcggcagcagcggcggcggccacgacagcaacaatgccggcacactagtgccagcgccggtgccggcgtcgtcgtcgtcggtgagcgcggggaggccgagccggcggccgcggtggtggcggatgtggctgcgcgagagcgaggcggtggtgatggagtcgacggagcagagctggagctgtgatgacgctttctctcgtggcccaatcttctggtgagggggataactctcgctttgatcgagtgcgacgtttgcgatgtggctaccaaccagaacaagtccaggacgcctgcaatcgctacactacaaacgatgtcgtatcaaccgtgacgcgcggttgatgatccctgcaatgcaaacgagagaacactgcaagaacaagataagatgcaatctaaatattgcgaataggtaattaagcacaaatgaatagttgcaattgaagtggtagatctaatcgacccagcaaatcaacacacaaactattaggggctctgaatctatagtccttgactaatcgaatgaagactagagacaaggtgaatggcacttggcaaaattcaactaaacaaaacccaattgtttttaaggatgtacaaagctatttatagaggaaaataaagctagggttaagtgctaattcgtggaggtggagggagacacttccgagatgggcctagtctattacaaggcccaagacccaagttcggtttgagcaacatcactgtcttgttttggtgattcccgttgactcgagatgaatttggacatgagaccgaatgcgtttgaaaggtagcgagatagctttccacaaagtccaagatcacccaaatcggagttggcaagaaggcgctaggtccgtttgaagtcagtgctgtctccggaggccgaaatggacttggacttggaattatcattggaacgtgtgaagttatgtgcgtttccgacgaagtgatgtcctcatcatcctccccttcttgaattggagtcgtcctcgactcaatcccatcttcttgatcgtgttcactctgtcgtccaggggtcatccttggaggtatctcatcatgaaaagcaccctcatattcctgcaaaaggttagtaacagcgagtagcaaagaatataaagtactggaagcagtagccaatgtgggtatatgatctttgcaaaatagaggatagcaacaagaatctagctcttctagtgcacaaatattatatttagaagctaacaaagcacccgtcaacttaatttcattctttgtggcacttggttctgttgtactaggtgaagcaagattcttagtaataatctgattttcacttttcgctttcttttcacattcaagacttgcaagatcatctttcaaagcagcggctggagtcatagaatgcaaaacaactcttttaccatcgaatataaatttatatgtattagtcctaccatcaaaaacaacttctctatcatattgccatggtcgccccaaaataacagaacaagcttgcatatacacaacatcacattcaatttgatcatggtaggagcctatagaaaaagtattttaactaagcgggttaccttcatcttaccacatgtattaaaccactgaatatgatacggatgtggatgtggatgggtagtcaagccaagcttcttgaccatctcttcacttgctaaattgttgcaactcccgctatcaataatcactttgacggtatggcctttcacaagaactttgctttggaataaattgtggcgttggttttgctcttcacacttctctttagcactaagtgctagcttgacaattaggctaggatactgatctagcgactctggatgcaaatggacttcctcgatgtcatcgttatcttgtcctcctacatggtcagtggcaactaaagcatattcatcatcacaatcactagtagaagtatactcaccatcatcattcacaaatagagctcgctgatttggatagtcgcgggcaatgtgtccaatgccatggcacctatgacatgtaatatcacgggtacgtccagtggaagctaccgaagttgcactcttggctggagtctgaactgaagcatttttgcttgtttcttgagcatgggatggcgtggaggtaggtggacgaacggccgtagtaaattgacgtggtgttgattgtcgtgtggaagtagcacctgcaaaagaactcctatgcttgttgcgtccctgcacttctctttcagctttgcaagcaaattggaataatctattcacggtattgtattctttgtattcaagaataccccgcatctccaccaaaatgataacaatccggcctaggtggggttggccgaggcccaacaaattaaggttgcctggactcaaacagttcttaggcacactaacttggggaaaggcccaatctccctaaaagactaatccaataggggaagggtggctctcccttttaaggtgtctttctcctcccaagctaagcaaggtgggattattcagaggctcacacggtcgccgcccgacttttgcgtctttgccagcggataatagtggaggatgtcctcatcattcccaccctcttaacaagggcccagctctgataccaaatgataaagatctggcccaggtggggttggccgaggcccaacaaattaaggttgcccagaccccaacagttcttaggcacacccactcggggaaaggcccaatctcccctaaaaaaatagtccaataggggaagggtggctctcccttttaaggtgtcttccttctcccaagctaagcaaggtaggattattcagaggctcatacggttagcgctcgacttttgcgtctttgccagtgggtaatagtagaggatgtcctcatcaagctggtggacagcatgatcaagatgctgtgcaccaatggcgtctggtggctggaggacctgcaggacctcctcgcctgctacctctcgctcaacgccgccgagcaccaccgcaccatcgtcgcactcttccgccgcgtcatcctcgtctgaatccaccttagcagcagaggcttcttcccagccaaaggcttcttgctgacgcggtgcagcctcctgccgaccgcccgtccccgcactcgtcctcgccgtgcgcgctgcgagagagagagagagaggaagaagagtattacatgcgggacgcacaatttttaattaaaaaaacactgactgtactgccacgtgtacgccacgtagaccaaaaccaccgtggattgggtcgaggggggtaattcgtccggtttgcatagttgggggtgaagaatgtctagttttgtggttcagggggggtaattcagacgaccgcgatagttcgagggggtaattcatactttttcctattgaatatattcaaacatttaattaatttaaaagtaatttattacatgttagaaagtaacttctatgttatcaggaagtaactattacatcttatacatggttaattctcattagttattccatcaatgttatttacaatccatcaaaggttttatcttcttttctctttctacatgaaaaacaaaaatgaaaggaaaaaaaatcggtaattaaacatatttatagagagttacttcttaaccatgcaaaagttacttccaattaacattgaagttacttttgaaaaacattgaagttacttttaaaaattgttaaacttacgtgtgttgatctgtgctgattaaatttaatttctagataaagtcatatttttatccctacaacgaatttacttctaatgttgtgacaaagttacttccgttttgttttaagttacttttataatatatgtaaattacttttagactttattgaatttacttttatatgtctaaaaagtaatttagtcaaatctaaaactaacttatatatatatgataaaagtaacttatttatataataaaagtaattaacaaatataaatattttttcatcgtaatataatcatgtaatatcttgttgtgaagatttatcgtaacgaacacaatggtataatcggattatagatcggataagtaatttgagagaaaactttatttgaagaggaaaaagacacccacgtggatggacgccacgatgacgtgcacgattagacggctctgagatgtgtcgcactatacagctaaaccgagagcgctctcgaaatagatttcccgtttaatataatgaatctgattgtccagattcgttgtacgtcctagatttgattttttttatggactagatttgacttttttattactgagggagtataattttggatttccgcattttcctagagcacaccacaccagcaagcccgcccgcagcatacctcctacgcttagcgctagtagagattaatgttaaggtaatagcgattagcgttagcatgccgatttttggcaattttttcattgtattttataattaaatgtttcatcttaaattttaaaatattctattgaaaattttcaattcgaatgttgaactcagatttcaaaacattcgtctcaaaatttaaaactctcaactcaaaaattcaaatctgagctgaaagttttcaaatccaagttaaaaatttcaaatattgatttaaaagttttcaaatctgaaatggaagtttcaaatcttgacttaaagttttcaattctgagttgaaaagtttttaaatcttgacctgaaagtctttaaatctaagtttaaaacttttaagttaacttaacttaaaagttttcaaatcttaagttgaaggtttttaaatccgagttaaaaattttcaacaagagaaaaaggagattggataaggtgtgcgctacttatcttgctagtgcatatgtgttaaataggattccagttccactagagaggtgccaaaaaaaaattaaaaaccccatctccacatatctcgctctccataagttgggagtcctccttgtttctatccacggatccgaacgcgagcacgaggaactgttggtaggaatgggtgattttttatattgaaaaatcagatttcttctctaccgagctcacttatcaattgtagggaatcagttttaggcatccattggaaaagacgactattttcatgcatcaaattctgtttagggttctcaaattttttttttgaggatatatttttttaatatctcttggtaacgttctaaccccactagtttcgttctaccttggctcttcccttggacttcatagtttgtcttagatttcgtgaagatagctttagcattttcccttctaggtgtattcatgttttctttaaaaaaaattcaaaatactggtgcgaaaacgatttagattgatttgctctaaggatagcaactgagctagggcttgtcacatatggagtcgctgtactaaggcgacctaagaaattctgttaaaaaggattcttggtatcctgcaagcatggggtatttcatatgttggatggaggagtaagattagagtcatcaatatcctgtgaggattatacaaaaggtttaccatattcacacatccacgaacccacccctaaacacgtgctcaaatagccagaggtcggcagcaaatctcaaaacctcactaaatctatctattatattattaaaggaatagaaaaaagaacctccacgttcattctcatggcctagaaattctcacattaatcggagaaaaagaaaaagcagagtccatatagaaatacaatttagaaatagctgaaattcagaattaaaaaataaggaatattagaagaggagactagagtccatatagaaatacaatttagaaatagttgaaattcagaatagaaaaaggagcctccacgttcactcccatagtctaaaaattcttacattaataggagaaaaagaaaaagcagagtccatatagaaatacaatttagaaaatagctaaaattcggaattagaaaataaggaatattagaagtaaagtatagagtccatatagaaatacaattaggaaataatataaatttggaattaaaaataaggaatattagaagtagagtacagagtccatatataaatacaattaagaaaaaaaatagaaatccggaaattaaaaaataaggaatattagaagtagagtatagagtccatataggaatttaaaaactaactaaaatttggaataaacataataaaattaaaagtagagtttagagtccatataaaaatataatttacaaataactaaaattcgaaattaagaaaaacatgggaagaagagtttaaggtcagagtacaatttagaagtaagtgaaattcgaaattaaaaattaaaaaatattgaaagatgagtttagagtccatatagaaatacaattagaaataataaaaattcaaaaataaaataaataatattggaagaagagcatagagtgtatatagagatacaatttacagaaaattcggaataaaaaaaagaaatattaaaagacgagactagagtccatatatgaatatatataatttacaaataactaaaatttgatattaaaaaaaattattaactaacacgtatataaaatataatataaaaattcataaataaaaataaataatattggaagaagagcatagagtctatatagaaatacaatttacagaaaattcagaataaaaaaagaaattaaaagacgagtctagagtccatataggaatatatataatttataaataactaaaatttgatagtaaaaataattaataactaacatgtatataaaatataggggcaattgtattcttgcttctactttgcagtttaattgtgattttacccctaatttttagggtttgtgattttactcctgcttttttttaaatgaagcacccgtttacccctagttttcacggtagtttgatgggcccggaatttcccaataaaacgaagaaagaaaatgatattatagtttgtgaatgaccatcccttggttcactaaaagggctagccagtaaccacttctcttgctggaacgatttccccaaatcgaaaacctagcgacaagcggcggcggcggcgacgcgcgcggcagggaggcgcggcggagaagggcggcggtgttgcgcgcgggcagggaggcgctggggagaggagcggcatcgtcgcgcgctaggcggacaggcaggagggcgcggcgcggcgtgcgcacgcgcagggaggcgcggcagccccgcggccagtgcgcaggagggcgcggagcagcgggcgcacgcgcagggatcaaaacttttgtaattcagggggaggaggacacctgcagcttcgtcttcctccgtcagtgccttcgctaccgcctcctattcgcagaggtgatttgatcgattcagcttggagttgcattgagccattggttggggacgctgatttcatcttcttgattgcgaatcggggatggatgtgaatgtgatttgcgggtttgtaggctgactgggaaggtcgccgtcatcaccggcggcgccagcggcatcggcagggcgacggcggaggagtttattgtcccaaataatgtgttctaatcatatgacggagatgctgtacatattgtcccaaataatgtgttctgtcatcttttttaaattgtgtcaaaattattgctaaaattctgtcaaaactatcctaaatatagtgttctgtcaacttgtacaaaatttgtctaacatttaggtcccatattaaatacgcacaaatttaacttgaaacatgtccggtgttcatgccaaaattatagtagaggtatatttgtccattcactacacatttaaaaccattacatgaggtaacatagtaggggcaagcagctgcttcatttaaaaaagcaggggcaatattacaaaccctaaaaaaaaaaggggtaaaatcacaattgaactgtaaagcggggtaaaatcacaattgaactgtaaagcaagggtaagaacacaattacccctaaaataaatatgatatgaatattacacattagtagttttgtaaagttattgcaaaatttaaaattatattgttattttaatatatttgaataatataatgagaaaacatatatgctattacatgagagaaaatataatgatgctaaccacgcaatctgcgcgggccaccatgctagttcctatttaaagcacaactgcatgtttgtaatatttgtaggcatcaaaatttaaaccccgattaggatgcatccataactccacacaacacgactattgattcttcagtaaatttcaagttttgctataaggctaaatcattggtgcttctgaaaagtagatactacttccgtttttttaatagatggcgccgttgacatttctcacatgtttgaccattcgtcttattcaaaaattttatgcaaatatataagatataaatcacacttaaagtattatgagtgataaaataactcataacaaaataaattataattacttaaattttttgaataagacgaatagtcaaacacgtaagaaaaagtctaacggcgtcatctattaaaaaacggagggagtatttgctacggtcaagatttttgttagcgtatatatgccacatgatgtttgacctaagacattacaagcatttagttcgttgggtcacaaaatggtcaaatgcaagctctagcagtacgacactgtctgtaccctgctcacctgctggctgctgcagtgctgctgctgcttcatggaatgttggagctagtttagtggtagtgagcaccgaggggtacaaaattactctcttgcttcttattacaacggagacataatcacaaaaaatgtgtctgtatacatatattcttgcaatcttgcgagcatcgctctatacacgcacgacgacccaaaagaaagtgaaaaagaaaaaacaaacaaaaacaaaactgatgtaccgtgcgtgttgtcagccagctatgaacactaagctctgcctgacggccggaaccgagcaaatgagcgaaccgaagatccccgtcaggccgtaagcgatggcgcagaagggcagcgcttcaggctccttggccgacagcgctgctgttcccagtccatgagcactgcaacgtaaatgcaaacattattcatagagcatactgctgtatgtatgtatatatatgcagcttaacttactaaaaaaagcagccagcaggtaggtaaaagtaaagaaatttgctatctcgtggtataccaaatcattttcgatcatttgatctaaatcgtttccgaccattggatctagttatgtaggatggacattgttagatctaacgatcggaaacgatttgatactgtgaacccgtgaggtatcggtatctcgaaatactttttgttggaccggaacaaatctcaaaagtaaaactcaaaggtatatatgtacctggaagccgtccctattcctcgcgcgatggggtcgttgaggccaagcttgtccatggctgcttgcacaaaatttgcgccgatcagcccggtgaggacgacgaccgcagcggttagcgaagaatttacacctgcatgcccgggacacacaaactaagtcatccataccatatataataagctagctgagtactccatattatatatctagctgatcgaccagcaagaacagaaattgatttccagcaatataagtatgtactaggtccgtaccttcaaagaaagacacgatgctcagagccaacgccacggttatgcacctcggtaatattgatatggtcagtgaaggctctagccctatcacccgtcctaggatggcagttgagtataacgagaatgttgatgcgatggcaattgatgtgaaaatttccgctgcatgcctcttcacaagctgagttttacccaccgcaaaacattattagttgattagccaacacacaccagcaacaacaaacacagagcctcaggatatatatgaatcatctcacaccataaccatgcatgctaactgagaataattctgcagaaacagcagcaagcactacctttctctgcttgaacattgagaatgcaaacgatatgatgactgaaccaagaaatcccatcaggacgtcaccagctccaggattagatggcgcctttgtgaggtaatcacctggcaattaaaaccaacttatttcagaattcacaacttgattagagcactattgatcagggtttagtttacaacctagcactgcatcaactccagaccgggagagatacccatatgctattgctgccaaatctgcagagagtgcacaacaaatgattgggtgaagcactttcttgacaccagatggtatcctgccaagtaatcaataagacccatgtatgttgttagagaaatggagtaaacaaggcagctggtggcttcgtcagatcttacagattaagtgtatacaaaaagcatatgtatttacccagaaccaaccatgtatcccagtacagttgaagcgaggaggaaaggaagacatgttcttgccgtggtgccaagcgctgtggggttaacatacgcaacagcaaacgatgcgacaaagacagcaccccaggcccagaattccagcgtcgcgaacggagacggcttgctcatcggctcagctggtataagctgtgtctggacaatcttcctcacggtgagtgctgtgtatccggccaccatgagtgaagcaaaccagccaccaactgggaaatgaaaaccagataacatcacaccatcggttttttcagattgaatgcaaattaatctgaaaccaagggcatgtttagatcccaccctaaaattttacaccctgtcacatcgaacgtttgaacacttgcacgaagtattaaatataggctaaaaaaataactaattgcacagattgccactaatttgcgagacgaatcttttaagtctaattgctctatgatttgataatgtggttttacagtaaacatttgctaatgacggattaattagacttaataaattcgtctcgcagtttactgccggattctgtaattagttttttttattagtatccaaacaccctattacgacaccctatataatatccgatgtgacacggtaaaactttacacccctgaatctaaacaccctctaagtaaaattgttgtgatttatgaatggggccaatccacaatgcaagttggtgtggtaatatttactgcaagttaattgatcagcatatcaaatacgaagtagtagaatgtaaaatccggaggaagcagaggcggagcagataagcacgatgatcaggaggaagaaagaagtagcagaatgcatgcaacgataggagcgtagtgatgtgcatacaaatgatgaggaagatcttgaggccggaagcagccgggacgtccctgacggcgagcggcaggacgaccagggaagggacgtagaagaggggcagccacctctggatgaagagggtggccggctcgaagaagtccatgaaccccttggcgagcgcgggcgcgaaggcgtcgaggacgacgaggacggagaagacgcagaacatgccgaagagggcgctggggaacttgatggacgccgccgcgaacgcctgcttcaggaacttgtcggaggccagcacgatccccagcgacaccagcaggtgcgcgatcccgacgagctataaaatccatacatagctcacgcatgtcagttcgatcggcaggtcatgcgaaatcgcgacgaggctgcgtgcattttgactgattgacgactcacgctgggtaggcccgagggagaggtggcgcccgcgcctcctcctcctcctccggcggcggcggcggcgtggatcggggcgatgaggcggtggcgaggattggcgggagccatggagattgccgccgcttggcgggaggaggaggaggaggaggaggggttgcgtcggcatcggcggggaggaagcgtgcggaggcggggcggcgacgtggcggtggcggagggcgaaaggcggcagcgatggctgctgcgtagcgaggcaatcatgcagggggaggatgatgatgaggtcgctgccatctcttctcttctcttctcttcttctccttctcctttggccagcgagagagcagtggcagtgacagtggatgagaagggagctgggagcagtggcagaggccaggtggaagagaggagggcggcagagggatgcaagtgtggccagaaaattgggatgatttggggattgggattgttgggctaccacgcgccagcatatcgtcgttgcttttaggcgtgggtattcgattcggtttacactagtatggtctatgtttggtaaaactttaacattgaagaaaagtaaactgaaattatgattggaaaaaatctatctatctatctatctattaaattaaattattaaaacagccttaaaattaaaggagacaccgtatttattgtgcaggctaaaaattcccacattaatcgaagaaaaagaaaaatatctaaaccattggatcataatagatctagattttagcggtaagatttaatcagagtttcgcaaagtatatacacaacaataaaaaccggacaaaaggtaatatcaagtcagaaccggtttagaagttcaaaagtcgaaaaggtttattacacgtattccaatagctcttatggaattggaagcttttacagactactactcctgtcacatgacataaaaatactactacgaaacgctataatacacggattcacatgcaatagcttttctagagattcctatggccaaaacttttacagcaaaaacttttacagattactactactattcaccgaaccggctgattcctatgctgatcggattcgcatccaataaataccaagcaatcccacagctaacactacgagaggtgtgtggctttttgacattttattaggtcataatatatgaagttgacgtaatttcaaacgtcaaaaagccaccgtcataaatttagtatgtgacgtttgtacatctattgtcacaagcatatgacattgctttattatcacaaaatcctggggcttgccacgtggcagctgacttggcagttgacatggttgaaaaaaaaagtcacaaaataagattcggcttgctaaagcccatgtagctcacgggctacaaaatttttttttctggggttgtttctagctggcccagtatattatttgcttctttttaatgagtgcagcctgtacaaattttcagcccacaccaattcggcccatatgatttttctagcccgcacaattcagcccatatgattttttcaacccctacaatttagcccatatatttttccagcccatataattttttcagcccacacaactcatctgattttttcagcccatacaattcagcccagatacaatatttcagtacatacaaaatcagattcaaatgaattaacattccacaaatgattgcaatatcaaatgcatttcacatttcacaagtcttaaaattcaatatcagtacatccatccactggcagtgaattgattggccaatatctgattgaacatagagagattttaatgaacaattccgcagaatatgaagaatgagaagaattgaaaatacaactaactcgtttgttttgaaacaaaccattccctcaagctagctagcaacattgaaaaactaacacaacttgcactgtacttatgaagtgcatgcatcgtatcgatcaccagattatgctaaagagatccatcaagcaaggatgcatttagaaaacattcagattaaaatcagttatgatctgtagttcaactgctaaaacttttattgaggtcaacaggttacaggtagcgaataactcagaaccaatccaatgggccaatccgtgataaaagaaaaggtggcaacagtagatctttatattagatgaggtcttatacttgtgtgatactggaatatcaattcaagctattttctgctagctatgtcataataaggtgtgagatttgggtacctgctacacttttttttaatagtagcccaaaatctttatatcatcagcagattgatccttgtacacataaggaccacttaggtaccacgaacctgcagcacaatgataatattcttcaacacatcattgatttgcttgatcagggatgtaagaaaaattcaagggggacaacataagagcaatcagacaacaatatcaagaaaaacagtagttacctttttgtatttgtgaaatttaaagaactactactatgccggaccatgccaatcaaggttgaaaataacaagccaatatgaaggcaaaattaattagattcatggaatgcaattcggttgcacgctcctagcacggaggtcgggaacacaacacaccttgtgcttcaataaaatgtctctaaagaaagatgcatcatttcttttaatatatctgtctttggatccactcaaaccaaattttaagagattggtccttgggcaggttcattgtgaggcaatctaagccttggtaatgaaaagataaacactcaaattcctggaccagagaaatggatcaattttcatagtcagaattagaattgttccatgccaagtttagttcatctaataggtactactcaaatataggtctttgcccttgcttgaccagtgaaccgttatcttataaaatagtaaaaactaaaagtaaagaaataattgcacgtatggatattaccttcatgttgtgcttacggagtatatgaaattagatacatcaactagagaccaatcaatgctaaataaaagaacaaaatctcctcgaccaacatcctggatagatatggagacatgttgatcatctatattaaggagttcatgtggtcctgctcctctgcctctgtctgaagtttgggtagcctgaaacaatggaattgttaaaactaaacactagacagtctaattagttgactaacagttgtcgtactgattagttcgccaattccccttgacctttgtcaaatgcaccttcatatgcacaacaatttactcacatagaaattccattgaatatcttgcaaatgaatgaaattgtgaatctaacactacagctaatgatttctagaggaaaagcatactcactgaataaacgaacccttttttttcttgagagcaagcataatgtaccttgtttgtgtggatatgttgtttaaccaaaaggagctccaagacaccattgtctagagcctccatattatctagagcactataaacaaaatatgctagctgtgtactgtttagcagtcccaagtcacataaaccaagctactaggaataaatcataattgagcttaatcattgattttctacttttgtggagtatggaacaaaactacaaataaataacaaaaccattccttgatatgtctatatgtacatatcacgaaacataatgtatatacatgaatattcaccaaatgaagtcatatccacgctgttttgtgtagtgagcttaatcaagtagctcttggggattagcaccggatcaatagggcatgttgaactgttagtcgatacagtagttagatgcacacaaaccaccacatgaccactcacgggtgaaacataataaagaaccttaggattatacctgaccgtttaggttcctattcttcttgacctggcgaagaaatatttcagctcctgcacttttctattgcagcatgtacggagataaatcaaattgattgctgcatataatttattatagaatttgtcatgttaattcagagtgcaagggaaacaataccttagaggtaagcactgtcaccgtctgaagtagctagaaggctctcagaatacatgatcgtgttgtagtgtctagagattatttcgggtaaacactctacataatctttctacaagcctttgcattagcattggacatgtatctttttctaattactctgatttctaatcctttaaccaaagtctcccatgtgtatagcatagttcagttaatcagttggtgcaaataacatggagccatcacaatttcgtcatcagttggttgcaaactgtaatgcctgaaaaaagattgaccaagaacattaacaacaatatttagcttctgacaaagttttctctccacacagcaagtgtaacaacagcaggaaaaaagtaattttcttaataaaactcgcaggaatatcaagcgacggagggtgcgcaggtgttggcggacaggacgacacaaccggcgttggggcagtggaggaggatctgacgacgacggctgcatggcagcgacggtggccgtcgcgagattgatggcagcgcggagagaggatatcggcgaggcgaaggacgacgcggtgggtgatggggaggcggacgcggcggcggtggacaggacggcgcgacatgtgttagggatcgagagctggaccaccgttgccgagttcaccccgtcggcggatctgacgacgactgttgagccggcgaaggggactcggggatggtgaccgccgcgggattgatggtggcgctgagagaggagatcggcgaggcaatggcgggcaatggcgggtgatggggaggaggaggacgcgacggcggtgggtgaggaggaggacaacgcggaggcggtgtggaggaggcaatgcagcagcggtgagtgtgaaggaggacgacgcggaggcgatggggaggaggcgatgcagtggcggtgggtggggaggaggaggacacggcgacggtggcaggtcagggagattcggcggcgcgggggtgtggcaggaaggggttcgagagcggtagtagcgagtaccgcgggcgaagtcttcgtgcggtgatgggagcgaaaatcacggtggagataggatggagttgcggaaatacttcccatctagcgtccgatcacggcgaaacttcggacgcctcatcatttcctcccccatttgaatcacctttttaatgttacatgctaatacctcctcatctctttatcatgttagaaactcaggatgcaacttttgtgcaagtatatatgcatacgtaagttgaatgtaatctttaaaatcatttttctccaaaactactcattcagtctatgatccgtttatttcagtgtattcgtttcaattaaatctttacaataaagatcccgccttggtcgcccgggggagggggagaaaatcaggcgctccccccgcccccaccacgtgcgcacatgctccccctgggacccaccacgtctccccggtcacactgccacgtgtctccaccacatactccattacaacaaatcacccacatattttgaaaaccctatattaagggaattcgtttcattttttgttcaaaaaaatgtttcactatgtatagatctaatgttgaagtgaattgaaacattcttttgcaacaaattacccacatattttagaaaccctctattaagagaatttattttatttttttgttctaccaaaaatgtttcacctagtgtatttatagtgtttcactatgtatatatcaaatgttgccgtgaactggaacattatttcgttatttgctgaaacattgtttttatataaggtgaaacaaagcctgatttaaacgattgaaacattttcgatctattcagtgaaacaattccaatatacctggtggaacatcgtgcaacatttaaaaataattcaataattagctaaaaaaatttcgtcagaatatattcatgtgtggtcttgttttgaagatttaattgcaacgaatttaatagtgtaatcggatcataatttgtatacataatttaagagaaaaaatagattaaagtgtttttgcacatatcagtgcatgtgtcagaaatataacataacaagcgtccgtttttctgttatccatcggacgtatgaagtgtagtggtctccatggagttgctgtgcgagggtgaatcgcagtggacggtagggatgagagctatgcggatgaggatgcagatgatgataggaccaacatgttgatttagcctgcagcattgcaaggagataactccccctttttatattagtatagatatagatatctacctctatatatcaatggtagaaaaagaaagcaaataatttgcttaaaggacaagaagattaattgaaatttgaaataaaatataaaatgaattccaaaatagaaaaataattataaaagttcaagtaggaatacaacaagatatcggaataaaaaatatggattttttttaaaaatagtacatctagaacataaagatgacacatgacaataaataggggagaagcaacaaacctataaaggaccagagtggtggcggttgattgaacatctaaaagctataaacaaaaccccaaatagaatccgacgattaagaaaagagacgatgggtaaaccattaagtagcactgtcatgacagttggccggacatttagaaagcaaaagaaaaaaaaaaccaatgataattatgttcgattttaaaatttcaatgacaataaagaggggaggcaacgagtaggttgtagagtagtatagtggtggagccgccgacggttggcgggacttctaggaagtaaaaaatgaacccaacaataattatattcgattttgaaaatcccaatgataaagaggggaggcagcgggcaggccgtagacgagtacaatagcgacatttgacggacttctaaaagttataaaaagaaacccaatgagacaattaactctaaaaacctaattttgaaatattccaacaagaataaatagaagttgcggtagatcaagcaagcaaattaataaagggatggcaaaggaataagtagtggactggtgtgacttttcaaagcaacaaaaataaaaagttctgtaaaaaatatataattttatattggtgctagccacgcaactgcgcgggccacccagctagttactttaacaaaaactacgaaggggaaaaaaatataaaacccaagccgaaaacccccaactacagtaaagtttttagtttaaaccgaagcaccggtgaatcaccttctccatgcctgggcagtgggcaacgagaagaccacatccatggtcgcgtcgtccgcgagccatcgacttctcggcttcaactctcaagggagcgcagcggccgttggcttcccgcgccaccacggtcagatgccgaaccactccgccatccactgcatctttcaagtttcaccgctcttccgccgccaggcgccaaccggcctccgttcaccagcgccagcacggcccggcgggccccagtccatcgccctccgttcgtgtgagtccgcatctccgccaggatggcacgtggctgtgtgcatcgtcgcctcgtcggctggcaaagtggcgattcgatagctgggtcctgggtgggtgtggtcgtgggatagaataagtctactttgcctctctcgtctcttaccctcgatcgaatcatctctctaaccataaaaccgggtataacaccttccacatcaatcaaaaccggtgcaaatcgactccttcgacggtgggggtgtggggataggcttgcgtctgagtgctgactggaggaggagcatcaacgagctcgatatccaacaatgaggacagttgttcctgcatctatcgacggccagaaatgatgggatgcggcagaggaggcaagaaggtggcgaagaagaggcgcaagaagcgaatgatggggtaccagacttgactaggaagacgaaggctgacgagagtacacctgacttgacaatgatggtatggctttgcttggatgtcacccatttatagagagatggtagataaaaggtgtggacaccccgagtattataccatccagtgtccaacgcgaccaccacatactattggagaagtgggatccatacacgcataaatagccactcgtcctcaatgtgtccatgatcgcggttgacaaccttctattataataaacgaaatgtcgagtagtgagcgcaagacataaccgtaagatagcttgccagtccaccacgtcatatgcccgtcaaccactcgaaggtggcgaccaaaagcataccccagtgactcgatccaaagcgctatccccaattatctcaagcgatcaaaacccgttactcgtgcttagctagtccctaggaatgcgactagtctcacactttcatcgcaagcaattaataaacatagcaagtaccataatagggttaaagtgcagcgaggtatatgacacataatagggtccgaggtctcaacatacaacacataaatatagcagcggaagtctcaaatagagttcataagcaaaagataaaaccggtggtgccacaactccactagggcaaaccaaccgagcaagagccaagctgcaagagatcactcattgccctcgccgccctcggcagagcaatgaccacacaagaagcataactcataaccggaatcctctcctaaaattgcagacaccggttaagtacaagattgtactcgcaagtcttacccaaaattatatatacataagggagagagaaatatgcaagctttctagcctacagtgggtctctaggttcaacatttgcataaagctaattttattgagcaattaatgagtaaaataagcaaggataagtaaatctagcatcattttaatttatggacagcaagtatataattctgaaatgtataagcaaatgagcccaaacggcgctctcatcatcatccatggactaccaaagtccataccaacatggcacaacatgccaacaccaccatcaagcataatcacatccataataatccacatttgatgctaacataactagctaacacatcaagcattgtccataaccgaggacgcggctattcgaatagattatactttgatcagaggtgtacaattggacccacacgaaatgaacaaagatcaaatgctacacaccccgtcaagtgcggtacacaagtgattcaagctcattaaatgccctttcttagccccaccccaaccacctataccacgctggggttcccgacgactcagtcacgtgcgtgcgtgatgtgaccaaggtgggcgcgccacgcaggaggcacccccggccaaacctaggcacccgaggccctccaaaggctacctgcctcacaactctccaatgtggtataaatgatcacagtagaactagtaagaacaagccggtcccaaataagacatgtggtaagtacgaagggtgcttgaatagatgtcaaaatgttcggtccttaacgacctagacggggctacttgcatcaggggaaaccaacctcccatcatcgccctatcacccgtccaagtccaacatatttcatcaaccattatttagtgtaagtgctcaagttttatgcccaataatgcaagttgtttatataccacaattaatagcactgtccatccctatagttctattagcactaagcatggctaagcattaatgaataagaaatcccaagtaatcccaacaagtggtaataggatataaggacagcaataacacaagaactaaatgcataaataggttctacccatacaccataaactgacaatattaatatctaggcaatgcatgcatatatatacgtatagattgcaaccaaatcatttttagagaaagtataggttctatatgcttaggtgcttgccttgctgctgagggtagtcactatcctcctcgggatatggctcgttactctccggaatctccgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtacattacaagtaaaatgcatttcaaaccaagatttcataataatgattatttttagagtaaattacatcactcacagctcctatgaaaaattatttcacagctatatgtgttgtcattatttatttatagatcttacaagttagaaacataggaatgctaaataaactcctaaacatgatttaagaggtagtttttccaaaaacaacaccacaacagcaaagagtactaaaatataagctcaacaaaattggtttcataattttagcttttaccaataatttcttacgaatttcataagagctagaccacacaagggatacatatagctatttatatttttactgggaaaaccagtacaaatgttggtcatttttattttacaacattgaagatcacgtttttcttaatccacagaaatttggttcactgaattcggagttcatatgaactagttatgaatttttaaagcgcaaacctctttcagctcaaaagctatctcagaaatcgatttctattttcgctcccccttttctccaaattccaccagacttcgctcacatggtagcaacctggacgtagggtcatgaggctaaggcctcgggctgatggcaagagacggagcaaggcctcgggctgacggtaagagacgttgcctagggctgcttcaaccgaaatcaaaagagattaacaccggatgagctgcagccacctcctagctgcaataatggagatggatgacctgttgaatgttgctgtagatgttcaacatgaagggaaataaaaaaaaaggcaccatggatggcaaggaagctcaccaaatagagggaaacaaagtcatgttgctgctgcaaccatgcaggctgaaaccaccactctcttctcctatttcaatctctctcaactctccatgcatgtgcaagatgttgggatggatggaaagcttggatgatggggattgttgtgatctaacatgcatgaattgatcttgggctattggatgggatttggggaggagaagtgagatgagagctcagcttgaggaaaaaaaagaaagaacaagcagtgaagatgaaaggggaggaagaagaaggggttatctctgcccccccccttaagtcctgaggtggaagcacgcccatgggtgtgttgtggggctaaagaggcacccaaggtcagtgacaagtgggcccaagtcgtggctgttaatgagggtgagagaggtaggtgaaaaactgagtacatattcgtttttgcaatttccaggatttattttctttccctctcttggtaaattcaatttgactaggtaaaactagttcaaaaattaagggatttgttgtggtgataggtgttggtttctaggttccatttttcaaagtttcactcaaaaattcgaaatattttaattctggtgaaaagatgaaattggttaggctgaaagttggtttgaattcttaggaggcctaaacagagagtaaaaattccacaaaatttatatttgttggtgataaataaactagtatttgaataaattattacacatgtaacttctgttcaagttattgttcaaatagaagtggtttcaattttaccgattagaattaattttgttatcgccaatgatcaaattgcaatatagtaaatatgaaatctaaacgacaacaaatgcacttctaaatacctggttatgaatgtagggctgttacaaaaggaatagaggagagaggtggaggaatgggggacaaatatggcagctattttaaaaaagttgaagtactgactatgatgtcacgtagatacaagtgggccaagtcaatgcgtcacgttagacgagactgttgtgctaactactaaatgaggtaaactgaccgttttgatagttgagtgatgacgctttctctcgtggcccgatcttctggtgaggggataactctcgctttgatcgagtgtgacgtttgcgacgtggctaccaacagaacaagtctaggacgtcgtgcaatcgctacaccacaaacgatgtcataccaaccgtgacgcgcggttgatgatccctgcaatgcaaacgagagaacactgcaagaacaagataagatgcaatctaaatattgcgaataggtgattaagcacaaaggaatagttgcgattgaagtggtagatctaatcgacccggcaaatcaacacaccaactattgtgggctctgaatcaatagtcgccgactaatcgaacgaggactagagacaaggtgaatggcacttggcaaaattcaactaaacaaaacccaattatttttttaggatgtacaaagctatttgtagaggaaaataaagctagggttaagtgctaattcgtggaggtggagggagacacttccgagatgggcctagtctattacaaggcccaaggcccaagttcggtttcagcaacaacactgtcttgttttggcgattcccgttgactcgagatgaatttggacatgagactggatgcgtttgaaaggtagcgagataagctttccacgaagtccaagatcatccaaattcgagttggcatgaaggtgctaggtccgtttgaagtcagtgctgtctccggaggccgaattgggttccaaaactcattggactttaatatcttgtagatcctccattcatccaacgtattctttggcaatgttttatatttctcatgcttggttgtatgcatatacttgatggccacatcattgagggagactatgtgtctgtttttttggttaagagaggaaaatctgactcggtccatagtcgaaggaggtaataccataatatagactttttccttctcgatttgcaagaggcccaaaccgaactatcaattgaacatctcaattgccatcagtttggtctaacctgacggcagaaacagattctctagagtagtctacaaagccagaactcaagaatatttcatttgaggaagataccacatacacttgatgtcgcaacagaagttcaccgagtgacttgaaaaaaatctacaagatatgataattgcaactgcaagtgtataagaattagggaaatgccgtacaactttccatggtcgtccctagcaatttgggggccccgtgccaaattcaaaataaggccttgtgttaaaaaatacaaattatatgaatagagcaaggctatatgtttttcacaaacgttgatatgtctctactaacattgtctttttatttgatctgcatcgcagccactggcccttcaatcaccttgcacttggccctaaatttcgagggcctatgcggtctctcacctcgcacttgctcagggatccttcaccttccataaaatgttcaacaaggtcagaggaaacattaattctgctctcatcaagcaccagataggaagctacaagtaatttcggctaaatttcccatgcaactcttaggccattcccaacccaagacactagacatagttgtcataaactccatatcatcaagaaactagtactagatatactctttcaatgcaaacaccacttttccatacttaaatttaatgtttcttatatcacatgatgtcttagatgatgtgtagaaactatgtgtcatgcaagatctggttttcttatctttcctcatttactcacttgctacatcatttttcatcctaggtgacaacttatttaatgctattgacaccattttagtcattaggttagggatggccttatgtgtttcatccatcctaaagctgaccgcagcattgctctagctttcgaacatgcccaacgtagtaaaatccttattactaccggtcactagtgaaatcatcgccaaataaagatttttattttcatcatttatatttttttattttcatttacatccaagggcaatggtcagatttcttttaccatttagcctccacacccctccacatggcgcttttccttttttatttgcgattttcttttttcctttttcaattttctcctatttttagcgttttcttttcgtgttttttttgacttttttcaatcttcaacacatgtgttttcaaaattttgagttagaagttttttaatcttgatttgaaagtttttatatcttaacctaaaaatttttcaatccgaattgaaagtttcaaatctcgacttgaaagttttcaaatttgggtcgaaagttttaaaatctaggttaaaagttttcaaatatgggttgaaagtttcaaatttgaattgaaagtttttcaaatttgagatgaaaagttgaaatttttcaaaaattgacttgaaaaaaattcaaatttcgattgaaagtttttaaaatttgacttcaacgtagatttcttttcaatctactagtaaaaaaccctgccaaaaaaggaaaatattgctaattaccataattagcactaatgaaactaattacagagctaaccgcgcagggcgtcgaggggggcgtggctgcgcgttacttccgtagccagtgtgcacgcgaaataggaatccctgcaattttcatgatcgggtaaagagaacacgatgtactacatcaacattacgatccgttgcccccaaatactatacaacgtgcatgcatggtatgtggtagttttttccgttgcaacgctgagacactttactagtataaatataataatcaaatatataatataagcttgtacaaaactttttgcctcaatactttctttaaacaaataaaaatatatgagacttaaggtttcatgaaatttatttatatatatggaaaacaatagcaactttatagaactctctccatcccaataaagcgtgcacacattttaagatttaactccctaaatatttaaccaacaataatttactggtaacatgcacatgcttacgctacggcttaacagttattttgacaattaaatatataatgagattggtataagattcacacaaaacggaacaaattattgggtgacttcggaattagacaattcattaaccttcataccaacactttaaccgaaattgagaatgcaaaagcactagtcaaagtgcaatgcagcatataaaaacagatagaagggattaaatctatcatctctttgcctctctttcaatggaaagacaaaatatttaacattttcatgaagcagcaaggaacagtcaaattttccaacaccaagaaattagttgaatttacttgctttgtctgtcgaatctatataattgatcgagaatagacaagtctcacagtctgctataaaaaaggacgtctttgcaaaagttgtttagtaagtacttaagcaggaactacttggccaacaaattatagattttcttaccaagtcaggagaatttcacactcatcaatttatctggaaacaaaatcctatgtgtgccataaccaatactaaagaaaatacatataatatagcactggtattggtgaagccgcaatcatcaagctgagcactatgatgacctacgtttcggtggtggcgacgcagaggagatcggcgaggtgggcgactgccagcgggcattgagcgtgtgaaaaaaaggtgggagagggtgcgaaagacgggagtcacaggaggtagatggtgggagggatctaggaaggctagggcaagcgtcgatctgggcgacctcggtggcagacagtacagggacgcggtgattagtgggtgagggttgtagaggaaggcatgcgaaggaaaatgggccgtgattgatttgctggcgtgtgtgattttcagctggtgaccctgcgtgcatgcgctgttgtcagatctgatgtattggatgattttcggacgttagatttgatgaataaggtccgtaggatatcaatgatgaactatagggtagattataaattaagttttatttgataaaaaaataatattattgatcgatatttgtatttacttttatataattatgatattattgctataaatatcataatatttaaaaataccattaattttaaagtggaagagtatttcataccgcggccgtccacgccacttgatgacacgctgtcgccagcggaagttcccaaaagtgacgaaatttcggcatagcgaaatttcgcagctcgacttggaaaacccaaaacggcaaaaagcacggagaaacaatccatcgacgtggtaatcaatcaaatcgaaagaaaaaaaatataaaagaaaagaaaagcgcacgcccctcaaagcagcagcggcctccccttccttggagcagagaggactagaggagcaccgaatccaaggtcgaggggaagaaaaaaagagaaaattccacgaataaaaattcaaaaaaaggaggaggaaaaaactgaatccccttgcggctcgtgctccttctccccgacctcgaggcaaggcaaacccatccttccccctggcctcccttctccgcttcgccggctcacgccttccctctctcgcgaggcggccggcgagatctgcctgcgccgcgctcccgctcgcgccgtggtcaggtgagccccatctcccggcccgatctcgtgcgggtttcctgccaattcgggggggcagggcgaggtgaccttgtcgtgtggttgttgttgttgttgttgttgttgttagggtttcgtcgcgtgatggcgtcgtcggggaagatggaggggccgtcggcgccggcgatgcggcgggacccgtacgaggtgctctccgtgccaagggactcctccgaccaggagatcaagtccgcctaccgcaagctcgcgctcaagttcgtgctccccctaacctgtccgccctgctcttgctgctgctttcgatcgcgctattcagattgcagaatgtgaacgtgctgctagtttagttgaatgcgttctctgcggcttcattgctcatggtcacaattgtttggatcagctgcagcaatttaccacatcagctgtggtgttcctcagaatcacttgaacttttctcatccagatgcatttaacagcgctgaactttatgcccatgtgtaattgactaatgatgtgccaattgtgtttattgaatggaccactgaacgcataacaaccgcatttttccaatgcaacatgaagaatgatgctcttactttattgtgctgagtagatatgtaacattatttctgaagaaacgatatgtcgcaaacatcattctagatgaaactgaatcaagtgtatttattgttttggattaaatttgggaggaagcattgaatgagagcaaaagtttctttgttgtacttgcattcttttctatagatacattttttgttagatgctattaccacaaacataagagcttactgtcttttccttatttttgtactgtttctgggttaccatagaacattttgtttcttgattggtgcaatactaacaatggaacagaaaagagaacattagagtgacttgtactctaatagtagattatttacgtgggattagaaactgtttggtcataaagggttggattagcatgctctatatgagcaaattccatggcaatgagtttttccttcttttggatatctatactttactaccttttgatgaccacatgattcttctttgggttattagtcctctctattaatgtgtcatctcaaatactgtcaccccattacaccctgttgattactgaattaggtctgtcatgtatttacatgtgtgatgtactgatgtgcttggctgctctatctattcattcctgcatctgcagtcttgatgattttctgtactcatagttcctgatataattgataggtatcaccctgacaagaatgctagtaacccagaagcatcagaactcttcaaagaggttgcatattcatatagtatcttgtcagatcctgagaaacggaggcaatatgatactgctggttttgaggtgctattctcataatctcatgctgactaccagactattttcgaacagttttttttgtgtgtattttgcttttactccaatggttctgcattcttctccttttctgatcaatcaataaggagaagtttggctgggataaatgaccagcaaggtgatttttggtggtgctgcaccgacatgtatcatactgttgctgtgtatttattagaccatgtgataactgatgagatttttggatgcttatttatctccaatcctttcttctgttgcaatgaagattagctaaggcagcttggtatataacgtcgtagactcatagagagagatttaatccctggaatctgtcaaagaagaaatggagattactcatctagcttgatatttattgtcatagatagacaatccctggaaaccacttaagaggtaatggagaacctgtatcctctaaacaatgacaaactattagaagcatttccaccatgtataactattttaattccaaaaccatttgactaagtacctttgtcatggataatatgcttaagatgataattgtaccaagtagccaagggccacagcttatcctttacaaatttgaactcagtggcattttttttgggcacttcaattattttgggcgtgtaggttaagatgtgtttgccaagtttcacatagttggcagaaataatgtaactttgttggtttgtaatctaaccatctgttgtaatatgctttcttaggcattggagaatgaaggaatggatatggaaattgacttatctaatcttggaactgtgaacacaatgtttgctgcacttttcaggtgactgtagcatctgtatgaattgttttctagaaagaatcgaggatcactaattgcctgctaactttcttacatattataccatttagcaagctcggtgttccaatcaagaccacagtatctcctaatgttcttgaagaagctatgagtggaacagttacagtgagacctctcccagttggatcatcagcaacgggaaaggttctgccaataccagttttatggtcttgtttataatgggacggctaccatatatatttttctatttataggttgacaagcaaagtgctcatttttatggtgtaacaataagtgaagaacaagctcagtcaggcattgtagtcagagtcacctcagccgcacaaagtaaatttaaggtatgaggttgattcttccttcaattgctctggaattgaagcttttatgttctgcatctctttgaatttcaggatattatttaattctctcatttgccaaatatttctctatagctgcttttctttgaacaagaaattaatggaggttatggactagctcttcaggtactttcgagccttcgcctttatataattgcatgattgatgtgttctgtagtttttctcattatttgtcaatggaatgccatgcggccatggattagtattactttctctgttcataaatacctggcgttttacactcggcatattaaacaacgtgacattttgcattttggtggataatgaggttctctgttgcacccttagcctccatgaataaatcaagcatcttggccaccttaatgaaaagaaaatgcacccttatctttccataaatgaatcaagcatcttgccctaaaaaaggcaagcatcttagccacccatataaaaaccgtttatctatatgagtttttatatgggtggctaagatccttttattttttacagcaagatgtaaatgcctcccttgcaactacaaatacctccctcgaatgaaggagattcacagcgattgtaaatgatttctccatggctgtaatcgtaacatagataaaatgacaccacataattgtaaatgaagtagtccgcagccataaatactatcagaattgtaatatagctccatggcactttttaggggtaaattttgattacactttgagctaaaaggttctaccattacaatcccattagtatttcattataatcaagcaaattctatttacatccatgttcatgagaccttacagtcaatggtacttgtttacgaccacaagaaaaataatgcgtgtacatgtagatccattacattctgtgttatcaacccaaaccaacaacaaaaagaaagaaggccctagtggtgacgcaacggcagtaactgccttgtgttctctaatgggaggttgaggtgataggagaggaggctgcaaggaccagcatgcaaggactctctgtcagggaaggaaggcagtgaaaccaacagtgtgacaaggtttggtggtggtggcttgagcttgtcgagcacagtaggctgccttcatcaccattctggtggataagtgggatgccattgatggatctggttgaaggagttttggatgcggtggcatcgagtgctggaggacaggggtgctgtcgatatatccggctagaggagacaaggccgcctgtagagcgctggaggtttccgctattgtcagatctattccaactcctgaggttgccactgctgggctgggggagcaatggtgtgtcattgtctcattgatggatccatctggtggaggagaggaggtgccatgttgagcgttggaggccactgccatcgtcaccattggtgttgaagtgggagtggttgggatgctgtcagctggagtaggattgagaggcggttgttgaggagggaggaagaggagtgggtagttagggttttggaccgtttgtactctgtttatacctgcttatggtcgaagcagtttattacagccaagattgacccatttactattgtgggctaccacttatgagtaatgcgagtggtaggggtgggagctctccaagagtccatggcgtagactagaagtatataaaaatttatcatttatgtaaaatgtgatatttctggacttctccaattttaattttgataccaattgtgcagtaagtgaccaatgcatgctgtacataactgtctgccaaatggataagagccaatgtttttctagctgtctccaagtttgcatctgtgtctctagttctgccattgacttctttattgcctctaatcacaaaagagtgtcgttttaggatgcacacagtcaacacaaattaattttgaccgtaattattatttggaacgtaagtttttaggcataaggacattatgtagccaagtttgtgacaacaagaacattaatattgtacttgtctaagttcttattttggttcatgcaataaactaagtgatcaaacttatgtcttttgagtgtgaaaagtaaaaaacaactcaccttttgtggctggagggagtagtatgaatggtcaacaatgattttttttttgttaaccagctatgaacatgatcttaatattttacattaatctgcagtttttttcttttttcattttgggtatgttaatgtgctgcatataaaaaaaattagaagcctagcttaataatgcatttggtaaacctgggcaccattacattgtaagttatttctatggcgccatgcttaatcgttgttgaatggcggatagatttgctaaacgtggcttgccacacccagcagcttgccgtctttgtgatcaagacgatgagattatccaacacctgctggtttcttgcatggtcgcccggcaaatatggattgaagtgctcgggtctacatgctatgatacccaaccagattcggttaggttttcgagttagtagtaccgagcaagcaagttcacaaactgaaacgaaaaggctcaactctttgattattgtaatagcctgggagatatggacatattgcagtgaaatgatgtagccagggatgttgtattagtagtgcgtttggtggaaatggagggcaccctttggtgtggtattggagcaaaggagcttgagagcttgttgtttgcattgctactagtgttggttgtgtattttctttatgtggctcttatgtgtcaaacgttgtaaggggttggatacttggatctgtttgttctttatttttcttcttctttaaatgattaaatgatacgcagctctcttgcatattcaagaaaaataataacctccagtttttttccgcacttccaggaagatagtcagaagactggtaaggtgacatctgcaggcatgtatttcttgcattttcaagtgtatcgtatggattcaacagtgaatgcggtatgtatgttctgctatatagctttagtttttatgctctttgggcctgatgtgatgtgagactttgctgcttcctactacagttggcaatggccaaggatcctgaggctgcattctttaaaaggttggaaggtctccagccgtgcgaagtgtcggctctcaaatctggaactcatatatttgctgtatacggtctgcaaacttactttatctgtttatatgaatgacatacctccgttctgatccatcctaattaatatgttcaggtgataattttttcaagccagctagctatacaattgaagcaatgtgtgcaaagagttacgaagacacaacacagaggctaaaggaaatagagtctaaaattctagagaagagaaatgatttgcgccaatttgaaactgagtacagaaaagtcagccactacatctttttctacataacacatgaaatatgtatttagttttcttttcaatttggagagagctttgatcgagttaaatggtgtgcaggctttagcgcggtttcaagaagtgaccaacagatacacccaagaaaaagaagcggtgagcacatcttttctcctctgaatgccttttccttctttcacaattgatacttcattgtggatattgtagagacaaaagaaatagtcatcgtatttttgccctctaattgtagagtctaacataactatgtaagggtgaagcagactacatagtgatgttttttagacatatcacacctaccgtttttttgtagtgagcttgtgcctgtttgaactggcacagcagcatattgactatgtagatgcctctctgttcttctagacagagggtgtcaggctagctctcaaacaatgtctctaaattcttacatgtccacattttcttgatgtctatcttgcaccggcaaacttttctttcatagaaaataagtcaaactagaatatgatttcaaacattcctttggagggcactttgaaaagcaatcactgtgttataacttgcaagaaatgtgttataacttgtagcctaggttaacagtcgtgtgttatctttcttattagcatatatctcttcttctatcagtcttgcagtctgaacgttgactctgaattgtgtgaatccatggtatgcttttctcattgcattgttagaaccttttaacggccccatcagttggctgtttataagcataagcgaaatggcatatttgtaaataaaacttttatatacgtgttcttaacgatctaaaagcaaaggctgaaaaataaactacgatgaaaaaaatcccaaaatcaactccaaatttaaggttgaaaattcaaatttggatgataagcataagcataagcgaaaagatgaggccataagtgcttggctccatgctgtgttcaaattctaagtgagttgcatatttgcagctagtacttgattgccaacactgatgtttggttatatgaatattggtacccactcaaactgaaattgcgtataattaagtctgcacagtggatttacatggttggtgcagccatgttcagtgaatgcagcagaaatactgttattaagaattgacttgttaaattattttgtcagttgacatgcagtttcttctgagctttcgtcaattaaatagtgtcctagctgttaatagtttgaagtatactccctccgtcccaaaataagcgcagccatgatttttttgtgtctaactttgatcgtccgtcttatttaattttttttatgattagtatttttcttgttattagattataataaaatatgcatagtacttcacgtgtgacttctggtttttagttttttcaaaagaatttcaaataagacagacgattaaagttgaatacggaaactcatggctgcgcttattttgggacgaagggagtacatagtagtgtagcttacagaaccgtgcgctgtaaaaatttgaaaccaaatggcatcaatttatccttcacaaaaattcatcaaatagttatatctaccaatatgataaagtttgtatcatattcttttctcaggctgaaccctgatgattcttcattacttttgctaataatattggattattgctaaagagttgtaaggtctgcaggttgatgatatgctgagagaaagggatgacatccactcctccttcacgaccgaacgaactatggtgaactctgttggagctggtagcagcagtagtagataccccactgagagtcccgagaatggtaacatagatggtaaagataaatcaagtaaaaagaagtggttcaatttgaatcttaataggtctgacaagaaagcttgagtaatctttcatcaaggatctttcgctgttgtacatttcagaagccctattgtatttgtgcgttgtgagctataacggttaccaattcttgggagttttgtagcattagaagttttggacacagaaagtcatgtattatccttctttaaattccatgttcctgtcttacttttcttccactatctcgtcttcctcttgctcttttacctctgttgccggtcgagaaattgctaaggtaattcgcactggtgttggaagtgggaactcgagtaggttctttattgcaattgttgattatttgtttgttttcggtgctaattatcccatttcagcagttacattgtcagaacgagctccttggcattacccattacttatggacgtattgtagtagccactactttgggccttttaaggtcaaaactttcattaatcagaagaaatattaccgacttgatcgcaggtagcaagaaaatcctggtattttttttgttcatgctaacgatggcagttgcgacccttttttatttatgaggtcatctgctaaattgccatcacgttgatcaaaggacgacatgagctatttcttttgggattagcattccgacaaaaatttggggatgaaatcaccagattttggactcgacacatcatcgtgctgggcatgacctgtaactatgtagccttggtgcttgtaaagtctcgtactttgtttgtcctaaaatatagtatttttgagattagtacggatattaagaaaatatgtggaaatgattgaaagaagattatgattagttgaaaaaaaaagtagttaaagaagaatggttataattggttgtgaggagaaggtaggtggagaaatagcttcattttagaacaagacatcatgctagaaatagctatattttaaaggaaaaattggttatatagcatcgaaagttcacgtttttggttttatagcgccgaaagttaccggttcactttaatagcatccaaagtttaccatgttcccatttttagcacttccgttatttttttcgtccgtcttgatcgttattgatccagccacacacatgatatgacatttctacccctcattgacatgcattatacttgtacttgtgaggggtacgaaacgtcatatcgtgtgtgtggctggatcaagacggaccgagaatgatcgagaattgacggaagtattaaaaataggaacatggtgaactttgggtgctattaaagtgaaccggtaactttcggtgctataaaaccaaaaacgtgaactttcgatgctatataaccaattttgcctttaaagatcgaggtaatataaagctaagggtctgttcgttcatgcatttaggaatgagtattgagttgcttgcaaaacgataaatctcattagcgtatgatcaattgagtattaagtattataaattttaaaaattattttaaaaatatttgtatagaaattttttagaaattgtacattctggcgatttaagaaacgaattgacggtaaaggagagagttgcataaggaaaatttcatcagtagtgaaaggaaagaaaaaagaaaaagaaagaagaggccagcactgacatgtcggtcccctggtcttcttcagacccaaacccacgcctcccccccatctccgatccgccgcgccggcaaatcccccacaagcccaactcacgccgatccacctccgatggcctccgccccgccggcggcgccggcgccggcgccatcgctggtagacacgctattccagcgctccctcgacgacctcgtcaagtccctccgcgccgacccgtcggccgccggcgagtccgccgccgtcgcgcgcgcgctctccgagatccaccgggagatccgcgcccccgacaccgccaccaaggccgtggcgctccagaagctgacctacctctcgtcgctccacttcgcccccgtcgcctcccacccgctcgccttcccggccatcgagctcatcgcctcgccgcagctaccccacaggcgcctcgcctaccttgccgcctcgctctccctccacccggcctcgctctccctcctcccgctcgccacccatcagctccacaaggacctctccccctccacctccagcgccgccaaccaccacgtcacggccctcgcgctccagctgctcgcctcccccgccgccgccgccgcgcccgacctccccgtccacctcgcgcacgacctcgtgccccacctctcccgcgggagcccccgggcgatcgcggccgccgcgcgtgtcatagccgcctcgccgtccgcggccgtgccggtccttttcaagccactggccgcgtgcctcgcgtcgcctgacccgcgggcgtcggctgctgccgcagctgcattctgtgagctgtcggcgccgccagccgatgctgctcctttcctgccgctggcgcccgacctctacaatctgctcaccacgtcccgctccaactgggcgctcatcaaggtgctcaaggtgtttgcacggctggctcctctggaatcacgcctcgccgcacggattgtcgacccggtgtgccagcttctcgcgcgttctgctgctatgtccctgacgtttgagtgcatccggactgttctaactgccctgccggcacatgatgctgccgtgcgccttgccattgggaaggccaaggagttccttgctgctgaggatgatcccaacctgcggtaccttggcctccttgcgcttggtatgcttggaccggcatatgcatcgacgttgcatgaatgccgtggtgtgattgcccaatcactgggtgatgctgactcaaacatctgccgggaggcgttgcacctcatgatggggttgatcgatgacagcaatgtcacggacattgctggcatgctggtcagtcatgcttcgaagtcagacccagagtttgcaaatgacattcttggcgctgttctttcagcatgtgggcgcaatgtgtatgagctggtatcggactttgattggtatgtctcactcctcacagatatgggtaggaaccttcattgtgcacagggggatgagattggtcggcagcttgttgatgtgggactgagggtgcaggatgcacggccagagcttgttcattcatctcgaactcttctcattgatcctgctttgcttgggaaccacctcctttgtcctgttctttctgctgctgcatgggtctcaggtgagtatgtgaacttcacgaaggatcctgttgagcttgttgaggcacttctgcagccaaggatcagcctcctgccgatgtccgtgagagctgtctacatccaggcagtacttaaagtgatcactttctgttgcaatttgtatgttgagaggttgagtgattcaagcaaggaagtgtctgtagcattgaatgggttatctatggatcaaactgttagtgggggaagtgacgctccaattgggtctagcaatggacaaattacagtccctaggatgatggaaaaggaccctttttcacttaaatcggttgttcacatgattaacttgattgaaacaacagttggcccacttgttgagtgcaatgaggttgaggtcctggaaagggcaagaaacttgattggttttgtttattcgctaagagagattcaagaattgaaggaaagcaagtttgatgatgataagcatagcagggtgaaggagcttgttaagaatatgcaaacagtattatctcacgaaatagggcctgtttctttaaatgcacaagagaaagtatcccttccagatgatcttgtcctgaatgaaaatcttgccgagcttgttgacatcatcagtgaagatgacactactctgtcatcttcaattgttttctaccctcgtagctgtggttcagtcgaaaccagagatgaacctgcattatcacttggttcatcttctcttctttctgagcaccgtaaaaggcacggactgtactatcttccaacaggaaaagcggaggatgggccagttgattatcctcatgccaatgatcctctgctgcctgctagcagcgaaagtgctctggatgataaattgaagactatccagcctgttaccggtgggaaaaaaccgaaggccgtcaagtccagaccaaaagtagtgaagttggatggtgaggatttcctaagttctatggtggctagtgcaagtgttccaaaagaagattctttatctggtgctgtacgtggtgtactgttgggtagagatctcaagccatcatcttcacaaaaggcttcagataaggcttacgaaggaattataaacaaaatggactctggtgaatctagttctcagtggaaaaataatgtagatgctgatttcgtaggccatcccacttcaagttctagaccaagtattcaacagagccatgataaagagagtacaaaccctcttgaaagtgatgggaaggaagcgagaaaacacagaagatctaggagtgggcatcgtcaaggaaaacataagcatagagaaaggcattgcactcaacctgatgtacctcaagctcctataatccaggattttcttctatagttgctgaggactcccttgtttttgatacatttctattgccaagtacatgttaccttttgttcattcacattcagcggtttttagttttcactttcatttcatggaagttatttagttggtttatctgtggcagctggtctaactgccactgttgtatcctgtatatctttcttgagcatagcacttgatgttcttcatagctccatggcaatatatttgttcatagtgtacaaaaccagacttaatgtttttatcttttactacctccgtcccaaaaagagtgctgtccaggtagtgagaaatgcactatttttgggatggtggtagtattaatgtagacttcttttacatccctccttatacctctaagaaattgatgtaaccttgcaaactaattatccctaatactgtaagaccatgggtactttcgctatgcatatccccataggcttacatagttactggaatgtaccagttatacacattcataaatcgttttcatgttcttgcttcacataacataaatccagttatatatgtacaatctagattgaacaatgcaaacatgtcctatagatgctaaataagatgaactgaatttagaagggaaaactcttttcaagatgtactacagtacataccgagggaaaagatccttcagaagtatgctagaccgtgatgatttgaaaagtgatgctagtcgctaggccagacaccatttggtgagagggtgacctagaacagccaggcagccagccaaggatgtcaggcacagtacaagaattggacggatcgcacgtaataaacttggaaaagcgaaaactagtggctttatcagcttggttcaggctctaagggctttcacagtgcggtgatttgtcatctggcctgagcttgccacgtctacgactagatgggatccagtgtcacgttcgcagttgggcccaccaaactgaagcctggtcacccgttcgaatgtttatacttttgtaatttttcatcagatctagtctctactctcgagactatccagactaaataaaatgtttgtagagactatccagactacttaaaatgttttctgtagtgcataaattatggaattgattttattagattctctttgtttctttattcttgatttgatgctactgtaatcttttgtattattcactcttcttttttttaaacatacatgtacttacctttcacaacttgttctgttttgcctaacatgaagtaaatatattattgctccggcggttagaccgataaactggcggttggacgggtgaaccagtggtccgatttgttctttttctttaccacgtgttagggaactagagtaagaaaaaataaactcgcaggatatacacacgagggcaactcttcaatctggacaggatttgtagtaaaacaagattcattttcgtactgcattcgtttattttgagatatatagagtagtcatgtaacaacataatgttacataatgtatgatattgtgcttaggagccccatttatatatacattgagggttaaatgtcattatgctacgcaatgtcagtcttctcaacctaaaaacctatagaaactctttcctttgaaaaccataccttcaagatggaggtacattatttagttattactccctccaggtatgaaaacgtactgttatagtgttatggacatgtttcaagtcaactttacacataaatatatttttaattaccagaaaaagtgcccgtgcgttgcaacatgaagaaaagatgagaaaattgaggagaggttaagaaatatttacattacttaattaagtaaatacaaatttccggaatacttgtatttttttaagctggtaggtgtttaaattaattgaaaagtaagtaagtgtgggaaataaaaatgatatggctggatttaatttttattaaattctccatagttaattacactctcttaaattttcttgaaattttcagagcttaattgttaattttaataatacaaacatcatttcaatatttatttaaataaaaatcctcattacactctgggccattttcagcccatagcctccctcagcccacaaccgagccggcctgctttcatcccttccctccgcctcggcccgcaagcacgcgtccggcccagcaagcaatcgaaagtacaattagcctccccatggttctctcactgttgtgtgggcctatcgctacattgtcgtcccctacctccgtccagggttcctcatcttcccgatgcctcctgatgtcgccgcctccgtcaaatcgggccacatccttggagataatccgaaattgattgagggggtttcaatctttatgtcctctttccgtttttctgagaatcggagcaaatctgtttcgtattagctgtgaataaagccctatccaaaccctatttttcctactttaatacgatgcgacgtgtgtttttttcccgtgctaacgatcggagacagacaaagtgcagcgtcacgcacacacgagtgagagggggagagggaatcagatgattgatggacgaaaataagtatgacaaacggaaatttaccaattttttaagtagttaagatttacattagacgtgtggaattatgtctagaatttaccttgaaaggtactttcataatattacaatactagtgttttttataaatattttgcgatggaaaatagcggacaaagttgtagccccaatgtctaaaacaacttgtttttatgaatgaagggatgtgtcccatctacccaaaatctcttatattttgagcgaagggagtacctatgttcttttttagataacattaggatattgtcatgactatctttcatgaacatatttgattattaattttttaatcatacttcataaaaattattaaaaacataagagtaaaatacacgaatggttcttaaacttgtgcttaaaatatatttttgtccataaccttgtcatgtgtgtcatatatatatacaaacaaaaagaccgaatgtgtatgatgatcggatctgtttggcggaatttttttaatttttaattttatttattaaaatattttaaaaataatttttggttttaaagttttaaaaatctacacccataacgccttctcaaagggcgttttttatgatatggcacacgcccgttggtgttgtaatggtcgggtgaacatctacgagggtggcaagagttttgcctgtaaatggtcagctccggttgttttgcaagcgccccctttagccctttgggagggcggccaggggttgcctgtaaaatggccgaccgctctccatgtgaccgttagaatgcatcacgtcataaataacgccctttggaagggcattttaaaaaacgacatcctaaaggatgttagggggcgtagatttgtaaaactttgaaacaaaaaattatttttgtaaagatttaataaatctatctactctaatgttataaaaattaaaggtatttttttttgctaaagtttggtacgtcatccatagtccgattcccgtgctcgtccacgcgacttccctgtctgattcacgtctgacattgatgtgatcgcgatagctaattcgcgcgcgcgcgttgacggcgcccgttttaggcccataagggctaaggcccacgcataacctagcgtgcatgcgtgaggcggatggcgtccatgtccgtatgttttttccccggaaaagctaacgtccacgcatttttttcgtttctttttgccatttttttcgtgatctttttattttagaagttgaatctttcatctgtaattttagttgaaggttttgaatttgagttgaaagtttttaagatttaagttgaattttgagatgaaaatttttaaatttgaataaaatgttttgtattttcagatgaaagttttaaatctgagttgatagttttcaatctttagttaaaagtttttaaatccgagttgaaagttttcaaatcttgacttgaatttttttcaaatctaggtttgaaagtttgagttaaagttctatttatgtattatttttttaaaaataataatactaacaattatcattaaaactaattaatgtcattaatgctaatcagcgttattagcacttagcagaggctgagatgggggagtgcgttacgtgattacccactcatgtgtgagatgaaatgacccaccgaacaaaagatggggtgaccgaatgagatggtaaaatatatgctatccatcattaattctttctgcctgcagtgccctaattacaacctggtggcatatatggttaatgagaaatgataaaattttcaaacagacacccccaaataccagccgtgcagtagcgtgcattctagatgacatacgagatagggaatttgctttcaaaccgccttaagcgttaatgttctttttcttctcttgttaaagtgtatccatattgcattgtctcctggggatatgtaaggcacctaatggtccttttaatataaccggcaactctctggccgtcttctattaaaaaaatcattaattctttcattagcccttgggttttattaatatttgaaaaagtcattcatctttcattcaaatgatttcttccaaacctgcccaaaagttatttttgcaaaacctaatccttggggctgaagtggattttttttttttgaaatttttttttaaacccctttcattccttgtaccaaccttccgatgaaggattccccttccccataattctctatttcggtggggtcccgtcattaatggtgataatattaattaattttaactgttttgctctcacttcaacttcctcaatcccagtgattcagattcagagaatctatcaattgctctacaaactagataactttagctcttcaacccaaaaaatatttcttttcgtagtactgttttcatgtataacattccagaagcatacactgatacacaagctcgatttggagcagttgttttgtttgaggttcgtgtatcttatatcttatatagtttttcatcgatacatctatatgtacataagtattttggatttttttccgtctcctcccacgtgatcccacgcaggcagcgcgcctccgatccgcccgggaagaacctacgcgcataacgcgccttcgccccgcccggaccgaaccgtacgccactgcgatcatagatttgcctccacatatgtttcctattgcaaaaatctcactccctcattattttcgccgtaatttccttttctattcagttttaattcatcgaatttaatattttccccgtaattttcttttctattcaactttaattcgtcgaatttaatctctatttcagatggcctaccggtaagcttatccaaccttttatcttgagttttgcgaattctctccgatttgaaaaaaacggaaatagaaatcaagtggataaaaaaccatcaactaattttgggatatcgagagaatctttcgaaggttgaaaacgatagcggcggctatacgagttaggcgcaggcgtgcagcccacaatttgagccagggcttgctttaaaggaaggaatgaatgtccacaatttgagccgcaggctgaagagaggtagcgccgtaaaggaagggatgcagggccttcccatcccaaaaccaaggatggatttttataactttttcaattataatgtataccgatctaaacgtttcaataaacgtttttacccgttataacacatgggcattttttataaaatttaaaatataaaaattttctgtttggcgtgtgtgagtgggtgggccaagcacatcgcacattttggctcctgtggtcagagaccaaacaacaccattcgctcatgtgaagtcgagtactaggaaattagtaattttattaattaggtgttgataaattttcatgcatgtaatcaccgtaagtagatagtaaaaatatttcaatgaaattgaaaacacgtcaacaatgtttttgataattgtttttttttcttttgcaatcaaaatttcgatccaaacattggtttgctaaccgtttataataatcgttaactcattgttttctgattctttgggtaacccatacatatttataacattacttcagagtgaacataactagtggataagatttaaacaacgagatatattcacggaatatatcaacttagaaactttttttttctttcgtgatctcaaaagaacagtgagcgtattccttgcacggtaataacttcgattttgtggtaaattaagacctcgattgatctggaggacttctgctctgctcctaatcatacactattttcgtcggcacgcgtaaataatgtacatgcacgagcattttttttttctgatgttagtttaattgcccttatggttttcacctttgtgtactttactctgtcatactgatccgttggcacaattggtggtttctaacagaaattccaaggatgctgaaatatattagttacaacgtaatggtaaacgctgaagacaatctaggaatattgaaagagattgcaatgtaatgataaaagcagaagactaatttgtcctacaagcagaagactaattccaaacaacaaactaactcatcctggcataatccacatttcaatatcgaattatccaaaagggccgccaatccgtcatcttcactgtcgatcaaataaatttaactagtcaatcaattaaataaggaaactagcttaactgggaagctagttaagccctgattgttgttgcatacctgcagaaccttattgtatcaggagataagataattgaccctaactcactccgcaggatcgccaaattaactgccttccctttcctgctcagctggccgggcgctgtaaaatccttcagcaggaaagaactactacaactaaataaacttgaagtctgccgttacctgcctaagctggtcaagtcttgaactcttgattgtatagttgcttatctgcaaactgatatgatttaatcgggagaaaaattaattgatcttactgccaaaattatcttctttccctttaatgttcagctggctaggaggcggctgacattcttcagtaggaacaacaaagacagtactactaatcttcagtaggaatctacgcaggattagtacaaattttgggtcccgctatttaccctgaagtttaaggtagatactcaactatgtgattctcacatacacaactgcaaatggtacacatggcttgctattatctggcttttgctattgtcggatgaaaaactagcaatattccacaatagacctaagaaaaacatgatccagatgaatacttcattgttccccctcgccaggccaatcacaaaagaagcaaaaacaaggatttatcaagtatcaaaagggaaatgctagcaaacagaacctcttcaaaattattaatatggtcacatggatcgaaatgtgtgaatgcgatggtctgtacaaaaaaattatgtggttcctaataaaatagatatcaaatcaactttgccacctactactactaacttgccatctcatgttaagctggtagtttgtactattgcacaaagagctgttatgccaggcgtgccaagacaaagattttgtcaactgaatttcatgccaaagaaagaaagagcaatttatgacccagtatcaaaacaacaataatcacaagtgacatcagaatggcaaaccaaatgtcatgtagaaacatataatgccggaactaagtttttgccatagcatagggaacagactacataacgatgatgttactttcccaacatacagcttcttccataagcatcatattaacttagaatgtcagcaggattttgcatacttgcccaatctattcactatcaaaccaccaaaaggacataattaccatcacaaaaggacactactaattaacctatagagtatagagctaactgatacttaactatggaaccgaagatgacgaggagagactagtggatcatattaccatcagctaggatcgcagctccttcgagcttgtaaattagtccctttctaatcttggccatcttaactgccatctttttcttcctcttcatatcaatccacctcaggttctccaactttttctcaattgcgacaacttggtcgccgtccaacctagggaacaattccatgatagcaggttgtccctccatgagcaccttaatttcctttgcgagcaatggaaactgtttgcacatatcatcgaatgacctctgctcatcactagctaaggacttctcctcgtccctggccaaagacttctcatccctggcgaaagacttctgctcatccctggcaagggagctctgctcatctctggccaaagacttctcctcgtccctggcgaaagacttctgctcatccctggcaagggagctctgctcgtctctggcaaggcacctctgtttgtcgtccccggcatgagcaacagagcgcccccagatctcacaggagagctcatgaagctgaaggtcatgatccttggtaatagcaaggcccgacaagacaacatcgttgtaccgacgcttgagactgcgcaccttatccctcacatcactgtggttgaaggtgcggccctccaggcgctgcacgagttcatggaacaaggggtggcccggctcctgcggcacatttccaccactgcggatttgatcaacaagagcctctaggatcatgatctcgtcattgccattccacttgcgcccgaacccgggcttctgcgcatccacaatcttggccctcttgggatcaggtgggcaaatgctgcctgacaatgcggcaaccctcttgctcttccgctgcggcaacggacccttgccgtcttcctcatccccttgccatggcgccacctcctcctcagcctctgccatcaaatcaccatcttcctcctcttgagcagcagcatgttgcttcgccgatggcttcttccttgcctgcgctgatgccttcttctttgccttccctgcgttgggtggcacctcttgctcagactcggccaagcggccgtccacctcccccacatcttgctgggggcgcgtaggctcagcgggatcgtccggagcagcgaccttgccggagtcgccagctcgcagggccttcttcttcttcttgcggttcttcttcgacttgggaggggactcggggagatcgtcctcctgcgccgcatcatctccttgcggagttggcacctcgttcgacggcgacccggcggcgaggttctctctggagccgtggtcgctcgacggcggcgccgtcaccctcttcttgggcttcatcggcgacttggcggggccgtccggcgccgcggcattgccagagccgaagccggagccgctccgcggcagcgcggagtcccccttgggcggggcggcgacctcgtccttgccgggatcgccgccctcctcccccgattcggcagcgcgcgtcggcggtcgagggggctgggccgcagcaggaggcggcgacctccgccgcattgtcgatctgcggagagtcgcctccggagggggaagagctggaagggagaggcaacgagggcgatcgggcgacgcgcacccgcttgggcgccatgggtggatggatggatgctgctgcttggggatgagatcgaagtggaaggatcgatcaggatttgtggggttttgcagggtttctttcaggggggactcgtatagccagcgaacgcctcctcgggtccatggctcgccgagtggtggtggtggagaaacgaagcgccgagaaactcaacagggacggaggagggagtacgatgcagcagggcgggtttggccgtatttaccgaaatactccctccgtatataaaaaaaaacaaagacaaactcctgatttccgtgtctaacgtttgaccgtccgtcttatttaaaaaaaatatataaaaacaattaaaaagacaagtcacgcataaaatattaatcatgttttatcatctaacaacaatgaaaatacgaattataaaaaaatttcttataagacggacagttaaagttggacacgaaaacctagggtttgtctttttttttgagacggagggagtaagtttggttacctgcacgatgcctgactcgtattacgggtgtaggcaatgttagagatatactcctatttccttgtttgtgttaatctccaattgatgaatctttcatattctatcgttgtttctataaatcggttgaggataaatgaaatgttattttttgagggagcatatatatggaatgttatagcggtatatataaaaaaaagaattatcgtgtccaattctcttattctaacatggtattagttgttttcgcttccgtcaccaaaccctaaaactctacctctctctcccatgctcactgttggtgccgccatgatgcccacaccttctgagcctttgtctccacgatccttcgcccttgccgacaccgtgctcaatgcccaccacccgcatggtgcttcgggcgatcccaccctcatcgcctccgtggtgaccaccacgtctaccaccgctcgcaaggccatcactgccctcctcgccaagaacgccacaattgatgcgtcctcctcctccaagtcgtcatcgttcgcggcagacgccactccgtcggagctcgccacttcgttggcccaggcgcttgcaccactggcgagccacctctacctcccagcatcgacatctcacatggtgcgttcaacgcccccgacgccaccagcaccggcacgccccacgccggtcctaccgcgtccgccgatgcccatggtgctactgccgacttcctcagcgtcctcaacgtcgccttccacagcgcgtctagcatgccccacgccgcccccacgggcgccagccgcggcgtcaccggcctacctcccgcccaaccgcgtctctacacgctcaagccatcgccatcctgaacatcaaggcattggtccccgtcaccctcgacatccatgccagcaactataatcgttagtgcggtctcctcttcgccacgctcggcaggtactccctcgccgacatcttccgccctgaccgaccagattggatgcgcatagactgtgtcatccttacatggctctacaacgatcttcggcgatctcctcgagtccgttatgtaagtcaccacaatggctcgcctcatttggtgcggcctcgagcagcaattccttggcaattgcgagcactgtgccatcaacctccaagtggagttccacaacttccaccaaggcgacctcttcgtcacggactactgccacaagctcaagaccatggccgacaaccacggtgatgtgggcgaatgttgacagttgttaagtgcaaactttaaccgtcaacttatgtataaaagatatcaaatatattatcaaaacttaatggtgggagtttactactaaccgtttccaccagttttggtaaatatatgtatgcaggttaattaaggagaaaatacaccataggggcccacttgactgttgaaaccgacttaagatgggaccaaactgtctttaaccaccataggagcccattgtcaacctcccaaccaagagagaggctaggaggtggggcccgcagttcggccgaacaggggattcggttgaaccgccatagtggtgccccatcctggccttccacgtgtaggtcccagatgccttcccaatgacagttattcccggttttcggcctggatgactgccacaagccacaaccgcaatatggaggctctataaggaggaggcttcacatacttcaacacttacaactttggtgggaaatcaaactctaaccattggatagaaaacctgttaccattccaatagtgtcaatttggagctctgtttatttttcttcttagcaaatttattgcttaatacaagcatcataattgcttaagctcatatatagctcctctactcatggctttggctttgaactttgtgcttaaggttatttaaggcttagaaagaaaaaaataaatttacaaatgtcagtgatactatacacaattgaacaagttaaggagaatctagcatagctctatgatgacaactaccaagaaggggacatatctggtgaaaacccgtgaaaatcaaacctaaaagttttgcaaattcatgtaaaaattactagagacaggtataggtatgaaatacattctcaccaatttcaaattcaaactcaactttattatggagcaaaaaaagataaattttgagcgaatagtaacaagactttattcacctgaaatttgtcatttatgtttctctcgtatgaagttatgtttggacttaagatttggtatgaatgtatttcaagcctatctcatgtaatttttttttgtaaatttacaaattttttagatatggtttcaagggttttcacttatttgatgattttcaatggatatttcccctaccatgaatttctatatattattctaattacacaactaattaagaggttcacttcttaatcactaccttgtgttcgtgggagtcgtaccagaaattgagcccatttggttggcttgatagtttccaatagttgtttctactagtttctaagcctagctatgtcttgcatgcatatacaatatacatattgtcttgtggacaaagaaagctagctaggaggcaggaaaaggaaggaaacaagctacacacatgagctaccttttgtacatgtaccaaacagatctcccagggttttggttaaactcaaggttatgtgctcaagaaaagaaaaaaagaaacagcattcatagctagttcaaacttggcgcgaactgatgacatggggttggctggacagcaccgatgtctagaagaggatatttgtttaatttgtttgtgcataatttttgttagttacagaccggtaggtgtatatatatatatgtatgtgtggatggatggatggatgcaagcaagccattttgacagaattgttgtggaaaaaacattcaccggtggagatctgattctggaacatcagaaaggcattatgcccagtgtttagagtttagacctggtaattcgtttgagctgatttttatattttttcccctatacaaacattagtattgtaccgtgctttgctttgcaatctcaaaactcaaatatataggtatatgcaactattctgagttaaaaaataactataatctactctaaattaggtcaaaaggtattagtttgtgactagattatagtgactgcaaacacacgcatggcctaggggctgttcaaattaatgttatttttaaccataccatttttaaaaatatttacgtttagtttgttatcaaatctggtaaacacataagaaatcctactaaaattttagtaagatggaattttgacaatgccaaaatttgataaggtttattttagctacaatataagcagacccctaaaatttatgatgccatggtggtgcatatttctggacgtaatacaagaatgcgtggaaatcaaagttgatgaaaaaccattgttgtggaagacgaaatatgctttcagacgaaaagggtatcgttcactgataatcagaatacaagattaataagaactatgtggaaatttgatgttggcaaatatgacgttggcaagtacgtaatttggacatttaaatggctacaactatataatttgaatatattaatgttatcttttaattgaatggttataattaacatcaacttaaaatatagtttctaacggtcattcatacagcaaacaatggcatgtttggttatattcaataagtaaaacataacagaatataagaaatactaaacaaagtcccaaaaacaactttggatagtcatcaaatacacatgccacgaacaattaaacggaagatggtgaattaatcgctaaaataattttttaatgttcatgaaaaataaatgtcgaccgtatcacgataacaaactgtttcattaagtgtttgaatctcctaaatataaagataaaaataaagattaaatgtttcacgcaaaacaaaatagtaataacatgtgattaattgagatttaattattacaaacttgaaaaaggattaatatgatattttagaacaactttcatatagaaagtttttgcatgaaacgtaccgtttagcagtttgaaaagcgtgccacgagtatccaaaagtttattaacttttattggagaaaagaaccggacacatccgtttaatcggtcggtacgactgttttccgcaacctgccaaaaatctgtgctattcttcctaagattcgcatggactcacacaactagctactcaattaattttaacagctgcagctagaggcgacaactgagggccctggcaggattcggtagaagactgccaaagagaaatcagtgactcaagaaatgagagattgaagcagaggtaagccaggccagttagtgtgaagtgagataaactaatccaatcatccctttaagataaaaaagaacacgcgatttctcattgttcggggattattgttgggaaatgattatcagcggtttttaacctctctttctcacagcatgaacaaaacaacttaatagagcggaaaacccatacacatatctacattcctttcaaagactaattatgatggtgaatctaccatcacccgccacagatatagtatcatcgtccttcatccactttcacgctgaccaatcaattgccacacctagcgcgctcttccactcaggtccgatgccctgatccgtgcagcttggaagacccaccgtgatggtggggactggggatgtgccattgctggctactccatcaccatgggaaaatccacccatcaccctgggcagatttgccatcgaggctgcgccagagagcttgttgatgtgctaccctgatctacaccacgttgccacaatgtgcacctatgctgccttgatccacgccacttggaggtcgaccggcctacggtgccctgattcacactacctagagctctgttggcccctatcacgctgaactagggaggaggggagctcgagaccaccgccgtgaatgtctctgagtgcgagcgcccaccccacacgactagctagagtagcttctcttgctcgttcttggtgcagcgtgatgggaaaaggagaagtgaccgagatagagagagaaaagaggaggggtgggattttatatcagtttctgatttcgagagtgtataaagtaaaatgttggacttatatatatctgaattgcaaaaaaaatctaataatttaaatacgaaatgtaaaaggttgacaagggttgtaacacaaaaattcattggagagtggcttgcattgtagacctagtatcttcacagtagtttcatcttaggtggcacatacgtaggagttacctccattgctcgtagcagtagcggtgacgtgttctctctcctcgagaccactagtaagagtagcctccattgctcatgcctaagaacaaccatcttgtatcatctatataaattgaattgaactataatactcctactttatttaaattaaagtgttgtaacattggacattgagattgtctcaaagatataatattaactacttaaatattgtcccactcatacaaactataagctgaaatattattctcacccctgattctcaggataataagtagaatcacatccaaacaggcaaatatttgatatctcaagaggagaatcaccccagagtgattcatgttttttgaaagaatcactggaaacccagcttcaaatataggacattcaggcaaacctaatatagaactcaccacatactttctaaaaagttaccctccttctaaaaaaattataggccaaattatgataagcagcggacactagtacaaaaacccttataggtgccggttgggaaccggcaataggtgccagtttcccggccgacaccttttggtcggcaccaatgaccgtatgtcattggtgccggttgtagaactggtacctttgtgctctcccagattcaaaaaaaaatgaagaagccggctccaagccgagccgagccaatgcttttgagccacaccattcaagcagatgcattccatcacaaatcacagatgcaattccccggttaacaacaacaatcacatatgcaattcaatccggtcaacaacaacaacaacaaaatccatcactaatcaacaacaacaatcacaagtcccaagtgaacaacaatccaatcaatcacaaatcacagatcaacaacacaagcaaatgcacgaactcactctgtcgtcgtcaatgtgctgctgccaatcacagccggggtcccttgccaccgccactgccaccgccatttcccttggccacggccactgccgcacgtcaccgccgcacgtcgctgccccgaccggagagggagaggaggagggagaccggatctgcacccggtcacctatggggaggccgcccgccacctcccttggccatcgccgccgccggacatcaccgccaccaacctaccaccccgacctccccctcccctaatctggccgcctttgataaagccgatggagagggagaggcagaggggaccagatgtgctcctcctcgtcgtgggccaccagtccatgcgtcgctgctcgccggctaggagatggggacggagggggagggaagcgtccggccggagagagtgaaggcggatggagagggggactcggcgggtgctggagggggagggagaggggagggcggcggaggagaaggagtgggcgggagggggaggaggaggggagggcggtgccgcggtggaaaggagtcgaaacttctctctcgcgcgtggataaggccggaggagaagatgcgcggataaggaagagaagcagggacctacgcgcggataagtccggagatgaggccggctcggctcgcccagttcggctcggtttggtatgggtgccggttttttaattacccggcacctataatatattattggtgtcggttttttaattaaccggcacctattatatattattggtgtcggttctttttaaaaaccggtacctatagtattggtgccggtttttcctaatgaaccggcacctataatccttaaaggtgtcggtcgtatattttttcaacgtgcggatgtgggaaaagtctcataggtgccggttataaatgaaccggcacctataaggccggtccctataagggtttttgtagtagtgggatgagaatctaaagttgaatctctcaacttctggttttagttcactttctagattctataactaaaattcttagaatccatatgaaaatatgtacttggggacttgcacattctagaagaatgggaaactattctaaactctcgcgaagggatgtccactcgttgtttgcatgtcactcaaatggttatgaaaaaaaaaattgagaagatgtattaacatgtgatatatcactccacaaatatgtacctttcaaattcaacttctacatctcgcaaaaaaaaacaaattgaactacagctagtaaacttatatccgcggtcaaatttgtttttttttgttgtgatatgtagaagttttaacttgcatgtttatggagtgctatatcacatgttacatcatctcaatattcttttaatttttttcataatcatttgaatgatatgcaaacaacgtgggacatccccttgagagtttaaaatgtactctcggaagaatatttcttaagtcaaatctattaatatgattatttagttaagaacgagataaaatgtcgtaaatatattatgattaattttgatgagtaatacaaatttagaaatgtctattttgagaaacacacatgggtcttccggctagctccacaaggtggtgggctagacgacctgggttcgaagcctcaccccttctaattatttaatactttaggttcacaaggtagtattagattcttcccctaatattcacgtcttttcgaaatgtctactttagaatactctgtcagggttaataacacttatcgttttggtgaaaactatatcaaactttataaactttggttattaataacatttaaaatatttatgagaccatatgtatagattagttttaagaagtaattcaataaaatcatatatttattaatatatatatatatatatatatatatatatatatatatatatatatattaatggtcaaaattataatggtcttttggagactatgttcttgtccaaaataacaagtattatcaatccagagagagtaacaaatatattatgcacataaatatgctaattagaaaagtgacaccatgcatagtagactaacaggtaaggggaaaaattgaacacactcaaataaattggttagagaacatagtaaagaatatgacaagctactccaagtgaagtgaaactacgaggtacatatatccgtacgtagttggccaagaccctgtggaaacatttccttattggttggtattgacgatcaagctaaggaaaaaaggcacacgcatgcaggtaatccactactacgtactcctgtatgcatccatccatgcaagaaaaaggcttccatatatccttgtcacaagctagctcacaaaacttcgaactgacaagatgacaaaagtcacaatgcttgaaattgacaacacctagtagctttacatgcatgcataggagcaaatctctccaaccccaaaggttgtgtgtgttgttgtgtacaggtagatatagatgttgtacttgaacacctgaatatatatactactgctatctaggagtatctgatgaccaattatttctagaaacgggcactttgtgttggaagcttgcgtgtggccatttctcccccatgcccacctaccacccaaaaccccacaaatcttaccactcacacatgcggaaaacccccgttttctccgtgtggttgtgacttgccgctgcgccgcacgcgctacataaagctttggcgagctcgccgcttcggcttcaacggtgcagcttgccaacctaaaccgataatatcgctcgctcgctcgatccatggcgggcgtggtgcagaccgtgcagtgcgaccagccgagcaagcagcagctgacggaggcggcggaggcagcggctgcggctgcggcggcggcgtcgctgaggatatttgggtacgaggtggggggtggtggtggaggaggaggcgtggcggcggcggcgggtgcaaggcgggaggcggcggacgtggtcgtcggggcggggaggaggttcgagtgccagtactgttgccgcgagttcgccaactcgcaggcgctgggcgggcaccagaacgcgcacaagaaggagcggcagcagctgaagcgggcgcgtctgcagctcgccgtcgccgccgcggggacgccggcgggcatgggcttcgcggcggcacaggcgccggcgccgccgccggggcacgtgatcgccgtagggcatcacgcggggtcggttgcctcctacgcgctgcccaggtgggtctacctcgcggcgcaccacctgcagcccccggcggtgggcctgccgttccacgccaccgttcaggcagcagccggcgcgtgccacggcggcggcgacgtcgagacgcggttgctcagcgtcgccgccgctgggcggggcagcagcactgcaggcagcagcgctcactcgtacgaggtgtgtgctcctgcggctccggcggatgacagcgacgaggaagcctcggcgatggggttggacctccatctcagcctagctccggcgagctcggcatgaccggccggtggccgggagtagtaactttatttggtgcaccgcggccgacttaacatgtaactattctcgtgtgtatccccttcattttcttcccatttttttagggcaaaccctgttattttcgttgtttgcacatctcgcaaaaatgcaagagctcgagatatatacagtacatgcttgatcaatcatcaagctaatatacctatgtatactcacacagttgcccccactgcatttggtgtaattatcgctaatttataattctctcttatcaagtcacaccatcttatgccttattcgatttagagcagattgaagaggattgaggggaaatatttccacaccaaaatatgtgtggaataaatcccctccaatccctcccacatggggactaaccgaacaaagccttaattatttgttagtcattcgatgatcaatgtaagacgtggattatttacctcttttccccatcgtcaatattagtaggggtgaaaacaggtcgagtttggttggatcttacccttcctgtatcctaacccgtattttataattgaaattgggtcaatcacggatagtgctgaatatagatataaactcggataatatcggtcacaaatataggacgaatatatgccaaaacagatacgtacactataagttaaaaaacaactagttaacgtatatggtcaaaattgtttttttttcgttgtgagatgtagaagttaaatttaaacttgcatgtttgcggagtaatatatcatatgttaatatattttctcaaatttttttcataaccatttaagtgatatacagacaatgaggggatatcccctcgaaggataaaaatctactcccactattgttgtctgtatttgctcacaagctaaacgtgctagctcgagttaacaaacaatctaacaagaatagattaacccaagcaaacccaaattactagagggatggagaagaagtactgcagagggacagtgacactacagcgtcacaccgatcaacacacgacggcgagaaacaagcgactgaggtcaagctgaaatactggcgacgtttcatcggaagtggattttctaactcgagtgacaatccttatttgtacatgtcgttaaaaaaattattaagatagatcaatatatgatatattttttcacaaacatgtgagttaaaattcttctgatacaatttgaaacaaaaataataaatttgaccgtgaattacacgtttttatagtcaaatttgttatttttgtttctacttatataagttgaatttgaatttgcatgtttgtgaagtgacatatcacatattgatctatcctactaaattttttcaaattttttatgattttttaagtgacatgcaaaataaggggatatttccttaaaggatgaattgggtttcccgttatctgtaaatccaattttctttcctacgtagttccgaggacaataatagagccatcgatattactccctccgtttcaatgtaagtcattctaccattttctacatttatatggatgataatgaatctagatatatatctatctaaattcattaagatcgatatgaatgtgaaaaatactagaatgacttatattatgaaataggggaagtattagagagtcatacacaaattatgtggcggcaatctgtgtatgactatgactacagcttaatcctatatacatatacaagtcatccccactaagtgcaattaaaactaatttcctgttttgagagtaagccacgtcaccttgattcattccagccatcggattgctcataaacgtttggatagcaatcaatcaatcaactggagatagcaatcaaaataaacatttagcaatgactaattaaagaggcccacctagccatctcttaattttgaaacatacagttggaataccaacagcaacgcatgtagtaccccagcagttataagctctttaatcttccattgaagttattttatctcctgtaaccggtgaatcagatgaacagttatgcctttatatactctctcattcactaggactttgttcctgatcgatcatctgcgcttgacagtctttccatgcatccagttgatttatttgcccactcctctgctcatgctgatgcttcaacagatcaacatgcacaatccgctttggtcatctctctcttgcttgcttgctcatggatttatttttctttttcttactaatatcacttcttgtttagttgtagaatctgaagagaagaaaagaagtagcagtttcaaatatttcttattttctgttctttgtgaaggttgcagatcttatagagagaattgaagggttggtgcattactatattcacataccggttgaaataaataagaacattttttttgtttcagttggttaaaataaataagaatacttttttgtttcagtaggttattgacatcttcgactgaacttttgaaagtttctacttcattaaaactatagtttggaataagcaattacatagcatctttgtgtaatcaccatgacgtatattgtctaccatttttctttcttgcaacatagcatagaacaatctatgttagtaccattctatttattgcatctgtgttcaattggccttggttccagtaaaaggaattgaccattcactaaacaatcagcgtattctgttatgattcaaatttcagttgcttattattataacattgttggtgaagtgttcagtgtatatcaatacgatcattcatacctaatttttcatctttacattactcttatattcccacatcaatgcgcggggtgtcatctagttagagttcgtttagtgctcatatatgcgtggtggacgaaaccgagatctcgagtcagtctcagtcgtcgtggtcataatcaatcatgcgtattcaggagaaaataaaaaagaaaaaaaaggaccagctgatggactgccgctaccctctctttagtcccggttgataacaccaaccgggactaaagatctttagtcctggattggtagtcccggttttatctcggtttgaaaaccaggactacagagggttatgaaccgggactaaaaagcacttctccaccagttataagtgccgtgctacttacgtgtcagggtctcagggacgactaatatggcgacgtcgatggagctggcgcccggcgacgcgcggttcgcgaagctggcaaaagagctcgacgacaaggcgccgcccaaggccgcggccgcgccaccggcagcatcagaagaccaagcagcagcgagctccgggaagcccaagtacaagcacgacttctacaacggcgcgagcgaggtggtggtgacggtgttcgccaagagcgtggcggcggagcacgtgtccgtggacttcggcgagcagatgctgagcgtctccgtcgaggtccccggcgaggcgccgtaccacctccagccacggctgtcgggcgcaaggtcgtcccggccaagtgccgctacagcatcctcccatcgaagatcgaggtgcgtctcgccaaggcggatgagcaagtgacatggacgtcgctggagtacacgagcaaggccaacaacaagctcgcggcgacggcgacgacaacgacgaggaagaaggtagactgggacaagctggaagccgaggtgaagaaggaggaggaggaggaggaggtggacacggcgacgccggtggtgaacaggttcttccagcagatgtacggcaacggcgacgaggacatgcggcgagccatcatgaagtcctacgtggagtcctacgtgctgtccacggactggaaggacgtcggctctaagaagattgaggccagcgcgccggaaggcatggagctgcacaagtgggagtattgatagtgttattattatatatatagtcgggctaattaggaatggatattgtccgtgagttgcaatgagattttaattttaaaaatatttttaatccagtattagcattattttctatatacatcatatatactgtttcttacttatatgtggatgttctaaactctgcggggtaatttttaccttttcatataaagtagggagttgatagtgggggtggttgacatatagaccctctgaccctacatgtcttttcttttctaaaaagtagggagttagtggtgtcttttcttttctaaaaagtagggagttagtggtggaaatggtgacagattcacttttcttttctaaaaagtagggagttggtggtagaagtggtgacagattcacctatcactaattcaccaccatcattactctcttttataggtattataggtatataattcttgttatttgtaaccttatataatttttgttatttgtaaccttttctgtcagtatccttaaaaatgtggtactgtcttattaaggtatcattatacacatagtagtacatgttctttgttgggcgtgttactaatgtgctacaagtttaataaactcagttggaacttttattatgtgtaagttagcgattacggtggcagagtcgtgccagctactcgtggtagatggcaaagctcctgcctgcatgcctgaatggaccagaccaaatcatttaacatattgttaagtataattcaaggcgataatacatattgataagtgaaaatattgagtttgttctggtccattgcaaaacttaggttaaaaagtgaccctaagtgaaatttattttaaaattattgagcggataaattggatattttagaaaatatacttagctgatagcttaaaataagtgttctaagtaatgtaatgtagtgggaaaaaagggaaactatttatgatccctcgatgagatatctcctcgtttacttaaaatccatccaacagttatgaaaaattcttaaaagaaaaattgacaacactcatacaacatatacaactccacaagatcttaggtccaaactcaactcacatattgagatataaaaaagacaaattcagcatatgaatagcaacgtactgtttacatatgaatctatctttttgtttttcaatgtgtagggcgagtttgaacttaatttttggtggaccagtagataatacgatactcttcaatgtcatttttagaatttttcacaaccatttgtatcgaatatggaaggaaaaggtacatgaggggacatccccacaggagattagaatccactcctgggaaaatggatttttgagacaacattttctttaaaaaaaacataaagcacatagtttcgataattcgatgaataatctaaaaataacaagggctaaaaaattgctctcccccctccccaagataatatttttttttcgaggggacaaacagggagctcctgcaatttcactatagaagaagagagttgattcagtttgtaaggaaaaccggacctaaaaatcttacaacggcacggtttattaaaggaaaaccggcaaaaacctcgacattgacaaactgaacctaagtacaaccgtccaacaagaggaaagctcctaaaacgaagccttcaagaaggttacgccgacagaacagcgacatcatccgatcctaatgaatctaggttttcacccggagaaatctcttgaagtggagttgaatgagggctccagtagcaacgccttcaagaaggtgaacggcgcccaagggcgtcgccgttgctagcaccgagagcggagcaaggctttcgccttggagcacccatcaaccatagcatctacgacgggagccaccaaatgttacctgcacaccgagggtacctgcaatattcccatccccacccgaggacgcgccggatctgggcaagagagccagatccggccgttctcctcaccaccaatgccagccgacgccaaaggagtgccggagaacgccagtggcagccgcgggatgcctgcgtgcgctgcccaccgccggccgccacgccgccgccggatctgtggcctccaccaccgccgctccatcgccatcgccattcccgccggccatcacccacaactccacccagcgcaactcacctcgaccgcctccatcacccgtccccaccgccaccgtccttgcggccgcgcggctttgccggcggtgtggagattgtgggtacccaatacccacacggcatggttatccgactagttataggggataacttatatctatagaatatgtaacagatcatgacttgggtattatgtttccttgtatattacggaacggcctaaagtcctggtttgataatattgtaaagtagatttaggaaaccgataccgtattggttaaggtttctatcttgtaattctgccccccaccctatataaggtgggcatgaggccctctagggggcatgagcacatatgatcgtcagatctatactacacccggcagattcaaatccccaaacaggagtagggtattacctctcatcgagagggcctgaacctgtctaaatcctttgtctccgcatccatccacttttaggtctcgtgtgctaccccgttttattattgccaaattcatgtttcgacatttggcgcattaggtaggggtgcgtcgagtttcccgtcgaaaagtgtgatggaatcaacttgatgagtagctcgcttcgtcttcgctttgggagctttttgcttcctcgctgccgacgactacaacaaactctcgctctttgacttggattcaaaccagtcgggagagattcaatctagctaaggaggagatgcaacttccgtatcatcttcatcaacagcatcacgcctcgccaccgatcgatctccctccgatcataggaggccacatccacatctcccgccagcatcatccacaatgacagcaggccaagctgcagacggtggtcggccttgtcgccatcctctacggcacggacgcctgaccttgccgatctccccgatgcccatgcgcacgtgacccgcgcatgacgcccaagcgcgagcgtcgcctctgtgccatgcatggcttatggctgggagatccaatccttacactatagaccatggcaacatggccgaccaatgaggtgaagacacatcatcgccaggctataggaccatacaacaccttgcaacaggatcttggctaggagtgctttgcacgccttaattttttcatctacacatatacatatgctttaatctatgattgcttataagattgatttctccttttttgcatgtacactcggggaacggcgccgcacgcccgggggcttcatcctttgcgtggctgacgcggcccgactacccccgtggcacatgcgtccaaggcatcacgtcgcatgcccgggggcttcaccaaccggcttgctttcaccgccaccgactggtgttttcgcctatatggttggcggacttcgccgccgctgttgggcgtctacgacttcaccgccggtctgcctccgtcgccgccgactggtgtcctcgcctatatggttggttggtcacaccaccgttcatgggcgccatatcttcaccgaccagctggcctttagcgccgccaactggtgttttcgcttgcacggctggcctattatgccgacactgttgggcgtctacgacttcaccgccagcctgcctctgtcgccgccgactggtgtcctcgcctatacggttggttggtcacaccaccgttcatgggcgtccacatcttcaccgaccgactggccttcaccgccgccaactggtgttttcgcttgcacggctggtctattatgccgctgctgttgggcgtctacgatttcaccgccggcctgcctccgtcgccgccgactggtgtcctcgcctatacggttggttggtcacaccaccgttcatgggcgtccacatcttcaccgaccggctggccttcaccgccgccaactggtgttttcgcttgcacggctggcctattatgccgccgctgttgggcgtctacgacttcaccgccggcctgcctccgtcgccgccgactggtgtcctcgcctatacggttggttggtcacaccaccgttcataggcgtccacatcttcaccgaccggctggccttcgccaccgccgactggtgtttccgcctgtacggctggcctattatgccaccgttgttgggcgtctacgacttcaccgccgaccgcctaggctgcctccacggcgggtgtttttattgccattgatggatgaccttctccccacatcggctacttatgccatcaccaaggagaatattacaaagctaagtcatcttttattatatttctgatatgatattttccttttcctctgcctcactccatcaactggttctccgttgagttgttagtcgggggctatagacgttatgtcatattttttcaacaattttcataatatttatcttgatttgctcgcgacataatctgagtacaaaagtgcctatcgagttatggagttccatcttcctatgctttccgtttggtttgccaatggatagttgcctttgggccgattcctagcacccggaggctcgttggatggaccgagtaacgcaaggtgctaagtattactcggaagaaatcaaaagcataaagataagataatttattttctactcttaacaattgcaaaagtacccgagtagtaaattccaattcgtgaaacttcgttccattaatgacaaactcatgtcactcatatgcatgtttgggaagtgcctaggccgactcccgatgcttgggggctatgactagtcggacagagtgtttaaacgtaaggagtcatccgctcggggaaatcaaaattgacaaaagaagaaatacatatttataaatattttaaaatacttgaattttcctcgagtattatatttacatcagatactactcatcctatatatttgttctgcaggatccagatccagatatgcataaaagggattcatggctttaagcttatctcttacgctccaggaatggatcagtcagaacatcaccaccggcttgccgtcgtcgccgccgactggtgtcttcgcctatatagttggttgatcacaccatcgttgttatgtgtctacatcttcaccgccggcttgccttcgtcgccgccaactggtgtcttcgcctatacggttggttggtcacaccaccattgttaggcgtctacatcttcaccgccggcttgccttcgccgccactgactcgtgtcatcgcctgcacggctggcctattatgccgccgttgttgggtgtctacatcttcaccgccggcttgccttcgtcgccaccgactggtgtcttcgcctatacggttggttggtcacaccaccgttgttaggcgtctacatctttactgccggtttgccttcgccgccgccgactggtgtcaccgcctgcacggctggcctattatgccgctgttgttgggtgtctatgtcttcaccaaccggccgccttgtccgccgccgactagtgtctccgtctgcacggctggcctattatgccgccgttgtcggacgtctacatcttcaccgaccggccgcttcatatgacgccaattgatgctatcgtcttcacggctggccacgttgccgccaccacaaataggcgtcatcaccttcaactcaagttgtctatgtctgcagccgactggtttcttcacttccttgaatgcatgattctgccactagttattggccttattgtcttcaccgccggtcgtctcgtctgctgttgactgctgtgcaactttgtcaccatggtggagctacttcatatttattattttcgacatcggcaaactctatagcctatactttgcatgatttgccacttcaccaaccacgatgtctacaagagcgagcatctcggcatgtgtcacgaaatattatgccgtgttattttactacaacaagtggtgttccaatctccaatatttctactcggacatcttcaacacgtatcttcactcaagcaatgactattcgacgacaagaagctacagttctcgactctatgttcagttgtttctcaactaaccaaagagtcgggagctacacaaatacaagactctcaaaattcgacaagccttatgtcaagatgaagcaatcaatcaatcaacgaatcaattcggggagttattatcttcgtcttcgcttcagagccgacatttaatttcagcgactccaattattacatcggcaattttggcttcttcatgccgccacaatctactccaaatttcttaagtttgagatttaatttacatgtctgggagtttggagtcatcaaccaatcaactcagatcagatccaatgagttgaacaacagtttctactttcattcaagtgaagcatctacattagctataacactaagttttgcagtcatcttcgtaaatcaagaagctttgcatcagtcttctttatgcacacactcgaatcaaggaaactactcgagttttgatatcttctcaacaatttgatggattattgtcactgacatcatcaccagcacctctacttcatcggccctgacatctctaccgttgctaatggatgactacgttttcacctccggctgcttctgtcattgccgactagttatttcgccttcatggttgacctactatgcaaatgctgatgagtgtcttcgtcattatcattggttgctacactgctattgactggatcaccgacatcgtcatcttcatcatgtcggttgcgtttgtcgtcgtcgactatttttcttcatcttcatgattggtggatttcgtcatcgcctttgatctgcctcgtctgtcactgactgattatttcgctgccatggctacacaactttatcgctaggcgccttcatcttcattgatggctgacctgactgctgccgactggtttcttcgcctccacggctatgcaacttcatcacttttgattggtatcactatcttcactaccaccaatatttttgccacctctgctgggcaatattatctctatattggtcgtcttgtctctatgccaactgcgtcagctaccatcaatgaacaattgtgactacgtgcttagggcttactagctcaaacacaagtatcataccttcaatttggacttgctccgaatacatgcaacatgaattcatgatcatgggtctattttctatgctcaaagactggactatttattattccccataagggttatcaaccgaatacttgcgccagtcgggattcaattattatatctattttggagtatcccataagggataatcactcagatcagaaactattgatatgagctacacttggtctatatcacccggaagatgtattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgtccaataccttaaaatcattttataccgcagttactcaactttttaggagttagtacaatgcatcttaaaaggtgtcaaacagtaaagctttatatagctgcctcgctgacttttttatatagtcaaggcactgtttgggtttatcaagcaattgattggatacaatatcgttgctttttgccacgtaagtgtgcatttttattgactaatattatggcttaggctgattatacattgtggtcattttccaggcggttggtaaatcatttatgagtttatttactcagattttacaccacatatgccatatatttccaggtatggtgaaaccatgtgttttttagggacttaagcacatctgttaaagcagtgtgcgcatggcgtatgcccaatactttggaaatttctttattcgcagcattcaagcttctttatagctgttttgctatgtgaatttttaatgatgtaggcaactttaggttgtactcatcatagtttacaaagcagtcggtatatcacttggatcatgttattcggggattcacatcgcatatgctatatattgatatcaagtcatttggtttattacaattatcaaaaccactcagttagttagattatttattccttgactatatgcttggtttgttcaactaatcacatggtcggaggctacacctattaggtgcatatactcgatgcacctaaatttacattcaattatttttcagccctccacagtcttcatatttggtaaaagtactcgggagaccatggcaaagatgattgaagcacttggctttggagtaatctggttcgagagaagattatcttttcgtctgttaaggtcttaggggctactgtggagattatgggtacccatacccacacgtaggattgcaagtgggacgggttgcgggccgtcccgccccgccccacaaccatgccatgtgggccacacggcatggttatccgactagttatagggaataagttatatctatggaatatgtaacagatcatgacttgggtattacgtttccttgtatattacggaacggcctaaagtcctggtttgataatattgtaaagtagatttaggaaaccgataccgtatttggttaaggtttctatcttataatcctgccccccaccctatataaggtgggcaggaggccctctagggggtatgagcacatatgatcatcagatctatactacacccggcggatttaaatccccaaacaggagtagggtattatctcccatcgagagggcctgaacctgtctaaatactttgtctccgcatccatccacttttaggtctcgtgtgctaccccgttttattattgccgaattcatgtttcgacaggcggaagccgtgtggccgctcaagtgacggcgaggcagagagggaaggtgggggagagggtcggctaggtcgtcgcctcccgagccgcgggagagcgacgcgagagatatctatgacccaagataatattgaccttgcgcatctgcaacagcaaaggaggggtgctgtccagcaacgacgctgatcaacttgcacaagacgatagatgactagcgaagaggcgattgacagttaattccgccgcatcaacaacaattcattagttgattggctactcgaaactcttgtgctagacagcgccaccagtggcgtaacaatatctcgcatggtttcgcctttcacaagacctttttttttgcttggccttcacaagttaatcaggttaggatcactggcatatccttcggcaatggattatcgtgtaaaaaagaagagcaggagaaaaaaagaagagaacgcaagaataggatattccattagcaataaaggcaccgataagttacaaataaagaataatcggactatcatactcaactcgcgagaggcaagctgcagttagttcatgcacctacaagagaaaaatggagacatactctattcactcgcttcacattttcctttccccaatactacttacaacacggcggctagttcctcacataataaattaaaatgcaacctaaaattatccgaatcgcctaaaatcgagagagagaaaaattgtaacacaaagagcgctcacaattgaaaaagaaggtgagtttgcgggagctacaatggtggctgattgcaagtgatatcatagaaccttgacgccacttggtcgtttaccttccatggcatccttcttgtcgcggcaatcggaacaaaggaaagggccttcccatggcttagaggagctggaagagaagattgaaccagcatggactgatataccttcacttggttcaaggtccacctggcagatggcacatgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32620 - DNA, 547 bp, Oryza sativa
agccgatgacatatcatttattcttgagccgatgtcatatgtgaatcgatcggcagttacaaataagcaaggtaagactaaatctactcgatcgagtacatatattaacgctatacaatctttctgtcgatgtatatttaaatcaagtgattgggatagatcagtcgccatgccgagacagtacaaaccacttaggtcgaaatatacattaacatgaagattataaacgcttatatcatagccgatcagatagatctagcatgtatcggctaatactccgataccactctacattaagatattaaaacagatatactatatcaaacaaaagcctaatataatttattgtgataagatcttaacgcaaagggcagacttagcatatcaattaaacatataaaacataaagctaaatcaggtaagatcagctgaaaccccgatactatctctcttgataatcataaaacaagctagatatcacaattataaataacacataatagatcgaactcaaccgatacagcattaagcataaaggcgagtatga

SEQ ID NO: 32621 - DNA, 649 bp, Oryza sativa
  unsure (1)..(649): unsure at all n locations
ggcgaattcgagctcggtacccaaccaatcatgtgcatcttgattgagagaacccttttcttccatattgggcacccactctatacctgacctagacctagcacatgcccagagctggtttttcagattttcacctttgaagtgaacttgaaagttggagtagaggtgtctaacacaaaacctgtgttctgagtctagaaaaatttgctgcacagctggaatcaaaccctgcaatcaagcacaaaccaagaacaacaattaacacaaaacagtttggtgacatttagaagaaataaatcaagagcttagagaactaccttctgcttgtctatcattattgtccaaggataagtattatcaatgcctagatcttccttcagggtctgtagaaaccacctccaagagcttagagattcagtctcaacaacagctaatggtataggatatacgcaatcatttggatcaattccaacagctgtcaaaatctaaccaccaaattttgtctttatgtggcacccatccaaacaaataaaaggtctgcagcactttaagaacccttttttgcatgcgtcaagtgacatatacaaagggattcttcaaannnnnnnnnnnnnnnnnnnnnnnnnnnnnnnnnnnnnnnnnnnnnnnn

SEQ ID NO: 32622 - DNA, 521 bp, Oryza sativa
  unsure (1)..(521): unsure at all n locations
actatagggcgaattcgagctcggtacccattaggactcggctacatgagattcaagctctgatcccagatgagctagccgatgtcctaactccagctgtctatctcgagcagcatcaattcaagctggagaaggccaagctgagactagtcgagcgtcgggagcgcaaagacatcgaggccacaatttaggccaatcggcagcttgttcatgaagagaaggccaagcttgatcagttatctgaaggtccgatcaagtctaatattgatcggcttgaagctcgaaagattgagctcctggcacaacttcaagaatgcagtgccaatctggacatggaacataaaaagctagccgatctcccaaaatctgttgaaaagcagaaagcaagactaaaatcggctataaaaaatgttgctgatctaaccaagtctttaaaagtcatccctggaaccgatgctcaagatnnnnnnnnnnnnnnnnnnnnnnnnnnnnnnnnnnnnnnnnnnnnnnnnnnnnnnnnn

SEQ ID NO: 32623 - DNA, 28518 bp, Oryza sativa
tactacctcaaacaccttcctttttgccttctcagccactgacttcttcccaggactcatcactttgggaagctggcaaatagggggagaaactacatcatcccagtctacacgagcaattgtatcatcctgatcaaaataaatcacaaatttgtttgccctgttaacaacctttgccattacttcaaagtctgcctgtgtttctatcaccctaagaccatcttcaagagttttgcctggtagcaaccaatatgccttgaagcctagactcttatcatacccaagcatttctaagaaaccatctaaactaacagcacaccaagtttttgcctcaacattatcaaaccaatccatgttctcatcttgtatgccctgttgctaccatagccaacaaagaaacccccatggtgtatctcagcagtgaatgtacccgaatccttagctgcattacaaaattggtcttcctaattagcaaagattactgctatgatggctgtcaccaaaaccctaaataatcaacaaaattcgaccacagcttccacactcgaaatcatcaaataaatagaccacagctagcataactaccacccatctgcaatcaaccaaaaaaaagctcaaattttgggtccattgtacataccgtacaccggcggcggctctcctgttagccggaacaacatgcctcctcgccggcttcaacacctccgggaggccagtgtctctgcaccctccccgcaacctctcaatccctatctcaccagtgatcacagcccgcaatttctccggcgatcgcctctgcttcgctgtccaggggagaagagagtagagaagagagggctaaggtttggagaattcgagggaactgaggggcttagatttaaaaagtgcacggtgcggggcggtgcggtgtggcatcacacgtgtcgcaacacgttgctgtccacgtatgcacgaaacgggtcaaagcgttctctagaccggattgatacaataaaacaagattagtgaccttgaccccgtgtttgtaagttcatggacctggatgaaacctcctcacaagtttaaggaccgccagtgcaatttactcctaaaagaaaatggggggagacaaacattattctttctgctatgtacaagagacaatccaatattttttctttgagtatcgtgttgcttagtttgtttagagatgcgtgttttttgcttttaatatccccgcaccccgtaacgccaaaaacattttcggtaattagcttagaggggtatctaagtccattaagaagttgattctaatcggagctagtgctgtatgtaggtccaaaaacattttcggtaattagcttagaggggtatctaggtccattaagaagatgattctaattagagctagtgctgtatgttggtcaatttggcgttgtcacaatgataaagtttttaatggtaaacaattatctaaccctatgtaggttatcttcatgtcttcctactggctccacttttggtctacaatgctaccacaggaggagcaggatactatgcgcaatggtgctacactcttggaatcggtagccaagggtctcttattccactatgggtggcgttgttccataagaattgctagctaaaatattttatatggttgaacgctagtcaataataaaggggagttggggatttgtcccatcaccttatttctcattttgatttacttttatcttacctttttattactattaaacttatggctgtgtgtcttatgacagaagccggagatataatccatttccattatctaaaaaattcatccacttcatcgatcctgcaatgttgtaggtgggtcattactctctcatccctgtcatgctgatcaattatctcttgtctcactgtctcagctatatatatgaacccctcccgatcattattcacttcccttaaattggcacaaaaaaaaagacacaggggttggagaacacaaaagtcttgagacgctattttttttaatcgcaatcttttgctgatcatccccataggacagcataaactattcctgctttggaatgggtggcatcaggaattcagaatcttgccattgcctggtgaatcctgcaagagggagcttcaagtaacctgccacgttgagtgtcctctggaatacacatggcgacaacaaggagcccgtgtcgccataggcgatggtccgccatgtcctctcgagtgacgtcgtgtacactccgtttcttgctgatgcagctgctggttcaccatgaggccgcaggctcgcctgcaaccagatcagattagtactcctaccccgttctttctttgtgttaattaccaggaggagatatttcttttatgggtggattgggctcaatcggagattataatgcgacaagcaaccccacctgaacaacaaagtttttcagcccaacttataacttttcagccctgtaatttacactgattttcgttccaaaacttgtgttccaagaaggtcctgagggttgttttgtttccaagatattagttactatatttgttaaattctgtagtaagtacttcaggatagaaataactgctagattaaccaacattgcaggtatctgcatggaagtacaatgtgcgggactgaacaatctagggtttaattgaccctatcctatcaattaaacctaaggttttggtttaccagcccagatggtctgccatgtgagctgcctgtcatttcgttcagcctttccgtctcacaagcaatccctcatctccattaattcattgatccattaaacttaaaggttttggtataccagtccggatgatctcccacggagatcgcccagtccagacattgctacgttcgcattgtagaaactacatgtggagattacgggtttcatatatccacacagacggcttattcgactgcgagcgcttaagccgtctgcacgtgctaatagaaaatcgcaaaaaaaaaattccagaaatcaaaaccctagccacagaacagtaacctagaaaccgtcgccacaaccaccatgtcgtcgcccctcccaccgccactactgccgtcatcacccctcccgtcgtcggcggatccatgtgcgggagggggagggggttccccgattttgtcagcggctgatccgccctccccgcggtcgccgacgatgaatccgtctgtcctgcggtctccggcgacagatcggccctccctgcggttgccggcgacggagccacccgtcccacaatcgctgtcgacagatccgcgcaccgttgtcgctctcgtggatgggaccggccgaatccgcgtgctgtcaccacccgcccctgaggctgcctccgccgcctgccaaagagaccttcgtctctgcatgccgccagagcccgcctgcgaggccgtcatctccgccttagccaccggtggtggagaagagaacgaggagaggaaaggaaaagatatgaggtggagtgggaaaggaagggtgagaggagatgtggagtgagagttgaacgggaagagagaaaataaaaaggagtgaaatgtgtggtagagacgaggaggagaaaaagggatgcggggacacgtgtggcccacttatctccgagttgcccgcatgcgaaaatgattttcacatgtggttctttgataggcccgtctaaaaaatatccccatttttgcatacggctccttaagatgtttgtatgtgaaaatagtcttttccatgtaggccacttaacgagttgtgtgtaaaaataaaaataaaggtcgatttttccagacgtggacacttatgacccgtttacaatatattagggtgctcttataggaaaatcatttgtgtagtagtgtatgtaactatataaggaaatccatgttatgtccgattgggtttccctttgtaactttgcccccaacctatataaggagagcacgaagccctccaaggacataacataattaggtcatcagattaatatacatccggtggatacaatagccaaacaggagtagggtattgccattaatcaagacggtttgaacctatctaaatccttattttttttatccatttaattttaagtctcgtgcgttaccacttttattattgctgattttcagaatcgacttaccgttctctaaaccgctagatttgtgataatttgtgcctgcccatatccatgtgccaatgagcgtcctgtttgatgtacggttggtctggctagacatcgctcactgtgctctggaaacatcgtaggtgcctgtgacctgcctatgatttcgttcttccatctcacacgcaatcccgcgtctccattcattcatctttcgatcgcgcctctacacctgaccttttacggatttccgtcttcgtctgtgctcctccaccggcgtctacctgcgttattcttgcttctcgattatgtagctaggctctagaaccttattgtcaagctatcctgaaccttattgtcatgccatcatgccggccgtttgaatataccagcacatggcagggtcctcatccttgcaatttctagataagtatagacattcatgatgtgactttgcagtagtagcagcaaagtcacatcagcgttcagtagctattcctgcggcagtgcttgtgttgtgcagctgcagaacatgccagctgaacaatagaagagtagcaatgtatagtagtactactagtttcaagggttatcctcctataaaagcagaagatctctgttgttgtctacttctgcacaccggctgccgtagcagcggaccccccctcccctcgaagggggcgactacgactggcgcatcactctcctccaatgccacgccctcgtccctcatacttcttaggtagcaagacaatcaatatttcatgcaaaattaaaacatgtcgtcttcaccttcactattggcatgggacatgataatgacccatcaatgtgatattcaagcataaattggattgggatatctcttcattcattaaactgcagatcaaaatattttgagtaaattgtgctttgcacaaggtagagtatcctggtttactttgcaccggatcaggatatactttcactctacatttgggtatcttgaaataattatcactctgtaaagaggttcaccatataattgaagggaaattttagaaatcaagattgaatctcctggaactttctgaccttcgacttgtttcatgaaatttcattcagattttatgagaaatttctatatgctaaacttgatacaaagtgaaacatggtgagcttcatccaaggcaaagttcaatttaaatcaattcacttcaactggcagtatatatgttcaaaatttctctccgtttttttgttctggcagtgcttgatattatctttgttagatataatttaaaattttccattacaatatgaaacaaactaatggttcttttcatattttggttagaaaaatacaatatgttcagagaaattaaaataaaaggaatcaaggaagcaaaatatctacaaattgaaatcaggtaaggaaaagccagagaatgggactgatgaactccaagatttgttgctatgaagttccaggttcaggatcgtaacgtccactaattgcaattactccagaaaacagggaaactaaggtagggatgcatctacaatcgccacaataaatctacaatattatgcgattgtggccaaattcggcattgtcacccctaatgacaaaaggtggtcagttctttgcccaactttcctaactcacctccatcattttccgtgcgcattcttttcaaactgctacatggtatatttttttgcaaaaagtttctataggaaagatgctttaaaaaatcatattaatccatttttaaaaaatagtaaatacttaattaatcataagaaaatgcgttactccattttccgtgcggagaaatgagttcccaactcgacataacgatctagcaaagtagtactctctccatttttcaatatatgacgccgttaacattttaagatacgtttgaccattcatcttattaaaaaaataatataattattatttattttattgtgacttaatttattgtcaaatgttctttaagcctgacttaattttttttatattcactcaaaaattttgaataagatgaatgatcaaacatttgtcaaaaaaaaaagtcaataacgtaatatattaaaatacagtggtagtagttgctaaaagttacacattttcgtgcaatctgattacaacattatatgacccaaagcaaacaacatgttaatgactacctagctatatataggatcaagacccataattatttttcagtgaaaagcatgttgacatattcttattatccactaagccttaatcaaagttgtttacttattgtaggttgatagttctaagtgcattgacgccatattggcatacatgcaaagttgtttacttatgcacatgaacaattagaatatttatgcattgaagcttaaatatatctacctacaaccacattatttcttttagaaaagttataacttgaagttacaacaaatatgtgggtttcacaacaactattttataagttttcttatgattggcgtgaaaagggggaggaatatgtgtattttgcaaattaatttcagaatatttgcaataaagaagcagaagaaattgtagatatgtggcaggcaaattggtgtgttataggtcaaatgctagaagcaaaaatagcacaaactattagcgaatcttatttgggataattatgaattattgtcacacaacgaagtgtgttatttattggccattgaaaattgcatattcatcgaggaagtatgaaattgcatatagctatttgaaagctattggtttacttgtagtaaacaatatcctaaataattaatgaccctttggattcgaatgattctgaatgatcaaatgacaccacatttactttggcgtaatgaataaaagttagacatgtcacccaattaatttattggcatattcaagaagaataaatattctcgtagaataatgtttgggtgatttgaaaagttccatgatggttaaactatgttcatagattaatgttttagtgttatagttatgttcttgaagacatcatgaagttatataatactaacacatccatcttatgatcatatctatgttgcatgaatataaacatgaagtgtattgatccaacttaattagagaattgaatatagtatgagtaattggatcaagtcttgggcaaataagaaaaaagctagaaaatagaggaattttgtcgactagtggatatttgtttgggcttcattgtcgcagaataataaccctctatgacttgggataacctacaatattagggatgtgcaatttttcatgccattgcattaatttttatgttagctcactgcatataatatctttaccccctttattttgtataagtgcatgttcaatgaatgaacatttccctcatatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaagatctttataagtaagaataacgtacaagccaaactaaactagaaggtttagtttattctcgtgtaagccagaagcggaagcttgctagataattatgaattaaaggagtaatcagaagttatgtttacttgtagtaaactttctgctaacagtggtataccccgggttttgaatagtatatccacaaatgcagagtgacatgttagtcaatgttctaaaatctacgggaacacgtgcggattctaagatctaatgactattttcaatgtacccattaataactccttacaactcttgtagagtaatcaccatgaaggtgaattgcctcatgaagaggttcatcatgaagatgaaaacccagaacgcacatctatctaattctggggtgcggaacaaccatacatcttatgtttggaaatgactaagatattgtttataatgaattaacttcacggaatgagtatgtggagaaaataatagttgtcgacaacatcgcctctatgattactaatatttctctaatgagaatccggatccggaaccaaagtccatggcagagttgcatagtagcactcatatcaggtctattgaagaaagcaatgaggttgaaccatagtcgctaaataagtctatgtgaacatggaagttcagacttaataggaaatgaagtggtgaaaagcgacggctcatttggtcatggaaaagaccgatattctcctactatgaatgtattaaattccactatatatatcgctggcaaaagtcatgaatgaataaatgatatgcagtttatgggttatgaaaatccatatgaagttttcactagaaagaaaacaattccgcaacatatatgtaaatctcatactaattagtatcatgaagcacactatattttcatgaagagaattgcaagactcgtagaagagtttacgatgactcacgaagagtttttctcctagaagcgagaatatttctcatagtagagaaaatgacttccggaagaataagttgatccccgtaggattatggtaatgtatgaattaccggttaatctccatataacaccgataactcgtactcccatgaagtggacagacccgttcaaacgaatgaataggaaaatcacatccactagcttgcaagtggattggtagttttctacatactataaaggtgtaagaatttatatatcatgaagatatacttattgatggtatttggcattcttattaattcccctaataccaaaatatagaccgttttatgtcactctaagtggtttaagctaattgttgaagattagtgaaacaatcaaattggtaatgatgactgataaatccaccaagagaaagttgcataatatttaacctcttgtattgagctaattattttatacataccgcatatgtgtatcgttgcatcttattttcccataatcctccataaggattaaactttgtttgtattgcacatttgaataagtgattatacatattgctcctatacgttgatttatttcttatgttcatagtagaacttatgaaataagtaaacgaaagattaaacattgtggtaattttattatcattgttttacacattaataaaaatatggttatgacattggaacatggaagtttcaacggatgtcttattgagggggagcatatatgctaaacattgattatcatacttaagacttggaagtcctatatttgatttacaaagaattaatcaaattaatcattattttgataatttaccttgaaggttactaccactatattgttgtgttaatccaagttgattaatataataaatcatatagatcattagctatttatgaagaatagtcgatattaaagattatgcgatcaagaagatcgtgtgttgtactctttttcccttagtgagtttttactagaatatttctcacgcaaggtttttaacgaggcaacaagtgcaatataactagcgtgtacgatgtactcttttctcctatctttttctcccactgggtttttggacggagtttttaatgagacatgtgtatagcgcggtattcgcccaaggagtgttatgaaactattatctcctgccagagataaatatgggctcataccaaatatatggaaacgtatcctaataggactcttcctaatatgggtatatatactgagagagagggcttgagtggttggttgatgtatccgcatatggttaaagcaataaagctgtggtgcccctccctatatccgtgttcatctactatatgattgtgtgcatgagacgtcgtctactactctgaatcagcgaataggccactagttatttaacaagtagctactcccatgaaaccattcatcacttcatcgatcgtgcaatggtacagggtgggtcattactctctcgtccctgtaatgttcatcgcatctggtctcactatcttagttatatatatgaacccctcccaatcatttttcagttcccttcaatttggttacaacatgccctcggctgcaaaagagactttagggttaagcacacaaaagtcttgagagatgactttttgtaatttcagtgttatgaacatcccaataggacaacacaaacagccccggctttggaatgagtggcatcagcaattcagaaccttgccatggactgatggatcctacgaaaggattgtgatggcctccatgaagcttatggttcacgacacagggtggatttgcccttgacaactcctgtcttttctttgtggcattaggagatatttactttttaggtaggctaggatcaactggggttgtaattatagaaattaccatctaaaaaacgttctttagcccaactggggctgtcatgtacgttgaatttaggtccaagacgccttccaagcagataccaaggttttttttttaagtaagacatatatattgaccacattatcatataactagatttaagatgatgcatcacaaaactataaatttaacatcaaatttataaaaaaaacatatacatttaaggtgaaatatgacaaaactacatatttcaaatgatcggctcttcctagaggaggcgcgggaaggggaagatttcttcggtgctgacgagttcacgttctaggtcgatccgctctcaggcaacacctgtgttgttttgttattttatcttatgttgggtatggtttttctatttgtagggagtgtgtcgttgtaagtttggtctatcggcccctaaaacctactctaatatactcatatgtaatgtttttatgtaaaatctcaaatatatgtaccgaaagatattttgtttatcaatctgtacacgatcaaaatcctggacgatcatgggtgatttcaagataccgtactcaaaccgagtatccctacagttttgtactccctccgtttcatattataatccgtttgactttttcattagacaaatttctttaggtttgactaagtttattggaaaatttagtagcatctataacatcaaattagcttcattaaatttaatattgaatatattttgataatatatttgtttggtattgaaaatattaatatgtttttctacaaatttgatcgaatttaaataagtttgactaagaaaaaattcaaacgatttataatatgaaatggagcgagtacaattgtagcactaaaattacattaataaactttcatattgcattcatcgttcacccctacagttgcagtcattgttgcgtggaagatagatgtagtataagggttgcagtggcagtcattgtccagtaaatccccgtgatcacgcagtagtaccattaaattgcttcaaccaatcatcctattcatattcatcttttctactgtacataagaactgcgcagaaacatcccaaaggacattgatgctctttgttagacaatctcgttagcttggcctgcatctgggcatgactaaggaatgagaggcatagagaagagaagcatcggtatccacccgttaaagcaggaagcaaatgatgtctagctccaaccatggatggcgggctggctgctggggacaaaccggctgggaatttgattcatggcaagctgaagctgaagacggaagacaagcagatgtggctaatgaacgaacaacagtgctgtctgctgtgaggagatgttcgttgatgcaagaaaacctgaggctgctggtggctatcacacttgctgttgctaattctttcatcaatattttggttgctagttggtacaaaagatatcgcactacctgaaaaatataaatacatgctagctagcttagagaactgggggtctggaaaacattatgatcgtctccagtactgccactcttcatatttcaccaacatatgagctcttataaactatagcatgatgaagagtggaggtgctgtacacttgagttctaataaaggtcgaggcccccatcatttggcttattaagtgaataagaaacggcatatttacaaataaaaattaatctgtaacctttctttcgtcttctccgacgagaagaaaagtcgtgcagtcctcaaattatcccaacacgattgatatttgttcatttctaatagattcttgattagtttttgggacaattgcttatttgaccctattttaaagcccaactaccaatttgaccttactttttcaggtttgcttatttgaccctcttttttgaaattgaagtttccgtttgactctgtttagacttcaccgttggaacaacatttagaaaaaagaaaaaaaaaacatactaccccaaagtgacaaaaatacccccatattactaattaaccctatccccacctctccatcccaaattcccaatccccacatcttcagtttttagtcgccggcgatggcgagtgctgcggccgacggaggaagcggtggcatcggcgcgcaggaggaaggagcggtgtcggcggcagctgccgtgcttgaagcggacagagggagcggcggcgccggtggctgccgggctcggagcagagggagggagtggcgacggtggcgcgagggccctcctcatcgccgacccaacgcttccccttgttaacgaccaaatttggtaatatcagcatcggaaaagaggattagatcgaagtggagtcgaaggcggagatcgattcgagaatagagcaagaatcggctggagtccagatcggctacgattaggatcggctggatccgagtcggactgagtaagttgatatagccgattctgataatacgacttggtatacgatatcaggttgaattaagatgcttcaagatggttgccgcacatggatagagtcttgagaaggcaattgtatctattaattaggacattttatgtaatttccttagagatatgtttagggaaaaagtctgccgcaaagacttatggtatcttagagtttgttagagataagagtcgtgtccgatatggacatagtttgtaattttcgggtataaatagaccccgaactatcacgcccagaaattcccgaatagaattctaagtagaatgtgcattaaaatccccgtccattaccggccggggtacacaaacgacaaagttaacatatagatccacgtcttacaaatattataaaagtcttacataaatgcagcggaaaattaaaagataactggagctaagccttgacttggactgcagcgggaacaccactccacaggcattctcgacggcacggacgaagcctactcctcagagaaaccaccatctgatgcatactcaaactctgggggtttggggaaaataaagcaagactaagtacaaccaccgtactcagcaagtcataccggaacagggggtatgatgcaggatattaccaaaggatagctagagaggttcttttgtataaagcgagcatttataaacagtagttgaaagcaggaaaatcaggtgtaataattaatcaatattaaccatccactgtccaacgctataccacgttgcaacaggcccaaccaaccacctgaactaatcagttccatcagactaaactagggtgagactaatcacggtgaatctcgttgaccgcccataactgcggacacggctattcgaatagttttactctgatcagaggtgtacaactgtacccacaagacacagccccacgacatgtttccatacgccgacatgccaccacgacataccggaaagaggccgtgacaggactcttcgcataaccccatctagccaagcacaccacacctcaggtttcacccccgtccccagcgggcaacgggcagtcccctctcgtgcctaggagaatccggaagcaacagaggccgtcgcagggcccgcccggctccatcacgcccacccttgcctggatgcgtcagctagaggaaagctacactacaagcccagccgttgcccacgctagcttgtgataagtacgtggaattcttccaggggtttcccgcgaaccgatccttaagtgccatgggcgcgaccatcgaagccaagcacccacagcccatcgtttaatatattttaattaaccagcaccggagcggtggtattaaccaacatcattactagaatcagatatctatgctttaatgtattttccccactgtgtgctagttgaactaagcatggctaagcaatccctagtctaatatcaagtcatgttatatccccaagctaacaacggagcatgatacaaaactagtatggctgtaacagtaggtaaacatcccatggtgacattataaaacgatgcagcatttaaagtaaaacggtagagcatttgtaatataggatcaacatgttcaagtgacaagcatgacttgctttgctctactgctggaggaacctcggcgactatttcaaagtacaccggagcatccggagagccggaatctaagcgacatacaaagcaaacaatacaaacaggctataagactactgaaacaaagaacaaaaccatttttaatggattcttcacattcttcttgatttactgagacttgaatgggcttaaacggagctcggatgaattagatatgaattttagaagattcaatgtgcttttactataaacagaaaaatccttaattgatttattgcgtaataaataaaatcccggggagagagagggtggcgccgacatgcgggccccacatggcagtgactcggggagggcggtccacggtggaccgtgtccatggaccggggaggagcggcgcaccacgtggtgcacacgtggtgccgacgcggcgcacacgcggcggccacgtggcagccacgcgggcagccggaccgatggccccgatatacccggcggcagggagctcgcggccagcgcgcgcgggctgctcaagccgacccggggccatggcgcggcggcggcgcggcaccggcggcaaccagcggacagcggtggcgattcggcagacggcgacggcgcgacgatggctaagcggcggcgctactagggaaaagagaggaggaagaaggaaggggaaggagggatgtcctcaccgaaggggtccgaccggcctggagggagacgacggtgaccggcgacgaggaatgacagagggaggtcgacaagcggcggacggggtctgggacgacctaaggaacgaaatggagaggattagtgagggagagagaccatagagggcgggaatgccggccgaagacggcggccatggcgtttcttaccggcgcacgacggggatgaggctccggcggctaacctcgacggaggaggggtggacgaggtggacctcggccgcgcgaacccaacggtggcgatggcgcggtgcggcggcggccctagcagcggctagaggcggccggagtagaggaagaggcggcggctggtgggtgcacggtgcgggagcgatggagagctctggagaggccggcgcaaaaaggaaaaatgagaaggacgcggggatggattatataggggcggagaggtcgggaacggcctggagtggcccgatttcgccggccgacgtggggaggtggaggtggagagagaggcgggattcgaaattcgaatctcggccatctcgggggcgcgggcgagcgggagaggggttgaggggtgcgggaggggcggacgcacacgcgggtgtggccgacgtggcgcggggaaggcgggcgcgggcggttgcgaggcggcggctgcagacggtgggcggccaaaggttagggatgggcctaacaggtgggccctacctgtcagcgcccgagggagagggaggctcgggcgagcggatgggctgtggccttcggtcggcccagcaacggcgcgggaggtggaggaaatgggccggcggcccatttgggaaaaaggaggggacaaaggaagaagaaaaaaagaaaagaatttccaaggattaaataatgctggtgctcatttttaattggttaaaattatttctagagctctaaaaattccactaaaaatcttgttagcatatttcgacatatagaactcaagaaaaatcccacatgccaattccgattattatttgcattaatttattagggtttgtcttgctttgacaccggtattttctctaggtgatttataattttcatttaggcttgggaaagaaacttcagggtgtgacacgaaccccatgtaatcagttaacacactcgttcaatacaatttcggtgcatcaccacccttttgcttttgttttatttcgacgagtccttgctttcgggttgagctgcatcggtttcgatcttcaacaagaggtaaaacttgttatgatggcttgcgttctcgggattagtgcttccatctttatgatactctaatcatgtttatgtaattcatcgagttatcatatatcttacataatctctggcaatatcattatctaacctacaatcgactaacatctgtcagtagagggcagccgattaggttagattttgatgttgatttagattatataagatctccaccactctatgaaacttccagcggcttgattgtctagatattgttcttcttttcatacttaatgctgcatcacttgagtttgatctattaagtcgtgcttagaatatcagtctctagcctgccttctagttgccgattagggtagtattggagtttcagccgatcttatctggtttaactacatttgctctatatgcttcgttgacatgttaaatctgccctttatgtcaagatattattgcatctacgtatattaaactttggtttggtatattctgcttgttttaatatcttaacatagaactgtatcagagtattagccgatacatgctagatctatctgatcagctatgctgtaaacatatatagttcggttattaatatatatttcgatctaagtgatttatattgtctcggcatagcgaccgatctatcccaatcacttgatttaaatatatatcgatgtaaaaattatatattgttaatatctacagccgatcgaatagatttagtcctttattatctatttccagctgccgatcaaatcgactggtacgctagcatacccgaaggcgagttttggacctgcactggagttaaacagatctcccaggcctcgtgttttacgtcaacactcttttggcatgcccgatgggaccgataagaagtcagacaagcaattccttctcatggccgagaaaccaccgctatcaccatcttcggctagttcaggcactgtcaaggagaagatccagaagttaggtttgaccgacgtcaatgaagggaacgtcgtacccatcgatccagaaaaattcacacctgatcaaaagaaagattttgaagcgatgatgcaggcagcacgtgatcaattcttgaactcattcatgcagactcgcaaggggacacttgttcagaagtataaaataaaggtggttcttgacgatcccgagactggttcctctaaggatggagaaggaaaacaaactcaagatggctcggctcaactgaatgacaaaggtgctacagatggttttccaccaaatcaaggtgacaactctcaaggggtacatggggttcaaggtgatggttttagggggttcaaggtgatggttcacagggagttcaaggtggaggtgttaatcaagacgacaatgcaacgcagttgcagttcaacaacattcaagatcaggttgactatgctgtaagtcacgcccggaaattcactagtaatttccaaacttatttgtgcataaaatcctcgtccaggaatcagccgaggtacacaaactgacaatttaatatacaaatccatcttaataataatgttacacgcttacaaaagaaaagaaaatagcagcggaataacggtctagcgatggcttcagctccaatcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaatagcacacccatgctgcacaggcccaaccatcctgaacaaccatacccggctgtacagatctaactccaaaccaggagctaaacaaattattaccagatatagtatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtgcccgaatagaggctgtgacaataccctctgcacaacacaactcaccacaatgcaccattcctggatcataatcacccccttataaaacaaggcatggcctccccagcgacccccgtgggcttatctccgccacttctcagtctggtgctccgcaatgaatcatattatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtggcttgccttgcaataatcggtcttcaattaatcttcttgaatacctccagcacactcgcgaaccttcgcaacgacggaaacgacaagctaacacgcaaaacgaagaaaaagactaataaaaaccaaataaacagtaatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttacacaacctttgcaacttgaaccacattaaactgagttacaaagaattagttatgaatttttaaagattaaatcggattaaaacatttatatagattttaattgaattatgacgcaataatgaattatttttgaaaaggaaaagaggattattgcgtcaacgggctcgggttcacggtggaccgggtgcacggcggcggctcacggaaacgaacggccgagatctaccctatccacaacgaacggccaagatctaaacggtctacgaccggtctatggcggacggcaacgatgacgtcagcgatgacgtcatcaccggcgacggctcgggcggcgcatgctcgccggcgaacgatggcgcgacgacgcaaacggaggacaccaacgggtagagggtgacgcggcgaactcaccggtgaccaaaacaacggcggaagagcaacagacggcgccggcgacgaggaagaagcggcgacggtcttcgggtcgacggtgacggcggcgctccggcggtcttcggcggcggcgaagcggtggacggggatggcgacgacctcgcgatcccgatggtggcgacggcgaccgacgacggcggctgcaacggcggcgcggcgcggctgaaccgatggcaacgacggcgacggctagggctacgcggaggcggtgctagacgcgacggcgggctaaggcaaaggtggcggcggatagaggagagctcgggggtgcttataaaggggctagcgagcggcgatggaggccctcggcgatcggcggcgagaaggaaagctagggttctgaggagagaagtcgatccaaatcgaactcgaatccttggatttccaaacgaaagtagccgacgattccataagagaaaaggaagcggagatcgagaagatcattttccctctattgatttcaccggatcgggaaaggatagaccggattggaaagcggcggcggcgcggctcggctagggttcggccgggcgacggctggaggaggaagacaagtccgacaggtgggacccacctatcagcgactgagagagaggaggaaggagcgcggcgggctgcggctcggctgcgggccgacttgggccggggaggagagagagagcggttttgggccggctttcggcccaaagccaaaagagacttttaaaaacctttttcaatttaaattattcatgaaatgatattccattgattaaaaatacttccttggctcaaataaatcctagaaaaatctaggaactatagaatcaagtaaagtatttaatgaaattttatctggccccattttatattggaatttattaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaaattaaatccatccatgctttatatttaggaaattttattttccacatttaacttcacttgtaaattaaagaacatttaatataaattctaataataatttattaaataatttataaatcctgaaacaaaaatcaggatgtgacactgtacaccatgctttgatcaatcaatctgagaaatatggtgaagtcaatgattgatggttcaatggccgagtatcaggttacaggaccagtttacctacaaggaggggtgttcccgaattatcggccgttaatcaccgataatctaccagtcgccagtcagtccctcttaatgcaccatcagctcagccgacgataccagcatcggctcccgcacctactgcaccaccttcagccccaggccaattaattaatccccgattgttggtgagagaacagccacagcacactggacagaatgtgaatcggctaacgcaagaccaggttgcatctatgttcttacgtcctcaacacaccattgatccagcccagcagcagccgattcagcagacactaccaaggcagcaggttgtgcaaccagttcagcaaacacctccaatccaacatgttgtgcaactagttcagccaaacacctccaatccaacaggttgtgcaaccagttcagcagacgccaccaagacgacaggtcttgcagctgattcagcagacactgttgaggcaacaggttgtccagccgattcagcagcaaggtccgatgaatgcatcggctgggtttgcaacacctggtggtcaacccatgcagcatgccgcaaatcaggttgtcccagaacacttggttcatcatgtgcagccagatggcacggttgttcctcaagttattcctgaacatttggtgtgcaatattcagccagaccttcaaaattaccaggggggcaacttgaattatcaatatcacccaccatcacctcatgttcagtaccagcaagcaggatcggctcagccccaatttgttcctcaatacaatcaatttgagcctatgccacaacaacttcaaggaacacctcaacagcggccatgggccgatttgattgtagatgtcatgaaggagcagttcgggcttaggccgaaagacgctggaaacctatatcgacagccatatcctgaatagtttgagagagttcctctgcctaaccgatttaaagtttcagatttttcaaagttctcagggcaagatagtacatcaacttatgagcacattagccgatttttagctcaatgcggtgaagcatcggctgtagatgccttgagggttcggttattccggttgtctttggctggatcggcctttacttggttttcttctttaccgtatggatcaattaatagttgggctaatttagaaaagcagtttcatagctatttctatagtgggattcatgagatgaaattgtctgatctaacatcgatcaagcaaaagcatgatgaaccagtgcatgagtatattcagagattcagggagatgggaaataagtgttacagcttgagtttgactgatgcccagttagccgatttggctttttagggtatgattgctctaattaaggagaagttctcatatgaagactttgaaagcttgtcacaccttacacagaaggtagccttgcatgaacaaaggtatgcagaggctaggaaaaattctagaaaggttaatcatgtttgcccttatatatatggatcggacgatgaggatgatgattatgagatagctgcagctgagtgggtaaggagtaaaaaggttataccatgccaatgggtaaagagctcaggaaaaaaggagaggtatgactttgatatcactaaggctgacaaaattttcgacttgctactccgagagaagcagattcaacttcctgccagtcacacaattccatcggctgaagaattaggtaagaaaaggtattgcaagtggcataattctgggtctcatatgactaatgattgcaaggtcttcaggcagcagatccaagcggctatcgaaggaggcaaaatcaagtttgatgactctaagaggccgatgaaggttgatggcaatccttttcctgttaatatggtgcatacagctggccgaacagccgatcggggtcgtgcaaggggttttcaggtgaattcggctaagattatcaacaaatatcagaggaagtatgacaagcagcaggagaagcatcatgaagaagacgacgatggctttgatcctcattgggttgtgagttctttagatgttgttggaatgaaggtatgaggttgcaatctattgaagactgtcctaggtgcggtgatattgccgagagctcaagccgatcatatagtaggggcaatcggctaaggcagacaagagttcctgttcatcaaagattgggtccagtgaatcaagatcgtggctaagaggacaatgaaaacaagaaaaatcaatggtgtccttctggtatctttacgaagaatcaaaagagaagggttcaaagattgaggaacagggagcgctttcaggaggtcgagcaggaaattaaccatttgctgaagaaaacgaagccgaggcgggtgtggcgtgttaagaatcaggttcctgtagccgatgaagccacagctgatgaagcaaaaaggttagctaaaggaaaaagcgtcgtaactgcttcggtcaacatggttttcactttgcctgccgagtttgggatcaagtaagccgatatcgatgaagttgaagaagaatcggctaaattgattttgtcgccagggcaggtagtttttgagaagccagaggggacagagaattgacatcttcagccattgtatataaatggttatgtcaatgggaagccgatgtccaagatgatggtcgacggtggggctacaatgaacttgatgccttacgctacattcagaaagttgggcagaaacgctgaagatctcatcaagacaaacatggtgcttaaagactttggcggcaatccatcagaaaccgaaggagttttgaacgtggaactgacagtcggcaacaaaaccatccccacaacattttttgtcattgatgggaagggttcttatagcttgttgtttggaagggatgggattcatgctaattgttgcattccttcaactatgcatcaatgcttgattcagtggcaaggcgacaagattgaaattgtgccagccgacaggtcagtcaatgttacacgtgccgatttagctctttgggagatggatggtcttgattgtttatctggaaaagtttgggatggagattttctaaaagtgtccgattctgatatacagccaattgaagatggagagcccaagctattattttgagggcgccgtggaggattcacatgtctacaacaaggacacggtagatgatctcgatgacaacaaaggtagggttttatgtcggctgatgatttggaaaaattgatataggtctaggtgaccgccaaggccgacgtttattagtaaaaatttatctgcagaatttagaaccaagttgatagagctgttaaaagaattcagagattgcttcgcttgggagtattatgatcaaatctttatggctgaagaagatattcataagacaactttcaggtgtcctggtgcaatcggcttgttcatatgggttgtgatgactttcggcttgaagagtgctggagctacatatcaaagagccatgaattacatataccatgatctaatcggctggttggttgaggtttacattgatgatgtggttattaagtctaaagaaatagaggaccacatagccgatttgaggaaggttttcgagagaaccagaaaatatggcctgaagatgaatccgacaaaatgtgcttttggcgtatcggctggccagtttttgggatttcttgttcacgagagggggatcgaggtgactcagaggagtgttaatgcgatcaagaagattcagcctccagagaacaagacagagctgcaagagatgatcggcaagataaattttgttagaagatttattactaatttatccggtaggttagagcctttcacaccattgttcaggttgaaagccgatcagcagtttacttggggggcagagcagcagaaagctttggataatattaaggaatatcttagttctcctcccgttttaattcctccatagaaaggaataccttttagattgtatctatctgccggtgagaagtcaatcggctcagtcttgattcaggagctatattgaaaggaatgagttgtattctatcttagtcgtcggctcttggatgctgaaactagatatttccctgtcgagaagttatgcttgtgcctatatttttcatgtacaagattgaggcattatctactatccaatgagtgtactgtcatatgcaaggctggtgttgtcaaatagatgttatcggctccaattttgaaaggaagggttggaaagtagatattctctttaactgagtttgatcttcggtatgagtcgccgaaggcaattaagggacaagctatagccgattttattgtggaacatcctgatgattcaatcggctcggtcgagattggccatggactttattctttgataggtcggtatgtactaatggttgtggcattggcttggttataatttcccctcgaggggcatgtttcgagtttgcttatactattaaaccttatgcgactaataatcaagctgagtatgaggcggtgctcaaagggttgtaattactcaaggtagttgaagccgatgctattgaaatcatgggggattctttgcttgtaatcagtcaattggcaggagaatatgaatgcaagaatgatacattaatggtttataatgagaagtgccaagaactgatgaaggaatttcggctggttactttaaagcatgtgtctcgagaacaaaatattgaacctaatgatttggcccagggggcatcgaggtataagccgatgatcaaagatgctaaggttgaaattgcagcaataacagccgatgattggaggtatgatgtgcatcaatatttacataatccatctcaatcggcttctaggaaattgagatataaggcgttgaagtacagtctattggatgatgagctttactatcggacgattgatggggtgttgcttaagtgtttgagtaccgatcaggctaaagttgcaatcggcgaagttcatgaaggaatttgtggtactcatcaatcggctcataagatgaagtggttacttcggcgtgcagggtatttttggctgacaatgctggaagattgtttcagatattacaaagggtgtcaagattgtcagaagtttggagcaattcagcgagtgccggcgtcggctatgaatcctattattaagccatggccattcaaaggttgaggaattgatatgatcgatatgataagtccaccatcgagtaaaggacataagtttatattggtggcgacccgattatttcaccaagtgggtagaggcgattcctttaaagaaagttgattctggggatgcaattcagtttgttcaagagcatataatctaccagttttgtattcctcaaactattacaaccgatcgaggcttaattttcgtgtccgatgagtttgttcagtttgctgatagcatgggtatcaaattgttgaattcttccccatattatgcacaagctaatgggcaagctgaggcatctagcaaaagcatgatcaagttgattaagaggaaaatttctgattatcctcggcattggcatactcgtttagccgaagcattgtggtcttatcggatggcttgtcatggatcgattcaagttcctccttataagcttgtttatgggcatgcggctgtattaccatgggaagttaaaatcggttcgagaagaatagaattgcaagatggtttgacagccgatgagtattataaccttatggccgatgagagggaggacttagttcagtcgcgtttgcgagcccttgcaaaagttaccaaagataaggaacgagttgctcgacactataacaagcaagtggtacccaagactttttcggaaggtgaacttgtatggaagttgattttgccgattggaactcgggataacaaattcggcaaatggtcaccgaattgggaacgaccgttccaaatctataaggttgtgtctaagggggcatatatgttgcaagggcttcatggcgaagtctatggacgagcgctcaatggtaagtacttgcagaaatattacccaagtgtttgggttaatgcatgatcggttagtgttgccgatacatgatagccgatgggtttgcatcgccttgggatgggcgatattgttatatcgcccttagttgtttttatgttgtaatcagttgaggtttgccgatttacaatggccgatattgttatatcgcccttagttgtttttatgttataatcgggcccttagttgtttttatgttgtaatcggttgaggtttgccgatttacaatggccgatattgttatatcgcccttagttgtttttatgttataatcgggcccttagttgtttttatgttgtaatcggttgaggtttgccgatttacaatggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccac

SEQ ID NO: 32624 - DNA, 6343 bp, Oryza sativa
gaggctgttttgccatgggaagttagaatcggctctagaagaacggaattgcaaaatacttttacagcagatgaatattacaaccttatggccgatgagagggaggatctagtctagtcgcgattgcgagctcttgcaaaagttaccaaggataagaagcgtgttgctcggcattacaataagaaagtagtacccaaagatttttcggagggggaacttgtatggaagttgattttgccgattggaactcgggataacaaattcagtaagtagtcggcgaattgggaaggaccgtttcaaatttataaagttgtgtctaaaggagcttacatgttgcaaggactcgatggagaagtttatggcagagcactaaatggcaaatatttgaagaaatattacccaagtgtttgggttaatgcatgatcggctgttgttgccgatacatgatagccgatgtattttcatcgtcttgagatggccgatattgttatatcgcccttagtcggtttttcaaattgtaatcggttatggtttgccgatatacaatggccgatattgttatatcacccttaattgtttttgtaattttatcaatgctattaacattataaaattagggggggcacatatgtacaaaaatgaaagtgaaaatttttgagcaaaatcagaagttatgttaatcggcacaaaggattgttaaaacaacagagtattaaggtatcttagccgattacaaaaatttctaggtcctattacacaaaagttattgagacaagtacagctggatagccgaaatagccctttgcgtaatttgttcgacttcttcaatggcttgggcatcttgagcatcagttccaggaatgatcttcaaagacttggtcagatcagcaacattcttgatagcctatttaagtcttgctttttgctcttcgacggaccgcgggagatcggctagtttcttgtgctccagatctaacttggcgttgcattcctgaagttgtgccagtagctcaatcttgcgagcctcgagccgatcaatgttggatttgatcggaccctccgaaagctgatcaagtttggatttctcctcatgcacaagctgacgattggcttgaattgtggcctcaatatccttgcgctcccgacgttcggctagtcttaacttggccttttccagcttgaattgatgttgctcaagatagacccctggagtaaggatgtcggctagctcatctaggattagagcttggatctcaagtagccgagtcctaattggcccacagtttaccaccaagttatctaatgatgatgcttccagccgatgacagatatcttcaagtgtcttcttcacatcatcggataagggagctagagctttgcttgaagtatcttcttctgtctcatcaagataatctctgatatcaaaggagaaaagatcggctaaagcctgcagagacaatttcggagagaataagagctaggtaaaatatagccgatctaatttcttgtatcgaaggaaaaatactgggatagcaggagcagctggttgttcttcctcaatgtgttgacttcccacagccgatggagttcggtcacttgacgattgctggacggaaggagaaggaggaggaggaggctgtaaaataaacgagtgttatataaaatcggctgggatcaactaattaaaatcgagactatcttattggtggagctggtttagatgttgctgcagccgatttcttcttcatagcaatcttgttttctgtaattacaaaatttgtgagtaatcggccataaagtaaaatgattacaaaagggatcaagaagagttgcttactcttgtgaaatgagtgcgagcagaaggagttggtgatgtctgcttgggtgaagttgatggtgttctttctatgtcactcacttcaactgcagcctgatcaacatcttcaccaatttcctcttcatctagagcttgttcgatggatggatctaaggcaggcagatcatcagtcggcttatcagtcgggttagttttcttggacttggcctttttctttggagctaaggccaaagtacccatagccgatgatctagtttttcttttcttgcctgcatcggctggttccctgaataggccgtgatggagagttgaagtctttggggcatggtagtcaataacaggggggatggtccacctccattaggaatcagacctggagcatattcaatgtcactgccactgttgctttggtgcggaggggaagagtcgatcccctgcaaaacaagaacaaaagattagtcaagtgacgaatcggctaaccatcattcaagttaataatgacaaggtttacctggggtatgacatcagggaataggtctgtcatatacatcgaagtcgattgatgaaaacaggtgcagcttccattcaccccaccatctgtcgaagtttctgctcttgaatcccgccaactcaatgttgtcaatgctgcctagagggggtcctgggaggttaagcagccgatccatcatcagcgttgatgtgatttctcctcggcactggatcttgtcggcaaagaataagccgattgggagttggcctaatccaagttgtctagccgagctcattgggtgataaaactcataggaaacttggatatttcttcttgatgaatgccgacaggaaggatgcatgggctgattgcagctgtaagaatttctctggatttttgatacttttcatgattgatatcttcaaatctaaagtctgatggaagttcaagatctactgagtcttcataaggaaaccaaactcgggcgtctttcttaaagccttcatagaagctgcagaaccaatccttgagcagctcggccgatagctttgctccagcatcggttggtgtggacgcatattccccatatgatgtgcatctgcgatgagtgtgttcttgtccatcatctcctacaatcggctctggcaatgggaactcagcttctgtcacagatggccgattgacgactttcatgaccattaggttcaaccaggtttgcagcagccaccatggtccacctgcaccgactactgagctgacggctatcttggccgatgcattgttcaatgtttgttataagtagccgaggaggatcttgctaagggaaattctttctttgattctaaggcttcggctacaaattgtcagttggttgtagggccacaactggatccacaaaagagaaatttttcgaggcacattagcaagaaggctacatgctctcgaggagtaacagacccttgacccatatatgctgctacatagccagaccaaccacctatgctttttgtcctgaagtcgaattgattcttggtgttcatgctcatgggattagccgatgaagtcacatccaaaccagtgatcatggtgatatcgatcaaagttggagtcatcggcccttggttgaacaagaaggcattgagggtgttggaccaaaaataggtggcggcagccatcagaggttcatccttagcagaattggctatggtgagagcaagcgcttggccgatcccaatctcatcccagtgaactttcttactagccgatacgtgctggtaccaggtggtccaactcttctcaggggtggttttctcaagagatggccaagatttgaaagtattcttccagtgacccagattagggttggttagttgtcacgtcccaaaacgactctaaaatacatcctctaaattaagcctagaataattaaaatccgtgtgaaagcctccaacaattaaaatgtgcaaagttaaaagtcaaataaggcttagaggatttttgtatatttcctaaaagcctaaaatgtgtacataaattttagtggaattttcagagcacaaataataattaagaagaaataaagaaagttaaaatgattttataaaaagaaaaaccataaaatccctccttctctctaatgggccgaattcggcccatctccctccccctctttctcctcttcccgcggcccattcggcctccctcctcgcgcgcgcgccgctgacgggcgggcccacccgccaccctcgctgacgggtggggcccacccgtcatccccttcctcccgccgctcctgccgccgccgccgccgaatccgccgcatcccgtcgtccccgcgtgcaatcaataggggggaattattccccgtgattccctctccctttcccctcaattttccctccctctctcccttggattcgtttggaaatcctcccctaatcccgccgacgccattgatggaacccgagaacgccgcgctggtttccttcccctccggccgctctctcccccttccaaccctatttaaaccctccccgcacctcctccgtccgtttccgcctctcaccgcccttcctcctcgccggaatcgagctcgcgccgtcgctctctctctcctccgttgctgacgacctccggccggctttctccgctcgccgggaccgtctcccgcctcagcgctgcctccttcggcttcgccgcatcctcgccgacttcgtccacctctccgtttcggtcgccgaccaccggagctccgccgtccccgacaacccgagccgcgccaccgcctccctctgctccggccgcctcctccgtcgccgccgtcgccccggggtgagccgtggaccgtcgcctcctttcccccttccctcccctctctcggccgccgctccgccgcgtctatggccgccgccggcgaccatcggggcgcgggcgcgccgcctcccgccgaccgcgccggcgtggccgccctcgtgcgcgccgagtggctgccgcgtggggcccggccgtcagccgcccgcgccctcgggtgcggctgacgcgtggggcccacggcgccggccggtgtgagcccgggtgcacccggtccaccgtggaccgtgaggctgccacgtgggccccactcccgtggacccggtccgcgcgcccctccccctcggctgatgcaataaacccctttttaaattaaaatttaaatgaagaaattcgcaaatattcatttaaatagcatataaacttcaaatggccataacttggccatttgaactcggaattggaccgttcaagtctctaatttttccttaagaagtcaagaacccatttttgtgctttgttcctacttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcgtggtaccactagtatgaatttaggtagatgcttcgccgcttaattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcatagggccggtgtcctgctgataggggctcagtcctgcctacctgtcccaggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttataggcaagccgagcaatgtacccaagttagtgtttttatttttaaaacctggttaaccactgaaatgtggaaatagttggcctgggttagcttgggacgagctgggaaccagggtcgagttgccagttcggtctgaatcatcgtaggggtaccgagctcgaattcgccctatagt

SEQ ID NO: 32625 - DNA, 16699 bp, Oryza sativa
  unsure (1)..(16699): unsure at all n locations
tcaccctagaataaacaaaaccccaactagtggtcactctactcatggtaccactagtatgattttaggtagatgcttcgccgcttattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacaaagtcgggggtcaatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccatggtggtatgtggcacgtggttacatgtgaggaagatctgtcttgtgggtaaagatgtacacctctgatcagagtataacctattcgaatagccgcgcccttggttatgggcaagccgagcaatgtatccaagttagtgttttaattttaaaacctgcttaacaactaaaatgtggaaatggttggcctgggttggcttgggacgagttgggacccagggtcgagttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacggtggttgtactcagtcttgctcaattttgccaaacccagaaaaggagccccttgatgatgaaggctttggtgtttagctcgtgcctgcagtcaagcgcctgtggtcgtcgcccttgtcttccgctgtttcccgtttgtcttcttgtgtgctgggccttcgccgcccatgtaataatgtaactatttatgcttccgcttgataaactctgaaatgtatcaactttcggtgtaccttgcctcctggaacaaggaataatacacgcacgtaaggaacgcccgttgggttatttccggtcgtgacactagtctaaaggggattctgttggtttcaccaatgatgaaatcaatggggtcaatattgccgattgggccaagaaaatagtggttttcgtgcgaccggctgggaatcgcgactaggttggaaaggtgctgcaaatccaaaggaatcgggaagcagaaagcacgatgagaaaagaggaaatcgatttcatgcgaggaaaagggatctatccgatgagaacttacctcagcgtactctgccgatggcgcggtagacgggctagcggaagacgacatcaccataggcggagatctgatcggaaatgaaatcgcctgggatcgccttgtgtgttggagagatcgctggagagagagagaacaaagttggttttagcggtgaaaacggaggaggacggtgtgaaatttttcgagggtgacggttagtatttaaagcacaactgtaacagtcggaaaacggcaaagtgcgaaacttgctcggagttgatatacagcaaatccggaacattaccaaatattccagacttggggggcatatgttaacgaccaaatttggtaatatcagcatcggaaaagaggattagattgaagtggagtcgaaggcggagatcgattcgagaacagagcaagaatcggcaggagtccaaatcagctacgattaggatcggctggatccgaatcggactgagtaagttgatatagccgattctgacaatacaacttcgtatacgatatcaggttgaattaaggtgcttcaagatggttgccgcacttggatagagtcctgagaaggcaattgtatctattaattaggatattttatgtaattttcttagagatatgtttagggcaaaagtctgccataaagacttattgtatcttagagtttgttagagatacgagtcatgtttgatatggacatagtttgtaatttttgtgtataaataaaccccgaaccccatgtaatcaattaacacacacgttcaatacaatttcggcgcatcgccacccttttgcttttgttttatttcgacgaattcttgcttttgggttgagctgcatcggtttcgatcttcaacaagaggtaaaacttgttatgatggcttgcattctcgggattagtgcttccatctttatgatactctaatcttgtttatgtaattcatcgagttatgatatatcttacataatctctggcaatatcactatctaacctacaatcggctaacatctgttaatagagggcagccaattaggttagattttgacgttgatttagattatataagatctccaccactctatgaaacttccagcagcttgattgtctacatattgttcttcttttcatacttaatgctgcatcagttgagtttgatctattaagtcgtgcttagaatattagtctctagcctgccttctggttgccgattagggtagaatcggagtttcagccgatcttatctggtttaactatatttgctctatatgcttcgttgacatgttaaatctgctctttatgtcaagatattattgcatctacgtatattaagcttcggtttggtatattctgcttgttttaatatcttaacatagagctgtatcggagtattagccgatacatgctagatctatctgatcggatttgctgtaaacatatatagttctattattaatatatatttcgatctaagtgatttatactgtctcggcatagggactgatctatcccaatcacttgatttaaatatatatcgatataagaattatatattgttaatatgtatagccgatcgaatagatttagtcctttattatctagttccaactgccgattgatttacatatgacatcggctcagagataaatgatatgtcatcggcatctagccgatcagctatcatttataggtttaactgcggtttctttgtctttatttcttgttgattgcaggatcaaatcaactgccacgctagcatacccgaacgcgagttttggacctgcactggagttcagcagatctcccaggcctcgtgttttacgtcaacacccctctaccaccaccgctggtgtcgctgagccgccaccgccccttcgctcccagcgccgctgctcctccgcagccgtcggccctccgcagctgccgccgccgtcgctctttcctccgccgcaactgccgccaccgtcgccgcagcgctcgagggagatagagagagattagagagagaggataagaagcaggtcaaacaagcaactgggttaaataagtatgggtaaaatggactatttacgcctaaattaacaccgttaactcatccaaacggaatatggtcagaccagtgcttcgttttttaaaaggagggtcaaataagcacattttaaaaagcagggttaaattggtagttacagttcaaaacagggtcaaataagcaattgccccttagtttttttatgtgttctgaaattttcatgagttcaatgacctgtaccagagatatcaacttcctgcattgtcatcagcagtgcctattttctagcatgcaaaccagtgatccacaaacccatgaaaggttttctttttctctcttgcttgtgttgttacaaaatggcatttttattttcttctgcggtaaattttggctttattcactttcgcatgtttcatagctgacatcactcatgttataataaactagattttttttggaactttgcaatacaatataatagcccatcttcatcttactccctctgtcctgaattatagggagccttaatttttaagtaaaatcaaactcgataacttttgattaataattacactaacaatatctacaccaagtattatatatgttatgtcattacattcgtattataaaatacttccatgtaatgctaattgtatatttgttgatgatacaatatgaaataaattattggttaacttaagtcattgaagatcgtgaaaaaaatatatagatcttataattcgggacaaagggagtacattgctttggctaagatagtttttcttggaactaaatggttcctagcaaaaagggagaatcaagaaatgggaaccaaagagatctgattagacaatgaaaccattgtcattatgcctgttcatggaactagacgatgagcaccggtggaatgaaccatccattaaggtgatcgacgaaacaagatcttcatatatcctccaaatcacattgacttcttgttaacaccaaaatttgttacgattattttgtggaattggttaatgaaagaaactgattggtagatggaaatttatccagattaagccgagttcaatgaggaatcctgaaaactacgacaatactgctttatattttccttagtatatctcttaaatagacatgattagttatttcttttcttgttaggaaatattatggctcccatcggatggcctaatcagccaaagaaaaagctaaattttaaatttttaaaattaattttgagattgattttgagatattttcaacgtagtttttttttctgcattggcttttaagtcaccaagaacacatatataaaatttttacctacaaattcatttttttattccctaataagccgttttggcttatttgggaaaaagccaaatgatggggccctatattgtgtcgaatcaggacttgtatcaaccttagggtataattaaatatgtatacctagggtttttgtaaggaaatccacgtcaatacaattatacgtcggtgtattgccaacttttcccaattaaattaatcactgaaatgatctttcaattgttaaaaatacttccaatgctcaaataattccaagaaaaatcttgaacatacttgaacactcaaagaatttaacaaaattgaaaccagctcatttaatgattaatttaatatgtgaataattactgaaatattctttgtattattaaaattaataattgagctctgaaacatccaagaaaattccagagtataattaatcatggagaatttaatacaaattaaatccatccatgctttatatttaggaaattttatttcccacatttaacttcacttataaattaatgaacatttaatataaattctattaaaaatttattaaaaaatttataaatcctgaaacaaaaatcaggctgtgacaaatctaccccccttacaaagaatctcgtcccgagattcggaacggctagaaagaaaagggcataggtcaactgcagtctatcttattccataactccgataattattctaaggctttaaagaagactactgctgctttgaaactggtggctgagctgtaacacttgaggacgcaactggcactgcattggctcctgtgacgacaatgttgttgacttgaccttgcggctgctgatgcttcggcttcggacactttcttgcgaagtgacctggctcataacagttgaaacatacttgctgctcccttccactactgttattttcttgagactgatcctgctgaactggctccgatagagtagcttgcttgatgttaacttcattgcttgcattagtctctgaattgatctcaccaccgatgttcaactgttgcgattgttcttgagatgttagacttgattcaccaacttgggatggcttgatatgctgcctctggctactgccctgtgcctcctggaaaacagtcattcttctcttacggttgtccatcctgttcttcttatcttccagttgaattgctttgtcaaccagctcatgaaaatcagcatagtcatgagagatcaacgtaactgacagttcatccttcaggccttccaagatcttctcctgcctttcctcgtcagtacagacatcttctggagcataacgtgctagacggttgaactcataaagaaacttagtcacggtacgatccttttgcttcaatgtcctgaactcacgcttcttcaaagcaacaactcctgcaggtatgtgtgtcttcttcaatccttcggtaaactcttcccaagtgattggttgtccttctgctctgttcatccggaagtgatcccaccattctgaagcatatccatgcaactgatgtgaagcgaacacaactttctcttgatctgtgcactggagcaattccaacttcttctcaatagtgtgtagccaatcacctgcttccactaggttgatagtgctagaaaaggtaggcggcttcacacaaaggaaatcagctaacttgttctggggcggtggagcattgttgttcccttggttgagatggttctgcatctgctgcatcatcatgtttattaactgagtctgttgagccagaacttgagcaagggttgggttctcttcattgttattgtttccacttccactagcatgagtgttcaccattcgttgcagatttggagaagatagaaggagaggggttacactaaagataaagaccttaactaggttatcactgatctggtgtgtgtagaccattatattgttcaagttgattaaacgagcaacctagtacaattacacactcatcaatgaacttcctcaatgatgagaatgcaaccatacctacacacaagcaaacaaaagcgttctaccctactaactatacttcaaagtcactttggcggtttaagttctaaggtaggatccaaacttcattccttcttgacaactggacacttcagatcgatcatcaccttcatattcctcgatccacttgataagtagaccacattggcttcttcaagtttcaacaactagtttcagaactactcaagctgaaagaggaagaggaaaggatgataaagcaatttgcaaagaattctggagaaggaagaaaggaaacattttcacaaaatcatgttttttgaaaattagtccttaaagtttgaccatttggcttatcctacagttgagatggctctgatactaacttgtcacgcccataaattcactagtaatttctgaactaatttgtgtgtcaaatcctcgtccaggaatcagacaaggtacacaaactgacaatttaatatacagattcatcaataatacagcattacatacttacaaaagaaaagagaaaatagcagcggaattacggtctagcgaagctccggcaacactcccacaggcagctcaattggggtataagccaaacgtcttctccttcgcaacttttcttgaactgaggtttgattgtttattgcaaggtgagtacatggaatactccgtaagccacacagcaaatatgcaaatgcacaaggataccaaagaatggcataatatagggctcatttacaaaagcagcatttaacaaacattcgagaattgtaaaatagtagagtaattaatcatcaatattaatcaacactgaacagcacacccatactacacagacccaaccatactaaacaaccatacccggctgtacagatctatctccaaaccaggaatgtatcattccaaaccaggagctaatcaaatattaccagttatagcattatttattatggtgaaaagtgtgagactaatcacgacagacattgttagagccgctcatgaccgcgggcacggctattcgaatagttttactctagccagaggtgtaccactgtacccacaagacacagccccacaacatgttaccatgcgcctcaataccaccacggtacctcggaaaggagctgtgacagtacccctcgcataatacaatccaccacagcacaccgttcctggatcataatcacccccttataaacaaggcatggactccccagcgacccccgtgggcttatctccaccacttctcaatctggtgccccgcaatgaaccatgctatacaaaaggtaaaggcgttgcgcatgctggcttgtggttggcacggttaatgtttcacaaccgaaactcgtgaaccagtccttaattgtcatgagcacaaccatcaaaaccatgtgctcacaacccaccattatcaagttttaatggcatattaattaattaaccaatcacgattaaccattgtgagctacaattaaatatccatcattaagtaatagtaaaacattagttatcccaattgtgtgctaatgtttctaagcatggctaagcaattatgtctaacatctagctgaacaaatatacaaagctcaactagtaaaattataataacacaaggtatcaaggaatagagtaatgaacgcaaattggccataacaaaggaataagttcacaccacccggtgacattcgaaaataaatgcacagttgaaataaatagagactttaaatataggatcaacatgctcaaaggaattgtatattaggatctgtgtggcttgccttgcaataattggtcttcaattatcttcttgaactcttacgacacacacgcgaaccttcgaaacgacgaaaacgacaagctaacatgcaaaacgaggaaaaagactaataaaaaccaaataaacagaacatataaagtaaacaaacatgtagatcatgattgtagatgaattatgagactagaacgacctcattccgattttatatgaattagttatgaattttacaagatttaattccagttaatcctattagagaaaagactattccaaattaattaaacaatatacaaatgatttataactgagataaaagattaaaacaatctctggaaaaaattagattatatttggtagttgacatatattaaaaatgaataatatgccattgaaaagagagaacggatttatattgattttggatggctgagattaatcttaaccgagagttgactgagatccaacggattagattgaatccattctagggtttagttagacatggcacagcagagacaacgaagtggctaggtggcggtgaagtgacagcagagatgcaacgacgtggcaaagataatacaaccacgcgggatcactggacggcagacacgggagcgacgatcaccggtgaactacggagcagcggcaaaaagggagcacaccgggagaaagagcacgagacgacggtccttaccaacacttacgtgatgacggagagcgacggaagatggcggtgacgagatccgaatggtggcgatgtactggtccacggcagcgacgactttccggcgatgagcagcgacaatggaggagtggacggccttcacctcgcagctgcgaacccaaaggaggcggtgacaaaacttggcgacaatgggaggtgctgcagggcctcgctggatatcaaaacgcgacggtgaacttcgggttgacggcgctgatggagctccggtggtgatgagggatgttaggtcccgatcttccgattggtattgataaacaaagatttgggtggagtcgtgacacaactcgatccggcttctgaacgaacacgctactgagccccgtaatcgcagcaccacgtctcctctggttatcaaaagtgccgaaacccggtttacctcgccgagaaggctaatccctgcatgcgaattaaagaacacaagcaagaacaagatagattgtaaccaaattgcatatgaataattaagcactcgaatttggggttccacaaaccgatctagcggcgaaactgttcttgacaggataatctaagcaaaacccaactctaaacgatgacggctactgaattaatatgattagggatgtcctagggtttccctatggcgcacatcccttgggctaagcccacgacacaattacaaggcccaaaacccaaatcagattcggactggatgagatatgtggcttgttttgcagatttccggcagctcggtaggaattttgacatggggacaaaaccatctgaaagtagacccataagctttccaacaagtactcataggcctcaaaattccttctagatcagaggctaggtccatttaaagttgatgctgtcaggaggcctgaatccgaaatcaaaacgtgtagaactttatctcttttcttttatggaccaaaagtgacgtgttaagatgaaagaaaaccttcaaaaaaaaaagaagacttgcagaaggtcttggtttggtccccaatcaacttcttcaatcatccatgcattccttacgctcggtctcttttctttcgcccaagcaagtacctctgcaaacaaaaacacacgaaactcattgtgtggcagcgtttgttcaaatatataacaaatatatctaatgtagaacatatgcacctttatttgattaatacataaggtagtcatggttatatccgagctaattatgtcctcatcaggtggatttcggcttcggggaagtggaggacgatcttcttctcctcctcgtgaacccaatggcggcagtggcgaccgaaggcgacgaccacagcgacggcgcacggcggctggagcagcggccggaggtggagagagaaggcgagcgcggggagagcgtttccggcgacggcggaagacgggatttgaggggataggtagaggacgactagggggtcctttatataggaccgggagctcgggtccaagcccatatcgacgggaaaaactgcgggaatgttaaggatcttcgccggaaaaggaaagattgatccgcgaaattggaaaggatttccatagaaactttttgggatttcttgggaaattgtagaggagattgagaggattccattccctcaactaatttggaaaaaggagcaacgaggaggccggattttggaaggaggaggcggcggcaacaggacacgggcatggctggctcggactctgtccgagctggaagatgaacagtgtcagggaggcaaaacagacttttgtctgggcttctattgcacagcccgatagaagcagggatgcaaactagactattggaagggataaggccggccgaatagaaagaagaatgggccgaggactaaaggtgaactttcctgtttcggcccaaaaaggaaaaggggattttaattacttttcccaattaaattaatcactgaaatgatctttcaattgtaattccaagaaaaatcttgaatatacttgaacactcaaagtatttaacaaaattgaaaccagctcatttaatgattaatttaatatgtgaataattactgaaatattctttgtattattaaaattaataattgagctctgaaaaatccaagaaaattccagagtataattaatcatggagaatttaatacaaattaaatccatccatgctttatatttaggaaattttatttcccacatttaacttcacttataaattaatgaacatttaatataaattctattaataatttattaaataatttataaatcctgaaacaaaaattaagctgtgacatgtatgtatcctgacttagcagcagctcgatcttccacggactatccgataaaccaaaccaatatagaatcaattacctggaggatgacagcagtagggagatatgaagttggaggatgacagcagtagggagatataaagttggaatacatgatggggataggaagtggcggtgcaccggacggagcagggagcatagggctggaggaggagaggggctatgaagcgatggagtagcattgcggcggaggaggtggcagcagcacaacgaaggagccaccgggggcgccacggaggcagcgccaagtggcatgaaggaggaggtaacgggggcgtccaagggcaggcggtgtgatgcgggcggacggtgtgatacggaggtgggggcggtgcgggacagcatgaggggtatctgagccttttgatctgcacgaggatcctaagggtaatatcggcccttagattatccaggactcaccaccactactatgtattttttactacgtagtaaataaagataaagattagatatacaagggataattgttatttgatgaaattactatcatggctttgttggagagttaaaacttactaaaaggtatgggataaatttggttactattttatcataatatccgaaacatgaacataatattttgttagcgcttaccatctatcaggcggatctacagtgttaccactggtgtcagaagacagcgatgacattcgacaaaagctatgtttaaattgcttgtctatatattataacactatattctaaatataattagcatgctatgataacgatagacacgttaggactctagatccaccactacatctatgtgaccttctgtataatttgcgttgatgattgctttgtgcataaaaaccatcaatgataattatagagaaggtcacgatggttttgttgtgaaattcctggagaaatcatatatggtttgttgataacgtgaaatcatgcttggtctgctgaattttattgagttaccatatacagatttgcccttctctacttcctctattttcccctatctatttgctttgctctgtttcatcgagccggttatcctcactccgcacagtgcgcgagtgcgtatgtccaggtgcagacgttctttattaactagtgaagaaaccatatttgatcagtctggcgaaaatcataatagtcccggttacactaaaaaccgagactaaaaatggatttttagtctcggttggtggttacaacaggactatttaatttttagtcccactatagatcgcaaccaaagaataacgacgatctaatacattaataaatactagtaataaacaaattggcgattattttctctaattaaacacactttaatctagctatgcataattaatcttgttcctgatcatcgacattcggcataggtacatactacgtggtgataaatccacaagattgcaaccgcaaaacagggagaggaaaacggtataatacaagctactttcctgcttttctctgggcatcgcgaaacagctaacgattattttcctttcgaccggagtgaagaatgggtttttacggaactgcccgtcatgtgtaacatggaaagacaaatttaccctcccgcttgagcccaccgccggatccgcatggggaagggcaggggagagccgctcccggcctcccgctcgagcccgtcgctcgatccgcgcgtggaagggccgagggagttgccgccttttccgttgccggcgcctgcattcgccgcagttgccagatcagctatcgaagcctccgtcgatgcgcggggaagcccaccgttgatagcaccgcctgccgcccgtcacgaggccggcggaggcagagccgcctgatgccaccggtcgagccctccacctgccaccagcagtgccccttgcctgccgcttgccacgctgcccactaccggccgcgccgcccaccgctggctgcaagaggagagtgagataggagagctgcgcagaggagagaagagtgagaagaagaggtgagagagtgagaaaggaaaggagagggtctcgccctgaaaaaaccatttatgcagtagggtaggaaactaattcgtcattggattgtttatactaccaataaattataccgtaaaaattcaatataaaagaccatcatccagcaaagcacgttcatcggaccatacactccatatacaacgtgacccacttaatttatgctcccattcttccgatattttttttcagttctaacataactacaacgttctttgatatgtgaaaatatttagtacctggtatattgaaatcaatgaagcggcgattttttattggttgcgcccgatgatcttttattttgcgtttttatttggaatgcgcggcatcaggctgatcctgggaggtgcaacagtctgtaccggtggtgttaccaaccaggattaaaaaattttttttcttttccttttatccggttggtcttttttctttttcattgttcttttactctttgcatatcgcccaaatcatcatagatcgaatgaataaaataaaaaaaagcccaaatcatcacaaatcaaatgaataaaatcaacatcaaagcatcaatattctttgcatttattcacatctacaatatctccaggacaacaagcattcatcatagacaacagagaaaaaaaaagttcacatctacaacatcgtcagcattcatcacagagaacagagaagagaagaaaaaaaaacatgttgtccgtcggccgccgcctcccaaccggcgccggccgcggcctcccgcccggcgccggccgcccccgacgcagccgccgcggccctcccgcctgccagctaggtcaaagataaggggaggggaggagtggagaaggagaagaaggagaaaactaaatgagaagtgcatctggaggaggagttgagaaggaggagaggaagaaaagaagagatggatggggaggagtggaggaggagaacagataagggagctgggcgcctctgattttttttgttctttattttttttgagaattgatcgacacgcttgctctgtttgatttttgttgatctacgcgctagggaggagatagaaaaaataccgctaccctttttaactgcgactaaaaatttttttagccctggtttttttaagcaaccgagactattatggtttttggacaacccattaaagatggtttctccagtagtgattattcatttttgtttgatgcaaatcaacactaaaggaaaattccatatcataatcatcataacacaaccattaatgtgtgtctactaaaccaaaacaccggatacaagtctagctgactcaacaggtgccaggctttttccaaattgacgaaagcttcaaatataatatgaccaaataatagaattttcacagtagttgagggatttattattctagctcggattttcttcaaataaaatataaccaaaaaaaaatgatgccacatcataaatagtgaaccgtgggtcggacctaggtataaaacttgagtttctttttgtgagtcgagggacaaataacatatagttttgtaattggatcactaagtggactaacgacgccatagtctatagttccatttttcatgtttttaggtgtgtttttaggaaaggtgccgtgaggacccagctttcataataagccacttctttcttatgtgtttcaattctcttgaaataagattgatagaaccgtaactctagaaggtgagctccgtccgcatcgctcccacctcaggggcgactaggatgcgaaacaaccaccaccgcctttgcctcaccaccgtccgagtcgccatcggaaaattcagatggtgaggtagaggaggaggcgacagtgctagggaagcgaccaatgatggatagtgggaggcaggtcgtgccttgggaggaaccaccaaatcttgtgctcatttggccagttctggcaccccggcgactggatctggcctcttatgtaatttatacaagtgggtattcatttaaattggttataaaagtatagaggtatcttgatatacagtagtatcgctatcgctactatttacataaaacaataaaaatgataatatagtttcgaccatttaatttcatccctaggagagaaacacctagagtcgtgatgcacgggattggaagaaacgatcaaatgtacacagatagatgcacaattgcgtgacagtccattgtattcacacgtggtccactgtattcacacgtggaccactgtattcacactttttgatcgataagcagcactagcaaccaaattggatgccgcatggcgccacgttagttgtgagatgcatgcatgcatgggattgaaaacgatcaaattaatatgtacagtactgatacatgcagcatgtactctttccgagtgattaattcacacattaatttgtctcatcgatcagcagctctagccacatgttttctattaagaatccatgcatatatccatctataaatatacctcatgcatgccagcttcttctactactcgcagcgcatcactcacagctacatccacaagtactaaaccaatctctgccagcagtagctctcagctatggctgatcccagcaagctgcaaatcacaccctgtggcatgcttgttcagggcaaccagatcaacttcaccaaactctacctgcaccacacgccggctggtccagaacaaaaccagtcggcggtcacaagcaatgacaaaaaaaccgggttgggttgcattgtcgttaacaactggtcagtatatgacggaatcggcagcgacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32626 - DNA, 1128 bp, Oryza sativa
  unsure (1)..(1128): unsure at all n locations
nnnnnnnnnnnnnnnnnnnnnnnnnnnnnnnnnnnnnnnnnnnnnnnnnnnnnnnnnnnnnnnnntacttatccttggacaataatgatagacaagcagaaggtagttctctaagctcttgatttatttcttctaaatgtcaccaaactgttttgtgttaattgttgttcttggtttgtgcttgattgagggtttgattccagctgtgcagcaaatttttctagactcagaacacaggttttgtgttagacacctctactccaactttcaagttcacttcaaaggtgaaaatctgaaaaaccagctctgggcatgtgctaggtctagttcagttatagagtgggtggcaaatatggaggaaatggctactctcaatcaggatgcacatgattggttgaaaaaaatggaacctagtacatgggttagagcatattttagtgacttcccaaagtgtgatatactcttgaacaatagttgtgaggtttttaacaaatacatcttggaggctagggaattaccaatgttaagtatgttggaaaagattaagcaacagttaatgactaggcactttaacaagcagaaggaggctgcagaacagtggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcaatgcaagtactgcaatgaagcaggccacaaccaaaggggttgcaagttgaaaaaagcttgactcaggcc

SEQ ID NO: 32627 - DNA, 17559 bp, Oryza sativa
  unsure (1)..(17559): unsure at all n locations
nnnnnnnnnnnnnnnnnnnnnnnnnnnnnnnnnnnnnnnnnnnnnnnnnnnnnnnnnnnnnnnnntggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcattgcaagtactgcaatgaggcaggccacaaccaaaggggttgcaagttgaaaaaagctggactcaggcccaatcagcaaccaaagaagtctattcaaaaccctgaagtcatcacaacagaggtaatgccatcttttattcaatgatttccttctaaaatcaaaacttccatttaccatgacttctctgtaggtgcaatctcaatctcaggtgcaaactcagtctcatgttgaatctcagtcccagcagttgctgacacaggttaacaatgcaatggtatctcagatgtttgaggagtcctcccaagttactcaaatgaacttggcacctaggcctctgcctgacaaccaatttgtcatggcaaacaaaccaacagccaggccaatgcctctaaccacaacagcaaaggaaggaaagctgagagcaacaaaaagaaaggctgcaggtgatggtcctgaaaagagagctaccaagaagaagtagaattgctgatagaactgcataagagctaggctagagagctatcagtactttcttttgtaatgacaaatgatagtgtcaatctgattatggctaccatgtctccttttataattatcgaagaaatggctggcatcttttattttgtaatgccaaactgaatccaggcattaactacatcttcctgttctggctacatattctcagaatgcaattactgattatagcttcaatttctcattctgtttaaattttgcaatgctctactgtcattttgtctgaactttgaaaagttctactgtttgatgtgcacgtgtattattctgagccatgcatgtgtaactgaacagattcaacagagactgatggatatgcacattatttgttcattgcaaacataagaaagttaaaaacttcatccaaaattcagaattgaaatataacattgcttattcacagcacattgcacattgcacttcatttgaaacatcacattttttttctgcattgtttttcctgaatacaaattcacttcacatagcacattgcatatacatcacttaaaccacagaacgatgcaaatacacagtagcagaccaactaaacacacaccaccagctaggaacagcttcaacaacaccatcatcttggtcaaaatgaaaatcatatcttccagctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaatgacaaaaatccacaaagggcactttatcagaggcaagagatttatcacgtggtctggacatgtgaagaaaatgcgacctcgattagcttccgtggtcgcggttagctccaagatctgcttcaccccgcatgaagggcacttaatcagcgggattgagggcctcctcctcttgcgactcgagtggcttgagctgcttgcagaagccatgccgacgacgatgaacacacctcggccgagtgccctccctcgccgttgactctcagccggaagccctccctcgccgtcgactctcagccgccctcccacgccctcactcaccgtcgactctcagccgccctcccactccctcactcgccgtccaggggaaaagagagcagaaaagagagggctagggtttggagaattcgagggaactgaggggcttagatgaaaaagtgcacggtgcgggacggtgcagtgtggcatcacacgtgtcgcgacacgttgctgtccacgtatgcacgaaacgagtcaaagcgttctctggaccggattgatacaataaaacaagattagtgaccttgaccctgtgtttgtatgttcatggacctggatgaaacctcctcacaagtttaaggaccgccagtgcaatttactcttcttttagccaggttatctttcgttagaattactttcttgtgaagaaaccacataaagaccattgaattactttttttcgttagaattactttctttagatgaagtggatgaatgaagctaatatgtcaacaaacgattcatgaaaacataattaagacttttggccccaatagctatacatagctaggtatgtacgtactccctccggttccactgcacccctgctcagcttcactgttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaagggtgcgactatataagcactcgagaggaggctagggccgcatagaatttgtaaacagcaaactgaatccccaaactaatcctctgtctcctcaatctatctctgatttatttctgcagttaagggtaaatacaacaagacctagatccgggatttcaaaaaattcaccggttatagatatatattttggtccaaagttgtcaacgctggttcatttggtgcaaattaggagtaacatgcatccgaatggtgcttaactagtttctcttttgttcccgatctgcttaattaaatgcttagcgattaacaagcccaatatcttcttcaatcatgcaagaaattaagcgcatcgattttgcaagaattcaattacttcaaacttttcaattccatttaacagcctctgagccaatcaatgcttaacaaaaatgaatcaatgctattctgtaaccatcatgagcaggcatcatccatcaacaggattcaacaacaatcacattagccatggtacgtgtcagccggttgccacagatgtgcacgctggcgctcagctgccccagctcctcacttctttctcttagggttagatacagatggagtgggttactgatcatatcgatatagaacgctactagccacaacagataaggaattactaagctacctttattaatattatttcttgttcctaaattatcctttagaaatcaacggtgcatattatttcgttgaggtacctgtatatgttgatatgctgatatgagattgatcaggtagtgaccaacgcagtgcttaattagctttctcttgtgcttacgtttttcaaaaaataaataaatgaataaataattagctcagatttgtcattttggtcatatacaacggtcatgctatatagagtcagaacttttgaaactttaactatcattagtttttcaaatgctctatttaaaaagggaaaacaatagtatgcttagttttgccatgaaaaagtattatcatagtataaaaacttattagatattctaatacaaaattgatagtcaaagtttgaaaattgagagattttacggtctcgaggtaccacattttatctctcggtgtgtttggtacgtactaggagctacgggtacctctagtaactcttgaggactgtaaaatttctcattaaaatttcaactcaaattttgctctaaatattaatacttatgagttatgaccggatggagtatatgatacggatctgtatcctcaataaaaattttaactcaaattttgttctaaatattaagcacttatgaccggatggagtatatgatacggatccgtatcctcaataaaaatttcaactcaaattttgttctaaatattaagtacttatgaccggatggagtatatgatacggatccgtatcctcaatactagtgtatacacatcgttcttcatgcagtttgtccttgatatgaagttctgaaaaaaaaaaacttgcggcggttttttaacccattgacctgctctcttgtctgctctggactttcactacccacagatacacaccttcttctcttcttgcccgatcacctatcccttattgttacaagtctcattttatttttcttattaccccatcactgcatgctacaagtgataagctactgcttagctgtgaattctgttaagagtattatgtgtttaggggtatattagtaatttctcatatctattgtactcatatatgtcctttgggctaactcaatggcaattgttaatctccaaatcttatctcaaagtgacatggtatcagagccctaatccaaaatcgccactaaatccgtcatcaccggcgagccatcgtcgtcgtcctccgccgttaatcgttgaagcatcaagcaccagtttttggcctcaaccagcagcagtgaccggtcgttatatccagtactccgagactgccgcccgttgccgttcatcgcagccgctcgtcacggcgcctttttcatcgctgcaggtcgcggcactcgtccctgctgctcctccaccagtcgcatggtcgtcccgcgccatcctctcggccccaaccacgcggcgcttgtctcgctgcccgtcgcgtggatcgaagcaacctctgcgatctgtagcagcaacagcagcggcataccatcgtccagttcgccttcaacacttcaagcagtaaacaagtagcagcagcaaatcaaaatccccttttcatcatcattctctccaaatctggtgatgttctctggcaccgatcgaatctatgatccttgtcctcgagctcctcttttcttcaaacagtagcagcagtgaagttccaagatgcagcaacaagtctcattcccattgtgaatattctgttcttcacccagtggttatcctctccttctccatgttcattcactctctacactaattttgcatatttctgttgtggctctgtgctgctacagcctactatttgattagtagaggagtacatgccatatcatgacataattagtttcattgctcgtcataatcatcttgtgcagctgcctgttccctcaattaattcctactttcagtggtagaatttgttaaaatcgtccccttaatttatattgatccctactgtcaccatcagtggcttatgcatctatcaagggcagggcacttctttcgttgctcatttccatagcagtcaccaagctcatcgcctgtatatatcctcagcattgtgcttgcttgtacactgctgctgtcaaccatctagtagtatatatcctgtgtccttttgctagtatatcaatgtcttctacaaatcaatttcccatgtttcctataaaatctgtcaaagtccattgtattgttcagtccgtcgaagtcatgctagtcaatcttttcccagctccaagtcggagttggtcttcatcataatcatcataccatcgtcaactccatgtcggagttagtattcgtcttcagtttaccagctccatgcaccaccaccctcatcaatcagtgaaggactgaagaacagtctgtgaagttccttcaccatcattgtcaccgtctttgaatcaatgaaaagccaaagaacagtttgtgaaggcttctggtaccaagggctgaataacagtttgtgaaggctcgaggtccacttcattgaggaggggatggttttctcttgttcttcatccaagagcaatgcttcgacaacatctttaaatagggacttcgtatttatagtagtatattgtttatctagtgtttagtttcaaatgcaatgctattgtatatacattgcatttgagtggggctgttaagagtattatgtgtttaggggtatattagtaatttctcatatctattgtattcatatgtgccctttgggctaactcaatgactatggttaatccccaaatcttatctcaaagtgacacaagggagggattaggggaagcaagggattcattccgcacagggtttgagtgacaatgggaggattcactcaatccggtggtttgcttcccattggggatttaatctccaagaatcgaacatgccctaagggtgtctgccacagaaacacatggtaagcaagccagggtcctaagaagcagaggagcataaccaggacaagctgcagtatagatggccaaaaggcccgcccggcacggccaggcccaggcacggcccaccagccatcgagccggcacggcccggcggccgtgccggcccatgggctgcgcctcctgcccaggcacggcccaccagacgtcgggccggcccgaaggagcgggtggcccatcgtgctttttttaaataagtctattttctgtccctcctctatgggctgtgacatctatataacgaaaataagtctattttccatccctcctctttgggctgtgacatatatatatagtgaaaataagtctattttccgtccctcctctttgggctgacatatatatagctaaataagtctattttacgtccctattctttcaattgtggcatataatatgtctatttttactccctattgtttatgtgtcgggcctggcctgcggcccatcgtgccgtgccggtggagaggcccaggcacggcccggtgattgggccgggccggcacgagcccgacccttgacgggccgtgccatgcttgggccgggccaaaacgccatgccatgggccgggccgtcgggcctcgggccttttagccatgtataggctgcaacactaagttgatagttaggttaaacaaagaaactgggaattggtttgtgagcacgttcatggatgggcacaaccatgacctgatatctagctccgacctgacatgtgttatccggtgtcaacgtattgtcacctacgtgcctccttgcaaggtgggtatcaatgaagcactgagctgactttataaaaaaaaccaataggtgataaatatgcgaagggatatctggtctggtggtaatagattttcccagcaacaatcttacttttccggaatcccatatagtcatttttctcgtgtattagtggatctaggacatgatcctcacttatgttactattaaacactagaagaccaattgacagtggcgactcatagcgacgtgagaagcaggccacggcggccagtcgtcaacgcgtgcaaatgttggtcaagcctcctatttcttcagtcttccagatgctattgattctctttttctttcgaacagactttcttgtgtgtacatcttgattaatcttaagaacaaacaaactataatattgatgtatttgattttcatttattttaattaatcttaagaacaaacaaacaaacaaacaaactaaaatagtaaaaatctgaccattgattttcatttaaattggtgggtctattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattcaaaagtccattaaacttcgatcaaacgctcctatgctaccatgtggcatactataaacgctctcgagtcgccatgtgtcactctaataaaatagtaaaaatctgaccattaattttcatttaaattggtgggactattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattctctcctaataaatagtccattcaatatcaaataaatatttctaaacaatgtccagatttgttgttattggatatatcccatcatattctaatttgaatttttataggacggaggaagtatatagcactcttaaattagaggaaatcttaaagaaaaataataaaacattcgacaatcgaaattttaggttattagttctatctttttttttaaaaaaaaacatcccaaatctccctccgcactcccatgcggccttaaagcaaattaaccatcttataaatatttttaaaccacccagtgacacttctaaattagaaaaaatcataaaaatttaagaacaaaacatcaaactatggtttcgacgtaaatcgatggacatatcatttaggttgttattagatttttattttaaaaaactcccaaacctcatttcctccctccctgcccctacaatgttaatgacttaaaactacattaaatatcttataaatatttctaaaccactagcgttaaatgatattgttttttgtcataatgtgtaccacatctagtgttaattttttatagacaacataatgaaaataaaaacatgctcagttgaacatcatattgatcgtacaagcatgtaggttggaacaaagaatcttagaagtgaaacaatgatgaggtggccttaccaatataatgagtcaattccatataggaattaaaaatcatgttcatttatttctttttggtagaacttgctacgctccgttgtaaattcctaacatgtagtgtagaacaacttagaaatgtgtatttattacatgacctctatttttaatatttcttactctattgaagtgagataatttagaagagatgactttacctcatgtttgtaggctcgacccacttatgttttcaacccaaattacagagatcaaataatttcaaagatgcttcatagaatggaattctccaaatttctttaaaaaatggacatgaaaacaaacaaaatttatctatttttttaaaacaaattggttttaaaaaccattctaaatagaaatatttaaaatttttgctgcgctaatggaatgaaaatatgtaaaacatcaaatagcacctaacaaaaaaattggacattttgagcaaatgttggggggggtaagatatctacgtaggaagtcaaaattccaaaaatttactcatagaaactacacatattttcgacataatattttctcataaattgagaagtgtgcagtctcgagtaattttagtttagtatttatgtgctgaaggggtaatcagaagaaaattataaccagcattcaaaacacattaaataagttcaatttttattttatgtgcattacaaaggatatttgtaataaaattttacgtgcattaaaatggtgcacgcgcatgtgcgcgggctaccttcctagtttattgaaaaatctgaaaacctcaaacttttccatgtaataacaacataattttagcggtatatttttcaaaaatattctaaacaccaaaatgaaatgtttaaagaaacattttcacacagccacatattagtattgcttagcttccaaacatcctcaaacttttccatgtaatagaaacaaaattttaacggtataattttcaaaaataaattaagaaccacatatatattttttgtggaagtttaagaacatttcaatgatgatatctaaccttttccatatgtgttgtgttaattttgcacatgtacaagaacaaatggcctttggaggcaacggctctcatcggatggcctaataagccaaagaaaaaacctaaaatttgaattttcaaacttaattttgaaatttattttaagatattttcaacgtagtttctttcagcattgacttttaagtcacaagaacatatatataaaagttttacctataaattcatttttattttctaataagccgttttggcttactagaaaaaaaagcgaaacgatggggcccaacaatggaagtcaacaatcatcaaccgaatggagatggcaaaaggatactaatgtaagagtggcaaaatacatagaaatatttttggatgccaatagagagaacatagtagaaagatctctagtagaaatgagtggggaataggataagctcggagtgcaggtaatccatcttttctttgcttgtgtttaatttcaattcttagtgccttcgtctgcaaattaagagaatcaatcattgaagctcaaaagaacgcatcaactctatgttggacaggctgtggacaggtttttgactcaccttcgaaataaagtggagaaagtcgatcccacctccctttggtttgatcaaagtagtcaactacaggaatgtgtttgacttttacatttgaggaaccttgtacatgttccatgaatttttggtgcatgcccaccaaactgagctcttcaacagacccaaggaattccatgccctcaggcaaatcctctaaatttgtcaagcagatgagagcaaagttatagagatttggcatgctatgcttttcaatcactattgaactgacattttgcagctcagccaaagtaagtgtatgaagcttaggaaaccactctgcctgaaagagcaaggtttctccaatataatggttgaacagaccaagaagggtcaggttacagaaattagatagtgatggaagtggatctatgctcagcctgctattttcaagagtcaactccatgagggttagcctatttgcctcaaataggtcagagcctataaccctatcatggagtctacctttcacaaagagtatttcaaggttctgaggtgcaggatctagggcttctaagctgacatactcatcactattggcagttccaataagaaggttctttagaagctgcatctttctgatggatgcaaatagctttgtatagtggatattttttacgtctgtcaacttcaatgatctcagctgtgtaaagctggccaattgttccaccaaattgctgcttgcagaaatgcctgtgaggacatttagatccagtgatcgccataatccattggggactttgacacctgtgaagacatcttcgaggccaaaataagaagcaacagcctttccagcaatcagatggcgtagcatccttagcctggttacgccacgtggaagacttgctatttcagtaaggaagatgtccaaagttcggagattttggagcctgtcaatcgattcaggaagttgcttgatcttggttcgtcttaatcctaaataatgtaaattgaacaagttcccaatgtctctcggcagttttctgattggaacactacctagttccagaaccttcaggtacctagcagtccttgatacccattgcacttttgacacggaggaacaatcgatatcaaattgatagaaagaacgaacacgtgaagcatttatacttagctggactctgactgaattctcatgaattgataaccgacgaggctcgcactcaaccaccgatctctgagctttattatgtatcatgcagaatccttccttttcggatattgaaattgccagctccctgataatgtcatgcatctggagttcccatactcttccaagcttatttctccgagcaacttgaagcaggcagcgatctactagcttttctatgtactccattgcaatctcctccagtgtcatgttttttcttggttcaacaagaccttctactactaatagtttacatagccgcttcccgcgtatcatatagtcctctgggaagatactgcataaaaggaaacagttcttcaagtggaccggtagatgcttgtagcttaaaccaaggagtcgagtcaccatgctgagtccttggttatccaagcgattgtgcaactcccagttcagttgattatagaatttctcccactccatcaaatccagccgtttgaaggatagcaagttgcctactgccgttatagccaacggtagaccttcacacctgccaacaatctgtcttgctactcggtccattgcaggaggacatgtttgatcttcaccgtgccggaaagcccacatgcaaaagaggtcccaagactctgcctcatctaatcctcgtagttgaagacggcgcttgtcttctgccaaagaagcaacatcatttatgcgagtagtaattaccaccttacttctgatgctgctttcatctagaaagccttccaagctgaaccaaacatttgtatcccacacatcatccaagaccatcatgtatgtccttccctgcaaagtctcctggagcatcagcactacgccttcactactcatgcttcctaagtcagctgagcatgtatccttcaatgcacactgtataatcttcctcattatttcagtaatgtcatatgtttgagacacggtaacccagatctggcaatcaaaacggttcttgctagctttgctttcggaaacagttttgacaagagtagttttaccggaacctcccataccccatatggaaattattgagcatgatctttcatttgccattagcaactcttgcagcttctgtcgctcatttacaaaaccgacaagtttcttattatgcattatgtggtggagtgtgtgacctttgctatcttcatacctgatggagctggcactttcttcagataagtcaatattgtactgaagtttcaagtttcgaatattttggagacgattctgcacttctttgagttctgctgctattctgcgcaatggcatcacactttcagattttctgaagaagttcttcaacaattccacagatggggtttcttttctgccaaaataatagacaaattcatccaggatgtcttcaacttcaaatgctatctgctgaacttcctgcagaaaggtttcagcctgcctgctggagctttctttttcttggccatcttgcaggaaagattgcatcaacctaaactcacttctaatttgctttacaatgctttcaacctcaattaaaactgatacctccttccccagatgtgaaactaatgcctgcgtcagatgtgaccccaatattgatccaattttgcataggattccaaacaccacagactctgccattcagtgctcgatctctcagttcagatattttcaaatgcaagacctgaaacaaaatgaacaagcatccaataataaattttcatcctacaaattactttgtaccagagttcttgaaaaattgcattaagttaaaaaataacagaacggttgtcatttcagacttatttcacaaattttttggtgccagatgtatccatgtaacaattcaaataagaaaccggtgaagtttaagtggcatataaggaattttctcttcaaataaacagatgctacacaatctaatttctggtccaatcgaaggcaatatactctttctttttcagccttttttatgtaaaaaacatggaacccaaaccacaaaaccacctataagcctatacataagggagagaaacagactaaataaggcaagatagaacggagaaggtacatgaattacctgtgtttgctcgccgaagcttttctcgcagatgggaattgcaatggcaaagtagacgccctggaggcatttgatcgaacagttggcgggtggttgaactgacgaccggccagagtgtgcgccgtggtttgcacactatcaatgggaacctggtaaacccatagacacaccaataatagtgatgtcggtagtttatttagtgtttagcatctaataaaaagtggcaacttgcaccttcgaagaaattgagagcaagaaagctgcatgtttcctaccgaaatccccattcgagggacaaccgatcaagatgtcaattgcagcttggaaaggggaaatggtttaaatggagagagtgggactggcgtgtcagcctaggacaagcatataatatactccctccgtcccataatacaagagattttgactttttacttgcactgtttgtcccctcgccttattcaaataaaatgtgcaaatattaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgtttgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgttcagggtatataacggtgttaatttgagcaaaaaatgtctcttctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcctcgccacggcatcgtcatcgtnnnnnnnnnnnnnnnnnnnnnnnnnnnnnnnnnnnnnnnnnnnnnnnnnnnnnnnnnnnnn

SEQ ID NO: 32628 - DNA, 1853 bp, Oryza sativa
  unsure (1)..(1853): unsure at all n locations
caatttggttaatttaacccttcttttcaaaattgaaaatccaatcttaccctattctgttcagggtatataacggtgttaatttgagcaaaaaatgtctctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcttcgccacggcatcgtcatcgtcattgctgaccatcggcggcgcgcgcatggaggaagatggagaacgacgcgcgcggggatggagggagcggtgccctgatctttgccacggtgtcgtcatcggtgtgcgtggaggaagacagaggctggcgcgctcggggagggagggagcggctccctgtgatcttcgccgcagcgtcgtcgtcgttgccgacccgggggcagtacgtgtgtggaggaaccgaggaagacagaggccggcacgcacggcgacagagggagcagtgccctgtgaggcgctggagctcgccggcgtgcggagggcgggcggcggcatcacgcgcacggagaaaggaggaggccggcgccccgaggacgagcagtgacagcttggcgccgaaactcgccagctcacgggagaggggcgccgctagatctgcggcttgtacgcccagcttcagcgggatcccccgccacaacttgagctccgccaccgttgctcctcctcgtcgtcatcaagctgccgccgctccttccgctcgtcgttgctgctggtccttctgctcgccgtagctgtcacctgtcctttctccgcgcgcaccgcttcctccgcgcacgggctgccacaggtctgctacctccgcgtgcgccaccacaggtccacccccctccatcaccgctcgtttcaatcgtgtgccgccgccgccgccgatagacaagatagagacgggagtgaatggatagggttagatgtggatggggtttcttcagaatagtttggtcaatacgaataataattaaatttctttttttttcaaaaaaatgaaactttaacggtgtagtggaaacagggtcagacggagtattcatttttgaaaagcagggtcaaataagcaaactaaaaaagtaggatcagtttagtactccctccgtattttaatgtatgacgccgttgactttttagacaacgtttgaccatttgttttattcaaaatttttgtgcaaatatgaaaatatttatgtcatgcttaaagaacatttgatgatgaatcaagtcacaataaaataaatgataattatattaattttttgaataagacgaatggtcaaactttagataaaaagtcaacggcgtcatacattaaaatatggaggtagtatttatgcttccaaacggagccaaataagtaattgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtannnnnnnnnnnnnnnnnnnnnnnnnnnnnnnnnnnnnnnnnnnnnnnnnnnnnnnnnnnnnnn

SEQ ID NO: 32629 - DNA, 8267 bp, Oryza sativa
ggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacgttggttgtactcagtcttgctcaatttttcccaaacccagaaaaggagcccctggatgatgaaggctttggtgtttagctcgtgcctgccatcaagcgcctgtggtcatcgccctagtcttccgctgtttcccgtttgtcttcttgtgtgctgggccttcgccgcccatgtaataaagtaactatttatgcttccgcttgataaactctgaattgtatcaactttcagtgtaccttgcctcctgggacaaggaataatacacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaaatgttgcttttctcttttgtctttttgtttgtagatggccggcagcatcaaccgtcgtggtctggacctgactagcttcgttttggagctgcggggcatgtgcgttgtcctggggtatccgcatggagtggattaccagggcaagcagctcccggagcaggagggtgacgatgtagagccccatgctgcttgggaggtcactgcagtgatcctcactggctcacctgagaggacttcgttggcagtcaccgcgggaggagattctttctctgccgcttgccagaacgccgcactcctcgccatcggcactcttcaccagcgctacccggacgagttgcagcactcgccctaccgctaccaccctcgtcgcggaggagcccgcgactacgccaccttcagggatgctagctcggaggatgacgctaccatcatgcacctggcacgcatggtggaggcgtacgacgcggctcgtatcgacttccatcagatggtgcgccgcgggttggtcgagaacaacatgaagatcctggagctgcgacaggagaatctgcagctgaagaaggacctagacgcagtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccctagcgtggacctgctttgtcgagacccctcgtgccgagcccgcgcccttggttcctcaggaggagggagcctctggcgtgggtagcacgaaagatgcgctactgctcaccttccgccctggcccgtcgcagaagtagacgagcagttagtaggcttgcacgtgtgttcttctcgttggtctttctgcttgagtcgtgtggggcatggttataccggtgtggggtataactgtatcggagcctgtctttattttatttgcttaagcaacttgaaccttaatgaaccaatttaatagcagtaataaattcaagaattatggtagtcgtggctagttagttttaatagtcagctctctctgtttgccggttctgtgtgggattttgagattgtgacaaccaggagaagtgctgctaccggtgaaggcagtcaccccgaaggcagcaaccacaacaaccatggcagcccacctccacctcctcccctgcctccaccaccaccaccagacaccaactccatcctcacccaaatcctcgcccagctggccaacatgacgactgctttcctccaccacatccaaaatccgccacagcatcatgctccacctccaccaccacccccacaacactctaaactcgctgagttcctccgcatccgtccgcctaccttctctaactccaataaccccgtggatgctttggattggttgcatgccatggggaaaaagttagacaccgtgcagtgcaacgatgaggagaaagtcatctttgccgctcaccaactgcaggggcccgcatctctatggtgggaccactaccaggctacgcagccagaaggacagcctattacttgggcccgtttcaccgccgctttccggaggacccatgtgcccgccggagtcatggcccttaagaaaagggaattccgagagttgaagcaaggcaaccgctctgtgatggagtatttgcatgagtttaacaacctggccaggtacgccccggaggatgttcgtgaagatgaggagaagcaagagaagttcttggcaggaatggaccctgagctgtccgtgcgtctggtctccggggactatctggatttccagcgtttggtggacaagagcatccgcttggaagccaagcacaaggaactggagtcgcacaagcgtcgcctgacgaatttccgcaaccaacagggggctaaccaaaggatccgctacaccaatccctatccagggggatcctcctcgcagcagcagcaacagcagcagcaacctcgctccgtgccccaacctcaattcgtggtgcgcgtcccacagccgcagcagcagcagagtgtcacatcctgatttttgtttcaggatttataaattatttaataaattaataatagaatttatattaaatgatctttaatttacaagtgaagttaaatgtgggaaataaaattttctaaatataaagcgtcgatggatttaatttttaaattctccatgattaagtcaactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaataatttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaaccctctctctctctttccctcggcccagtccgccgcgccccttcctcctctctctctcagccgctgacagatgggccccatctgtcggagccgtcttcctcctcgcgccgccgccgccgcccgaaccctagccgagccgtgcgccgccgctttccaattcggccgcgtctttccttctccggccgaatcttttgaggggaaatgatcttcgagatctcctcttccttttctcttatagaaactccggtcaatttcgtttggaaatcgacggattcgaggtcgattcggatcgacttttctccctccaaccccgacctttccttctcgccgccggtcgccgtgggccttcgccgccgcctccttgcccctttataaggatccccgagctctcctctacccgccacctccctcgccttcgtctctcgccgtcggaagcgccctagcgtcgtgtgacctagcgccgccgtcgtcgccgctccagctgtgcgccgccgccgttccggtcgtcgtcgtcgctcgggaagatcgccattgtgatcgccaagtcgccgccgtcctcgtccaccgcttcgccaccgccggagaccgccggagcaccgtcgccgccgtcgacccgatctccgccgccgcttcttcctcgtcgccggcgccgtccgttgcttttctgccgccgttttggtcaccggtaagttcgccgcaccgcgctctacgtcctggtgccctccgttctcgtcgtcgcgccgtcgttcgccggcgagcttgcgctcccgagctgccgccggtgctgacgtcatcgctgccgtcatcgctgacgtatcgttgccgttccccgtgagccggtcgtggaccgtttgatctcggccgtccgttttggatagggttgatctcggccgtccgttcccgtgaaccgctgccgtgcgcccagtccaccgcaaaccctagccgctgacgcaataaatccctttttccttttcaaaaataattcattattgcgtcataattcaattaaaatccatataagtgttttaatccgatttaatctttaaaaattcataactaattcatttgaactcagtttaatgtggttcaagttgcaaaaattttataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattataatctacatgtttgtttactttttatgtattgtttatttggtgtttattagtctttttcttggttttgcgtgttagcttgtcgtttccatcgttgcgaaggttcgcgagtgcaccggaagtgttcaagaagattaattgaagaccgattattgcaaggcaagtcacacagatcccaaacacaattcctttgagcatgttgatcctatattcaaattctctatttatttcaactgtgcatttatttttgaatgtcactgggtggtgtgaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcatgggcaacggctttacctttcgtatagcatggttcattgcagagcaccagactgagaagtggcggagataagcccacgggggtcgctggggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttctgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcagaatggttgggcctgtgcagcatgggtgtgctgttcagtgttgataaaatttctgattaattactccactgttttacttctcttaaatgttttgctaaatgctgcttttgcaaatgagcctatattatgccatcctttggtatcctcgtgcacttgcatatttgctgtgtggcttgctgagtatgtcatatgctcattcttgcaataatcaatcaacctcagttgaagaaaaagaatccagaaggagaagacgtttggcttataccccagttgagctgcctgtgggagtggagccagagcttcgctagattttattttccgctgcagttttcttcatggtgaggactaagtgcctcttaagtaagtatttatcgttttagttaatttgatgaatctgtatattaaattgtcaatttgtgtacctcggctgattcctggacgatgttttcatgcacaaataagttcggaaattactagtgaatttccgggcgtgacacagagtcagcaagggacccgtgcgccccatcctcctacgccagccgtgcagcctggacaaggccgcagagacgttcaatgtcagcagcgtctgtgcttcaactgcttcgagcccgggcactttgcggataaatgcccaaagccgaggcgccagcaaggccaagcgcctccccgccccaacaacggtggtaaggatgtcattcggggtcgtgtgaaccacgtgaccgccgaggatgtgctgacaactccagacgtcatcgtgggtacgttcctcattcattctatccctgctaccattttgttggactctggagcttcccactcgtttatatctgtgccattcatggggagaaatcaattgggggtagaaaggcttagaaaccctctgctcatcaccacccctggaggggttatgacagcaaagtattatagccctgccgttcctatagaaatccagggaattccttttccctcagatctgattcttctagacaccaagaacttggatgtgatccttgggatgaattggtggctcaattccaaggagtagtggattgcgcaagacgcactgtcactctgtaccgagggccggaacaaccggttgttttctttgcacccccaacctctgtcggcagttccgaacttcatcagataggactgtcggaaaccctcatcgtcagtgagttcggagatgtgtttccggaagaactacctggtatgccgcccaagcgagagattgagttccggatagatcttgctcgaggaaccactcctctgtacaagcgaccctaccgcatggcagcaaatgaactagtcgaagtcaagaaacagttggaagagttgaaagaaaaggggtatatacggccgagcacttccccctagggtgctcccgtgttttttgtggaaaagaaggacaagacaaagaggatgtgtgttgactacagagctctcaatgaagttactatcaaaaataagtaccctcttccccggatcgatgatctgttcgatcagcttaaaggtgccactgtcttttcaaaaatcgatcttcgctccggatatcaccagttgcgtattcgtgaagaagatatcccgaagaccgcgttcaccacgcgatacgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcacaatcagaggaagaccatcagcagcatctccgtctggtgttgggaaagttgcggaaacatcaactgtatgccaagcttagcaagtgtgagttctagttgtccgaagtcaagttcttagggcacgtgatctctgctaaaggagttgccgtggatcctgaaacagtgaccgccgtcactgattggaagcaacccaagacagtcactcaggttcgcagctttttgggtttggccgggtactaccgaagattcatcgagaatttctccaaaattgccagacccatgacgcagttgctgaagaaggaagaaaaaattgtgtggagcccgcaatgcgagaaggcgttccaaactctcaaagagaagctggtttcctcgctagtgttaatcttaccggatactcgcaaggacttcctggtgtactgtgacgcttcgcgccaaggattggggtgcgtgctcatgcaggaaggtcatgtggtagcctatgcctcccggcagcttcggcctcatgaaggcaactaccctaccaatgatttggtgttggccgctgtggttcatgctctaaaaatctggcggcattatctcattgggaatcgctgcgaaatatataccgatcataagagtttgaaatacatctttatccaatcggatctgaatcttcggcagagaagatggttagagctcatcaaggattatgatgtgggaatccactatcaccctggtaaggccaacgtggtcgccgacgctctaagtcgaaaaagccattgcaacactcttggggtccgtgacattccatcggaacttaatcaacagatggaagccctgaacctaaacatcgttagccatggattcttggctacgctggaagccaagcctaccttgctcgatcaaatccgcgaggctcagcagaatgatccagatatg

SEQ ID NO: 32630 - DNA, 2282 bp, Oryza sativa
cgctctaagtcgaaaaagccattgcaacactcttggcgtccgtgacattccatcggaacttaatcaacagatggaagccctgaacctaaacatcgttagccatggattcttggctacgctggaagccaagcctaccttgctcgatcaaatccgcgaggctcagaagaatgatccagatatgcatgggatcctcaagaatatgaaacaaggtaaagccgctggtttcacagaagatgaacatggagccctatggaacggaaatcgtgtatgcgttccagacgacagggaacttaaacagttgatacttcaggaagctcacgaaagtccctattccatccatcctggcagcactaagatgtgcttggacttgaaagaaaaatattggtgggttagtatgaagcgggaaattgcagagttcgtggccctttgtgatgtgtgccagcgtgtcaaggcggagcaccagcgaccggccggacttctccaacctctacaagtaccagaatggaaatgggatgaaattgggatggatttcatcaccggacttccaaaaacccaaggcggttatgactctatatgggtagtcgtggatcgactaaccaaggtagcacggtttattcctgtgaagaccacctatggagggagcaaactagccgaactctacttcgctaggatcgtgagtctccatggcgttcctaagaaaattgtatctgatagaggaagccaattcacctctcacttctggaagaagctccaagaagagttgggtacccgcttaaatttcagcaccgcgtatcacccacagacagatggacagaccgagcgtctaaatcagatcctagaagatatgctccgtgcctgtgttctagattttgggaagacctgggataagagtctcccctatgccgagttctcctacaataacagctaccaagccagcatacaaatggcaccctatgaagcgttgtatggacgcaaatgccggacaccgctattgtgggaccaagttggggaaagccaagtgttcgggaccgatatcttgagagaagctgaagcgaaagtcagaaccattcgggagaatctaaaggtggcccagtctcggcagaagagttatgcagataaccgacgccgtaacctggaattcgcagtggatgactttgtgtatctccgggtcacgccgctgcgaggcgtacgctggtttcagacgaaagggaagctcgcacctcggtttgtgggtcctttccgtatcattgctcgacgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtagagagactagtgaaaatcctggacaacatggagcgcaggaccaggaaccgggtaatccgtttttgcaaggtccaatggagcaaccacgccgaggaagaagctacttgggagcgtgaagacgagctgaaggcagcccatcccgatctcttcgccagttcttccgaatcacggcgtcgagattccgtttaaggggggtaggtttgtcacgtcccaaaacgactctaaaatacatcctctaaattatgcctagaataattaaaatctgtgtgaaagcctccaacaattaaaatgtgcaaagttaaaagtcaaataaggcttagaggatttttgtatatttcctaaaagcctaaaatgtgtaaataaattttagtggaattttcagagccccaattaaaattaagaagaaattaagaaagtttaaatggttttataaaaaggaaaacccttaaaatccctccttctttttaaggggctgaattgggccttttccttccttttttttttctttttccgggggccaattgggcttccttccccgggggggcgcggttgacgggcgggccaacccgcaaccttggttgacggggggggccaaccggtcatccctttcttccggcggttccggcggcggcggcggcgaaatcggcggaatcccgtggtcccggggggcattcgaaagggggaaataattcccgttaattccttttccttggaattggttggaaaaccttcggtaattccgccgaaggcaattaatgaaaccgaaaaagccggggcggttttctttcccttcgggcgttttttcccttcaaccctaattaaaaccctcccggaccttctccggccggtttcggcttttaacggcctttcttct

SEQ ID NO: 32631 - DNA, 792 bp, Oryza sativa
  unsure (1)..(792): unsure at all n locations
nnnnnnnnnnnnnnnnnnnnnnnnnnnnnnnnnnnnnnnnnnnnnnnnnnnnnnnnnnnnnacatccccaaccattctgaacaaccatacccggctgtacagatctaactccaaaccaggagctaaacaaattattaccagttatagcatccataattattgtgagaggtgtgagactaatcacaaaaaacattgctcacccgcccataacccgggcacggctattcgaatagttttactctggccagaggtgtaccactgtacccagaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccccagcgacccccgtgggcttatctccgccacttctcagtctggtgctctgcaatgaaccatgctatacgaaaggtaaagccgttgcccatgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccaccattaaataatagtgaataataagttatcccaatagtgtgctaatgtttctaagcatggctaagcaattatatctaatatctagttgaaccaatatatatat

SEQ ID NO: 32632 - DNA, 634 bp, Oryza sativa
  unsure (1)..(634): unsure at all n locations
actatagggcgaattcgagctcggtaccctgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttttatccttcttagctctgtaccaactaactcttgtcatatccttgtgctgttttggggagcttatagtatttacgtaatgatattgtccatggcaaaggtaggagatgtggcaagatctgcaatgttcttacagagttaccatgactcttttgcacaagccgtggtacaagaacctggtaaaaaggtaaggcagttttgagtgcagtataaattaatnnnnnnnnnnnnnnnnnnnnnnnnnnnnnnnnnnnnnnnnnnnnnnnnnnnnnnnnnnnnnnnnnnnnnnnnnn

SEQ ID NO: 32633 - DNA, 2884 bp, Oryza sativa
  unsure (1)..(2884): unsure at all n locations
caaaaaaaagggttttttttcaatatccagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccgaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgcttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatccgacgacctaccgtacgatcgagttcattgccctggaagtcgcacgtactcggactctcgaagcagcatgttagctcgttccttgacacactgcaggtggctctgtatatttatctgaaaagctgccgttgatatttgcactgctttagcatttgtgagttagtagctcttatatactagcacatcatgtcgcgcattcaccacactcgttctaaaatcatgttattcgttctaaaatcatgttatgtggtagagtggcaatctatatatctcttttaggtttctggttgctcgtaaaaaaacatgtatcggataagtgatattgtatatgctgaaataataaatgatttaaactttaaatatatgcaaacttttacatctgtatgagttatagtcctatagttgttttcgtcattacataattaacccccttatcctctccttattttttttgggtgcacctttatatccgccacgcatatattttgtaagtttttaaggaatattttagttttgttttaaattagtgtggaagtcattaaacttatatttgggagaccacgacctcctcgttcgaaagaatatgtaggtccatatagcaatttttatctcaaacacattaataattgatttttagaaacataattaattatatgaatatacattttgaatatgctcttaatagttcgatcttgccaaaaatagtttttcactataggtgcaaatggtaaaattatatatgtaactttatatcctctacttattctctagctttctctttcttttctacctttcctgttccagtagtttccgaaagcctcttgaataactttttttaccatctgtcaaattcagtggcgaagattcattcactatcttttatctttttaaaatctgtagtttgtgataaatttgatattaaatttataatactgtgatgcatcatcttaaatctatatttttgtgataatttgattaatatacctatagttttatgaaatttacttaaaacaaagaaacaaccatcagtgtctgcttggaaggccctgttttggacctaaaatcaacgtacatgacagccccagaaattgttcaagttgggctgaagaacgttgtttagatgggtcatttctagaattacaatcccgagttgatcccaactacccaaaaaaaaatatttcttgaattcggaaannnnnnnnnnnnnnnnnnnnnnnnnnnnnnnnnnnnnnnnnnnnnnnnnnnnnnnnnnn

SEQ ID NO: 32634 - DNA, 1556 bp, Oryza sativa
tttttttaccttctgtcaaattcagtggcgaaaatccattcactatcttttatctttttaaaatctgtagtttgtgataaatttgatattaaatttataatactgtgatgcatcatcttaaatctatatttttgtgataatttgattaatatacctatagttttatgaaatttacttaaaacaaagaaacaaccatcagtgtctgcttggaaggcctgttttggacctaaaatcaacgtacatgacagccccagaaattgttcaagttgggctgaagaacgttgtttagatgggtcatttctagaattacaatcccgagttgatcccaactaccaaaaagaaatatctcctggagtcgtgaagggctactccgctctccttgtggcttcatggaggccatcgcccgcaaggaagaatcgataaatcatcttattacagccttcacgattatgtcattacaaccatgagtccttatcaggaccttgccatggactgatggttgtaacgacatgaattgctgatgccactcattccaaagccggggctgtttctgttgtcccagtgggatgttcatcaacactgaaattataaaaaattcatctctcaagacttttgtgtgctctaattaacccccaagtctcttttgcagctgaggctatgttgtagccaaattgaagggaactgaaaaatgattgggaggggttcatatatagagctgagagacagtgagaccagaggcgatcaacattacagggatgagatcatgagagagcaatgacccaccctgtactattgcacgatcaactaagtgatgaatggagctaatatatcaacatgcttttcactgaaaaataattatgggtcttgatccactaggcactagatatatacatagctaggtagtaacatgttgttcgctttgggtcatataatgctgtaatcagatcgcagggaaatgtgtaacttttagcaactactacctccatctatctatctatctatacctatactaattgagcactttctcggagcttccacgttaatcagattaatctggccattgattaactagatcgtaaaatcatgaccatagattaaatattataaccactagccgtcaacctgtgcgttgcacgggttactgtgactaataattaaaatattattactttcactggataatgataaaatatgttactttgaatgaagctgatagttgccaaaatcttaattagtaatttcatatataatccattctaatatttcttctattactctattttttcaaaattacataatttaaaatttcaatattagaaatatagatttatactcgttttgttgctcttgttagcatttgctataaaataatttagcaattttgaattaataagtacagaaataaacttagtttggagttaagctttttcatgatttaatgattcctatattcataataattaaatatcaagttgtattctgtgtggagtctcaattataacatcttcataatttaattttaaaattgctaactaaaaatattatactcggtttga

SEQ ID NO: 32635 - DNA, 4278 bp, Oryza sativa
  unsure (1)..(4278): unsure at all n locations
tttgttttatcgtgatttaaaaattgttccaaattttcgaatcaatagtagttctttcatgatttaaaagtatcaaaatttgaaagtaattaatatatatcgctacacttatctgaagtatcagttatttctatgatttaataattatgaatttaggaattaactggtacctatttgtgcttgtgttggtctcctaatttagtgtactacgctagatgcatgaattttagtggcacttttagatcatcggtgtgttgtaaaagtggcccacatcattacagtagacataattcagaccaaatagtccttaaaactgacaaaaggcttaactcctagttagaaatcatgcaatctaactcctaattagtcagctaaattgaattttttatgaaatcatacattcactgaaacaaatgtatttggatgaagcatatatggagcagatttgttagtgatgtatgtttaacttatcttgtcatcttggtaattgggcactttctagaagcttccacgttaatcagattaatctggccatttattaaatagatcgtaaaatcatgaccatagattaaatattataaccatggacttttaattaaaggcccaacaagagaaacatgtatctgggctaccatttaatctatatcggcttccttcaaagtctacaaactgtgtccatgtcgatctcagccaccggactcaactccacacacggcaagatgacgatacgacaggacatacgtcgatctccttcacaccctgccgctgatgaactccatcgatcgatctccagttcactattttatcgatgcagatactattcagattgatctttgcagctatgattgctattttaaatactcaagtaagcaagatctaattcattatatttaagttttcattaagtattttttacatgtttctcatctattctaaactatgtaaaaatttcagattttaaggtatcgcaatttgatagccataaatttggatggagtttatcaggtatattcatttacttctaagttaaattctcccacatccttcataagcaaccaataggctttactgcgtatctttttcttgacatgaataatttactgtgtatctaatgctttagttggttccacgcgtaaaacagctacataatatttttgacaagtttgtcaggtcaggtatgattacaaacaagggaacgtagctgctgcccctatctatttacgaataagaaacaaacaagcacttcctttaatgtttctctgttcatatttacagatgtttatttacattatctatgtcaggtgtaattagcaaatgtcgacgatgttggctgttcttttaaccaagatgacaagataagttaaacatacatcactaacaaatctgctccatatatgcttcatccaaatacatttgtttcagtgaatgtatgatttcatcaaaaattcaatttagctgactaattaggagttagattgcatgatttctaactaggagttatgccttttgtcagttttaaggactatttggtctgaattatgtctattgtaatgatgtgggccacttttacaacacaccgatgatgtaaaagtgccactaaaattcatgcatctagtgtagtacaccaaattaggagaccaacacaaggacaaataggtaccagttaattcctaaattcataactattaaatcatagaaataactgatactgtagcgatatatattacttactttcaaattttgatacttttaaatcatgaaagaactgctattgattcgaaaatttggaacaatttttaaatcacgataaaacaaaaattaagatttcaaaccgagtataatatttttagttagcaattttaaaattaaattatgaagatgttataattgagactccacacagaatacaacttgatatttaattattatgaatataggaatcattaaatcatgaaaaagcttaactccaaactaagtttatttctgtacttattaattcaaaattgataaattattttatagcaaatgctaacaagagcaacaaaacgagtataaatctatatttctaatattgaaattttaaattatgtaattttgaaaaaatagagtaatagaagaaatattagaatggattatatatgaaattactaattaagattttggcaactatcagcttcattcaaagtaacatattttatcattatccagtgaaagtaataatattttaattattagtcacagtaacccgtgcaacgcacgggttgacggctagtttttttaatatatcatgtcgttgactttttgataaaagtttgattattcgttttgttcaaaatttttgggtaaatataaaaaataagtcatacttaaagaacatttgacgctaaatcaagtaacaaaaaataaataataattatattaatttttaataagatgaatcgtcaaaagtatattaaaaagatattaaaaaactagatgatgtccagtgctttgctgcgagatatatgttagataatggagaaataatgaaatgatttggattaaaatattataaaaatgatttgagaatgattatctagcatgtgtatatttagttttagaatgaagtaacttgtagatataattactatatgcttccatgttgagctatgtgtgcttaaaaggttgatgtggcatgcttgtatgtaggttttaagagtgctaataaatattatgattgcatgttgagttttagatgtttagtgggcattagctttacagaggaagtagtttgttatattgcttagttatcagaacccactatctagatgcaccacttctgtcatcagatgacgatgctgaatttgaccacaatcgcaaaatattgtagattataatggtgattgtacatgcatcatgccttagtttccttgctttcgggagtaattgcaatcagtggccgttacactactagaaaaaatattttttattccaaacctcaaaacacaaatatcccgactagattaagaacatatattaaagatgttttaataccgattctaaaagtttaaatccaagaaacatctttagttccagttggtgttaccaaccgatacttaaaaaagcatctttagtactagttagaaacaccaaccaagactaatgctggagaaattttagtcccggtttatattactaactggtactaaatattttttttagtatcggttaccaaatgcctctagggttagttaaaaagaaagtatctctatccaagttagatgtgtgtcgtaggtgggatagtaactcgtattaggactgagtgagaaatcttaagttcgaatctcgcatcctacatatcttttttcacttattttgcatttttagtaccgattctatcaaccggtactaaaaatctcgatctttagttttggttgctataaccggtactaaagggggtttcaactggtattaaagattgtttctccagtagtgttactatcctgaacctgtaacttcatagcaacaaatcttgaagttcatcggtgccatcctctggcattttcttacctgatttcagtttgtaaactattttgcttcattgattcctttattttatttctctgaacaaatcttgtatttttctaaccaaaatatgaaagtaaccatttgtttctatcatattgtaatggaaaattttaaatcaaatctaaccaagataatatgaagcattgccaaaaaaacagagaaattttgagcatgcatatagagtgccagttgaagtgaatttatttaaattgaactttgcaatggatgaagctcgccatgtttctgtatcaggtttagcatataatttcactttaaactaggtgcatagaagtaagtttcactttaaggtcaatataaatcatcaaacatatggaaattttctcataaattctgattgaaacttcatgaaacaggtccaaattcgaaagttccaaaagatacactcttgatttataaaatttcccttccattatatggtgaacctctagcggaaagtggaaattattcagaacattgcaatttactcagaacattttgatctgcagtttaataaatgaagagagatcacagtctaattttgctagaatatcacattggcgggtcattattgtacccagtgcccatggttacgatgaaaaaacatgttttaatttttacgtagaacataggcttttttactaactagaaggggaaccttcaaannnnnnnnnnnnnnnnnnnnnnnnnnnnnnnnnnnnnnnnnnnnnnnnn

SEQ ID NO: 32636 - DNA, 7306 bp, Oryza sativa
cccctccccgcccccctcccgctgtcgcggtgcgctactcacagtcctcctcccctcctcctccagggggaggtccttcaaaatggtagtactagtacattgctacccttttattgctgccagtactgcaaagccacatcataaatatccttacttgtctagaaaatgcatggatgaggacaccgccacacgctgatatatacaaacggcacgatggcataacaataacgttgtggagcctagatgatcgacaagcaagaatgactcagacaaaggtataccgtatacgccggtggaggaagaaccaacgaagatggaaaagcgcaggaaggcatgtggggaatagattggctgagaggtgaaagaggagtgaatggagacgcgggattgcgtgagagatagaaaagctgaacgaaatgacaggcaattcacatgacagatcaccaggactggtataccaaaaccttaagtttaattgatatgatcaattaaaccctagattgttcagttccgcacattgttgtacttcgatgcagatacctccaatgttggttaatccagtcttcagcaataatttttatcctgaagtacctgctatatacaacttaacaaataactaatatattggaatgaaaacaaccctgaggacctgtttggcacacaagttttggaacaaaatcactgtaaattacagagcttaaaagttattctagttggtctgaaaagcgttgttgttcaggtgggttgcttgtcatattctataatcgccgattgagcccaatccaccgagaaaagaaatatctctcctcctgatagcacaatgaaagaatgagctaggagtcctaatgagtagtatatctctgatctggttacctggcgatcgagcctgcggcttcatggtgaacgggacaaacgaagccatcgcccgcactagcaacacgcgaagtgaggcaccccacagcttacacttgaggcaggatcagcaggtgcaccagcatgaaataaaccgagtgtccacgacctaactggggaggacattccccgcaaaaaaaaaaaaaaaaaaaaaaaaactggagaggacattgcggcccatcggtatggcggcacggctccttattctccccatgtgtattccacacgacattcaacatggcaggttacttgcagctcctttttgcaggatttaccatgtaaatgcaggatcgtacaacaaaaactaagccaattagaggggtcaaatggttggagtaaccaaaaatcaaaatttttaacggaattaaaagttagcctccatttctctttatagctgaggtaggttgcctaaaaccatgaaccaaactcatacaagaagtcctaatcctctaggaaaccatgctggacgagaaacaaactttataaactccaattcacaactacagaaatgtagattggtactggttgggaactacacaaaggtgctggatttcccaaccgacaccacgaaaacggcactgatgagaagactccaagatgccggtttaggaaccaacacctttgatgtatacgatttgtaaagaaaagagtaaatttcactttgggcctgatttattggccaaagtttccccataccaggtataactctaccttttcagttaacaccaggtatgattaccttcttttgcagtttggactgggtttcaatacttttgggccaccatgttggcttgagcctggtgaactcagttcagcgcagagagttatcaagggagactagcgcacgggaaaggaggaagatagtgtcgtggaggtgggggtggaggtggacttgctcaacgcctcgatctccaccctcgccaccggcggctcccggccaagtctccggagcagcacggcgtggcggcggcgtgaccttctccggctccgaattggcatggcggcgtgctcttcagcttcggtgtggtgttggtggaatgaatctgtgttgtttctaaatgtgtatgcaagtaagatagagctgtcaattttgccactaaaaacatggaaagaggttccaagttccatatgtacatgtacctgatcatgaggtacttgtgataatttccctttccagtgccttctctttagtggtacttatttacaatacaattagctaataattcctactctaacttggtgaggcttttggaatcctcccattctgccgtgagctgaaggagcagtgcgtgcaccccgttgccggcaccgcggtcgagcagaagaagagcatgccgccgtcctgccgcgccggagccgaagaagagcatgcacggccgctgcgccatgcctcgccagaaccggagatgtgcacacggccaccgcatcgtgccgctccgcaggcgtagaagccaccggtggcgagggtggagaccgaggcgttgagcatgtccgcctccgcctccacgacactatcttccttctctcccatacactagttttcctcgataatttctcttccccgaactgagttcactaggctcagatcaagccagcgtggtggcccaaagtcttaaaacccggtccaaactgcaaaagaaggtaatcatacctagtgttaactgaaaaggtcgagttaggcctggtttcatggtgaaactttggttaataaatcacgcccaaagtgaaatttactcaaaaagaaaaaaccaggagccgagccgatgcttgaaagccaccaaacataaattaaaaatctaaaaaaaggaacaagtacacatcacacaatcaacaagttcatagatcacaataaacaagttcatcaatacatcaagaacacggtctaaaaaaacaacatcaagaacacagatcaagaagtactctacccctgccgccgtcgccagatagaaaggaggatagggggaggggcgagcctccttctccccttccactacagccgccgctgcctctgctttggcgaaggtgtgggtgctaccattgccgtcgtggaaggccgctttttcccctcccaccggatctggcgaaggggagggtgccacccctgccgcatctcctccatccatcagagaatgcagatgcctctcctcccgccgtatctggcgaagggaagggcgctgccccttctgccgtcggaggcagtcgacgcctctcctcccactagatctagcgaaggggcggcggggtgtgaccgctaccgctaccgcctccgccgggccactccggccgccgcgagagatgagagagagaagagagagagagagagagagagacgcgtgagatagataagatcaaggggattggagagaaagagataatgccgagggctgggctcgctggcttggctcggtttgttataaaacaaaggcacttatagtataagtataggttttttctatttttagtcagtggaggtgggaaaaacactatatgtgctggttttagctattctagcccctatagtgccgacttgtatgtgccttttttagtagtgattgtaccaaatttggactccttccaaattcaactccacatcccatacgcacaccatatctccgtcgtatgtcatatggaatctataccaaccacgtgcattgatgtttagcttaaacatcccacatgatatcctaattatccggacatcatcttctcccaggttgactcccgatccatcactgacaacgctctcccgaggcatcaagacttacctacacatgaacctacaaagaagccatgcatattggagcataaaatctcttcaactagactcaacattagcacaacaatattacatacgcttgttaacgaccaaatttggtaatattagcatcggagatgaagattagatcgaagcggaatcgaatataaggattgtcgcggaaacagagtaagaatcggctggagtccggatcggctacaactaggatcggctaagtccgagtcagactgggttaagtgatacagccgattctgacaatacgacttgtgtacgacatcgggtttgagttgataagcttcaatatgattgccgcgcatggatagagttctgagaaggcaattgtatctattaattaggatattttatgtaaattctttagagataaatgtgggtaaaagtctgtcgtaaagacttatggtatcttagagattgttagagataatagtcgtgtccgatttggacatatcttgtaattcttgggtataaatagaccccgagccctatgtaattattaacacacactatcaatacaatctcggcgcatcgccacccttttacttttgttttgtttcgatgagttcttgcttttgggttgagctgcatcggtttcgatcttcaacaagaggtaagacttgttatggcggcttgcgttctcgggattagtgcttgcatctttattatactctaatcttgtttatgtaattcatcgagttatcatatatcttatataatctttgataatatcgtcatctaacctacaatcggctaacatctgttaacacaaggcggccgattaggttaaatagcgacgttggcttagattatatcgatctaagtgatttatactgtctcggcatggcgaccgatctatcccaatcacttgatttaagtatatatcgacataaggattatatattgttaatatctacagccgattgagtagatttagttcctttttattcatttatggctatcgatcgatgtacatatgacatcggcccaaaggtaaatgatatgtcatcggcacttagccgatcgactatcatttatggatttaaccacggtttctttgtctttatttcttgttgattgtaggatcaaataactggcatgctcatacatccgaaggcagttttggacctgcactggagttaagcagatctcccaggcctcgtgttttctgtcaatacgcttttggcatgcctgataggactgattagaagtcagagtcacaacagcagttttcctcatggccgagaaaccgccaccgtcaccgtcctcggctagagaacctgattctgtcaaaactaagatccttaagttgggtctgtctgaggttgatgagagcaacattatgcccatcactctggataaattgacacctgaacagcataaggatcttgaagcaatgatgcagcaagcaaagaaccaatttttgagttcatttacacagacccgcaagggaacgttggttcagaagtataaattaatggtggttgcggatgttcctgggacaggttcttccaaagatggtgaactaaaacaggctccagatggtatggctcagccaggtgatcaaggtgttgcaaatggttctcaaggaaatcaaggcgatggttttcaagaagttcaaggtcttggttctcaaggtgataattcccaaggattacaaggtggaaatcttagtcagaatggcaatgcagcacatgagcttttcaataacttccaagatcgggttgactatgccgtgcacaatgctttgatcaatcagtctggggtgttagtcaataccttgtcaaacatgatgaaatcaatggttgatggttcaatggctgaatatcaggctacaggcccagtttatttgcaaggaggtgtctttccagattatcggcctctgatcaccaatactcagccatctgttcaaacagttcctcccaatgcgccatcagctcagccgacggcaccggtatcggctcccgcacttgctgcgtctacgtcggcaccaggccaactagttagtcctcggttgttgatgagagaacaaccacagcatagggggcaggatgtgaatcggctacgcaagatcaggttgcggccatgttcttaccacctcaacctattgttgttctagtccagcagcagccgattcagcaaacaccgccaaggcagcagtttgtgcaaccagcttagcaaacacccccaatccaacaggttgtgcaaccaattcaacagacgccaccaagacggcaggttttgcagtcgattcagcaaatgccattaacgcaacaggttattcaaccgattcatcagcaagggttaatgaatgcatcggctgggtttgcaacacctaacaatcagctaggacaacatgctctaaatcaggttgtcccagagcatttagttcatcatgtgcagccggaccagacggtggtacctcagattgttcctgaacactcggtgcgtaatattcagccgaactaccagaattatcaggggggcaatttgaattaccaatatcaacctccttcgccgcaagctcaatatcagcaggggggcccactcaatctcagtttgttcttcagtacaatcaattcgagcccaagcaacaacagtcgcaaggagcaactcagcaacgaccgtgggctgatgtgattaccgatgtgatgagggaacagttcgggcttaagccgaaagatgctggaaacttgtatcggcaaccttaccctgagtggtttgagagagttcctcttcctaataggttcaaagttctagatttttcaaaattctcagggcaagatggtgtgtcaacttatgagcacattagccgatttttagctcaatgtggtgaagcatcggctgtggatgccttgagagttaggttgttccggttgtccttgtctggatcggcttttacttggttttcttctgtgccatatggatcaatcaacacttgggccgatttggagaagcaatttcacagctatttctacagtggggttcatgagatgaaattgtccgatttaacagcaatcaagcaaaggcatgatgaacctatgcatgagtatatccaaaggttcagagagatgaggaataagtgctatagtttgaatttgactgatgcccagttagccgttttggcttttcagggtatgattgctccgatcagggaaatattctcatctgaggactttgatagcttgtcacatcttatacaaaaggtaaccctgcacgagcagaggtctgcagaagccaggaagaaccctaaaagggttaatcatgtttgtccttacatatatggatcggataatgatgatgatgactgtgaaatagctgcagctgaatgggtaagaagtaaaaaggttataccatgctagggggtaaagaattctagaaaagaggagaggtatgactttgatataaccaaggctaacaagatttttgatctgttgctctgagagaagcagattcaactccccgctggtcatacgattccatcggccgaggaattaggcaaaagaaggtattgcaagtggcataactctgggtctcattctactaatgattacaagtcttcaggcaacaaattctagtagccattgaaggaggcaagatcaaatt

SEQ ID NO: 32637 - DNA, 1443 bp, Oryza sativa
attcaacaatttgatacccatgctatcggcaaactgaacaaactcatcggacacgaagattgaaccttgatcggttgtaatggtttgaggaataccaaatcgatagattatatgttcttgaacaaattgtatagcatccccagaatcaaccttcttcaaaggaatcgcctctatccacttggtaaaataatcggtcgccaccaatataaacttatgccctttacttgacggtggattaatcatgccgatcatatcaattccccaacctcgaaatggccatggtttaataataggattcatagccgacgccggtgctctctagatcgccccaaatttctgacaatcttgacatcccttgtaatatctgaaacaatcctccagcatcgtcggccaaaaatatccagcacgtcgaagcaaccacttcattttatgagccgattgatgagtggcacatatcccttcatgaacttcaccgattgcaagtttagcctgatcggcactaaaacatttgagcaacaccccatcaatcgtccgataataaagctcattatctaacaaagtatacttcaacgctttatatcttaacttccaagaagccgattgagacagattctgtaaatactgatggacatcatatctccaatcatcggctgttatggcagcaacttcaatcttaacatctttgatcatcggcttatatcccgatgccccttgggctaaatcattagatattccttaatattatctaaagctttctgctgctctgtcccccaagtaaactgttgatcggccttcaatctcaacaacggtgtaaaaggctctaaccttccggacaaattagaaataaaccttctaacaaaattaatcttgccgatcatctcctgcaattttgtcttgttctctgtaggcttaatcttcttgatcgcattgacacttctttgagttatttcaattcccctctcatgaacaagaaatcccaagaactggccagccgatacgccaagagcacactttatcggattcatcttcaagccatatttttcctagttctctcaaaaacttttctcaaattggctatgtggttcgctatttccttagacttaataaccacatcatcaatatagacttcgaccaaccagccgatcagatcatgataaatatagttcatggccctttgatatgtggctccagcactttttaatccaaaagtcattactacccattcaaataagccgattgcaccaggacatctaaaagccgtcttataaatatcttccttagccataaagatctgattatatcccacatttccatccataaaactcaatatcttatgtcctgaagcagcatcaaccaactgatcggctactggcattggatactcgtcctttggggtagctttattcaaatctctaaaatcaatgcacaccctcacattgccgt

SEQ ID NO: 32638 - DNA, 775 bp, Oryza sativa
  unsure (1)..(775): unsure at all n locations
ggttctccatcttcaattggctgtatatcagaatcggactattttagaaaatctccatcccaaacttttccagataagcaatcaagaccatccatctcccaaaagctaaattggcactggcaacattgactgacctgtcggttggcacgatctaaatcttgttgccttaccattgaatcaagcattgatgcatggttgaaggagtacaacaattggcatgaatccaatccctaccaagcaacaagttgtaagaacccttccgatcgatgacaaaaaaggtagtagggatggttgtgctgccgactgtcagctcaacatttagaacacccttggtttccgatggattgccaccaaagtctttgagcaccatgtttgtcttgatgagatcttcagcgtttctgcccaacttctagaacgtagcttaaggcatcaaatttactgcagccccaccatcgatcatcatcttagacatcggcttcccattgacatagccatttatatacaatggtttagcatgccgattttctgtcccctcaggcttctcaaagattgcttgttctggtgatagaaccaacttagccgattcttcttcactttgtcaacatcggtttgtttgatctcgaattcggctggcaaggtaaaaaccatgttaactgatgccgttacaacactattcccttttgccaacttcttcgcctcgtcggctgtggcgtcatcgnnnnnnnnnnnnnnnnnnnnnnnnnnnnnnnnnnnnnnnnnnnnnnnnnnnnnnnnn

SEQ ID NO: 32639 - DNA, 247 bp, Oryza sativa
  unsure (1)..(247): unsure at all n locations
nnnnnnnnnnnnnnnnnnnnnnnnnnnnnnnnnnnnnnnnnnnnnnnnnnnttacttttctttttgcacccaccggtgggcggcccggccggtagtggccaccgtggcaagcggcaggcaaggggcactgctggtggcaggtggagggctctaccggtggcatcaggcggttctgcctccgccggcctcgtgacgggcgcaggcggtgctatcaacggtgggcttccccgcgcatcgacggaggctt

SEQ ID NO: 32640 - DNA, 652 bp, Oryza sativa
tgtagcggaccctttggttagccccctgttggttgcggaaattcgccaagcgacgcttgtgcgactccagttccttgtgcttggcttccaagcggatgctcttgtccaccagacgttggaaatccggatagtccccggagacaagacgcacggacagctcagggtccattcctgccaagaacttctcttgcttctcctcatcttcacgaatattcctccagggcgtaccgtacccccccgggccaggttgttaaactcatgcaaatactccatcatggagcggttgccttgcttcaactctcggaattcccttttcttaagggccatgactccggcgggcacatgggttctccggaaagcggcggtgaagcgggcccaagtaagtaggattgccctttggctgcgtagcctggaaatggtcccaacatagagatgcgggcccctgcagttggtgggcggcgaagatgactttctcctcatcactgcactgcacggggtctaactttttccccacggcatgcaaccaatccaacgcatccacggggttattggagctagagaaggtaggtggacggatgcggaagaactccgcgagtttagagtgttgtgggggtggtggtggagcattatgttgtggcggattttggatgtg

SEQ ID NO: 32641 - DNA, 3560 bp, Oryza sativa
acacattcaagcaaaatctctgtcagaaaccgtgcaaaactgaaccttttatgtattacgaagttgacatgctcggatagcttcggtctccttcaacaaaggaacaaaaaaaaattacagcaattctctgcttcaaaacatgataaacccaatcacctcccatgttattactactaattattgtttaattttcctttcgctctatctcgaattcattcttcgattctaaagaaagaaatcggtgagaaaccaaacaaacaatacatgagccgagccgaggtgagcgattcagtgcctcccacgcttcttcgcgggcttgcagtcgtcgtcgtcatcttcgaagccggacacctcgtcgtcgtcgtcggagtcttcgtcgaggtcgtcgtcgaactccccgtcgcttcccatggcctcaaactcatcgtcctcgtcctcgtcctcgctctcgctcaccgccttcgccttccgccccgcggcggcgtaccctctccgcgcgtgcagcgccgcgggggtcgcgcccgcggggtggagcaggaagcgcgccacggcggcggatggcggcgccgccgctgccaggcggggagcggcgggcccaacggcgagatgcgccggtggtgggcgtggggcggccgcggcgaggcggcggagggcgagggaggcggcgcgctgcatggttgggggttggcggcggcggtggcggcggtgggggtgagtgggagggtggcggctagggttttggagcgggatttgcgcgagggctggggatttttaatggcggggaagtgggagggagcgcgggcgtggctggaagattccagagaccgcaagcggctcccgcgctctactctgatgatctgatctggtcgccgccgccaccggcgtgcgtgtgcctgctttttcatttttcttttcctattcgggctttgttgggccggtgaatgcttgttgggccattgaagatcaggaacaggttagattgggggaataagtccacattgactcccttcaaagtgacccgaatctaatccatgaccctaaacggcaaaaccgaatatctcgacccccgaactattggaactggtgcaatttgactcccttggcggttttggagggctgtttcgctgacgcggtgctggcgtggcggtgttgacctagtctgtgaggttgacgtggcgcttagatggcacggaagttgcagccacgcagcgagctcgagcgatgactcgatgacgtcgtcgttgcaatgctgaatggcgtagcttgatggcggccctcgcccctaaccatcttgacaggctcgacatcagccatgtcatgagcctgccgcatatgtcgaatcttgttgttgcgatcggcgaaaaggccagagtgccggatcttattgtcgcggacagcgggaggcagcggagggagcagggagctcgttcccccggtgaggacgttgtgtcggtggaggtgaggactaggggtggaggaggtcgccggcgtggatccataaaggagatcggctccggtctccccccagcacccttaggccacgccggctcccagatcttggcccgctgaagccgtctaccgccgtccccccgctcgatctcgtcggcgctgtcgtcctctcccgcctccttgccggccatcgagctgcccgctgccgctccagaacccgccgttagctccaacccaccggcgctgccgcttcaactcccggcggccgccaccgctctagcccccgcccgccgccgctctagcccgtgctccccgcgaccggccgaaggggagagagagacaaagaaagagagaagggaggaagaggggaggaagaagaaagagataggatgacatgtggggcccacatgtcattgggccccataattttttgtgtgtgaatgacaaacgggtcccacatatatgtttttaattcaaatgccacctaagcaccacgtcaaccccacagactatgtcaaccccgccacgtcagcgaaatcgccctccaaaaccaccaagggagtcaaattgcagcggtttctatatttcgggggtcgagatatccggttttacggtttatggtcatcgatcagattcgggtcacttttaagggagtcaaagtggacttattcctagattggatcgtgaggcagcacgacaacaaacgggtgattttagcatggaaaaagtacaccaaaggtccctcaactttttatcgagttacaaaatggtcccccagccgcaaaaccagatgtaggacatccctcaacttacagatccgttaactttaggtcctccggtggttttgaccataattttgtctgacgtggcagctgagtcagcgtgagaccaacgtgatccccacatgtcagggtgtccacatcgtcaccctatttctttcccctcttctctcttactcttctcgtgtaggactctgggtagggcgactgacggatggggaggagaccggcggggtggggcggggcgaggcgggagaggtggtccggccacaattgctatctcgcgccagttgcttatgtcgcgcgcacgtggcaagccaactgcacatgcatgcatgcaccacggtctccagtcgtgcagatgcattacacacatgcatgcatgcatctatacgatctttctttttttttatgctttcatcttaattaatttaggatgtagtgaaagttatcaaaatttctattataagataattttaataaaaatattttttataatgcaaatttaaaaactcgacatgaaagtttttaaatcggagttgaaagttttcaaatctcgagttgaaagttttcaaatccaacttgaaagttttcaaatctcgagttgaaagttttcaaatctgagtcgaaagttgtcaaatctcgagttgaaagtttttaaatctgaattgaaagttttcaaaatttatcttgcaaatttaaatttcgacttgaaatttttcaaagtttaagttgaaagatttcaaaatttgactttaaagtttaaatcttaagttgaaattttcaaatctaacctgaaagttctcaatctattagaaaaaagaaaaagtttttaggtactaattatgattagcactaatcactaatcacgtcatcattagtgctaatcacatctttgtgacgggggcagcgtacgcacgagttccgttcgcggcgcgtatgcgcgcgttaggactcccttggtccggcagccggcgacgacggtgcttgtgttggcaactttttttgacaagcggtgatcctagagtcgccaaccacctcgatctagcaaagagctaaacctagatgggttttgataactaaactagctagcggagccgatttctagataactacccgtctcgtgggcaaaacggaaggttttcaggacaaacctacaaagagatgtcgcactctcgcagcggcggcggacggtttacggcgcaaaccgacaaagatggaaaaactaagagaaaactaaaagcaatatgaaaaacgattcgattgattgattgtagattggttttttacaatgaaccggccatgtcccttatataggggttggtcttgccc

SEQ ID NO: 32642 - DNA, 433 bp, Oryza sativa
  unsure (1)..(433): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaagagatgggttctaagttgaactttagtactgcttatcatccgcagacagacggacaaactaaaagggtaaatcagattttgtaagacatgttgagagcttgtgctttagacttcggtggaagttgggataagaatctaccttgtgcagaattttcgtacaacaacagttatcaagctagtcttcagatggctcctaacgaagcactgtatggtcggaagtgccgcactccgcttctgtggga

SEQ ID NO: 32643 - DNA, 9997 bp, Oryza sativa
  unsure (1)..(9997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaggttgtgttctgatgcaagatgggaaggtggtttcctatgcatcttgtcagttacgtccgcatgagaactaccctactcatgatcttgagttagctgcagtggttcatgcgttgaagatttggcgtcattatcttttcggtactcgtacagaggtgtacacggatcacaagagtttgaagtatatctttacccagccgaatctgaacatgagacaacggagatggttggaattgattaaggattatgacatgggaattcataatcaccacggaaaggctaatgttgtagcagatgctctcagcaggaaaggctattgcaatgctacggaaggacaacagttgccatgggaattatgcaaggaatttgaaagactgaatttgggaattgtcagtagaggttttgttgcaactttagaagcgaagcccactctcattgaccaggttagagaagctcaaatcaatgatcctgatattcaagagatcaagaagaatatgagaagaggaaaggctatcgggtatttggaagatgagcaaggaaccgtatggttgggtgagagaatctgtgtcccagagaacaaggagttgaaagatgcaattctgaaggaagctcacgacactttatactccatttaccctggtagtaccaagatgtaccaagatctcaaggaaaaattttggtgggcaagtatgaagtatgaagtgtgagatagcagagtatgtagctgtgtgtgatgtttgtcagcgagtcaaggcagaacatcagaaacccgcaggtttgttgcagcctttgaagataccagaatggaagtgggaggaaatcggtatggatttcatcactggtctacccagaacgtcatcgggccatgactctatttgggtgatagtcgacagacttaccaaagtggctcatttcatcccggtgaggacaacatatttcggaagccgtttggcagaattgtatatggcaaggattgtgtgtttgcatggcgttcctaagaaaatagtatccgatcgaggtagccagtttacttcaaagttttggaagaagcttcaggaagagatgggttccaagttgaacttcagtaccgcttatcatccgcagatagacggacaaaccgaaagggtaaatcagattttggaagacatgttaagagcttgtgctttagacttcggtggaagttgggataagaatctgccttatgcggaattctcgtacaacaacagttatcaagctagtcttcagatggctccttacgaagcactgtatggtcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtatcttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttattaaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctctctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggttgccgtcgcgtcgccgtcctcgtctgccacttcaccgtcgctgaagaccgccggagcaccgccgtcgtcgtcaagccgaagaccgtcgccgcttcttcctcgtcgtcgccgccgtccgttgtttctccgccgcttctttggtcaccggtgagttcgccgcgtcgcgctctacgtcctggtgccttccgttcgtgccgaagcgccgtcgttagctggtgagtgtgcgccgtccgagctgccgagccgccgccgatggtgacgtcatcgccgacgtcatcggggccgtctgccgtgagccgccgtagacccgatcgatctcggccgtccgttttggatggattgatctcggccgttcgttcccgtgaaccgttgccgtgcacccggtccaccgcaaaccctagccgctgacgcaataattcccttttccttttcaaaaataattcattattgcgtcataattcaattaaaatccatataagtgttttaatccggtttaatctttaaaaattcataactaattcatcttagctcggatttagttggttcaagtttctaaatttttctaaaattgagatctacatgttaaaaatatccacatgtactattcatgcttgtttatgtgctgttttggtgtttttgctcttttctgtttagattccgacgtttccggagagtccgttttcgcaggagaagaatttgaagagttccaaggccagcaaggcaagtcacacagatcccaaataaccctttgagcatgttgatcctatttaaagctactgtttctattcaactattgcatttattttcgaatgtcattgggtggaattaacctattgtttgttatagcccttttgttcttgattactttattccttgatactttgggttattataacttgactagttgggctttatatattggttcaactagatgtattagatataattgcttagccatgcttagaaacattagcacacttttgggataacttatgattcactattaattaattaatgatggcttaacgatagttcacgatggtcaatcgtgattggttaattaattacttgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggatgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaatggttgggcctatgcaacagggtatgttctgtagcgttggattaatactgtttaattaatacttaactgttttatcaatttctgaaatatttgttaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtgaagctgttggtgtggaggattaggtgtaaccctggtcaagctgcctgtggagtggagtcgtctgtgccgtttatcttatttttccgctacttagatctttattgattgagaggaactatctacctctgtaatgacattttattcgcttattatttagagtaataattgaactctattatcaatttgttattgtgtgcctcggctgattcctggacgagggttcacacacatgtaagcgtttggaattttggatagaaattccgggcgtgacaagggaataagaaaagaaaaagaaagaattgaatttccagagattaaataatgcttgtgctcatttttagttggttaaaattatttctagagctctgaaaattccactaaaaatcttgttagcatatttcgacatgtagaactcaagaaaaattccacatgccaatcccaattattatttgcattaatttattagggtttctctcttacttttacaccgatatttcctctaggtaatttataaattcaatttaggcttgggaaagaacttcagggtttgacaaacctacctcccttaaacggaatctcgaccccgagattcggaagagctggcgaagaggtgcggatgggcggcctttaactcatcttccctttcccaggttgcttttttttctgagtgatggctccactgaaccctgtagaacctggtgaccttgtttctagtccttctttcactggtctcaaggatacgaactggcttttccacataagtcagatcttcttggatgtcaatgtgctccgaatcggcttgttcttcgggtaccctcaagcacttctttaactgggacacatggaacacgtcatgaatgccgatcatgttggatggaagttctagctgataggcaacttctcctcttcgttccaagattttgtacggtcccacgaagcgtggtgccaacttgcctttcgtctggaaacgatgcactccccggagcagagtaacacggaggtacacataatcccctgcttcaaaagtgagctcccttcggcggttgtccgcgtagcttttctgtcgagactgggcaattctcagtctctctctgacggttctgactttctcttctgcttccgttagcacttccgttccgaacatttgatgttcgcctgtttgatcccagaagagaggcgtgcggcacttccggccatacaacgcttcgaacggtgccatttgtagactggcctgatagctgttgttgtacgagaattcagcataaggcagacttttatcccatgccccaccaaatcgagcgcacacgctcgcaacatgtcttccaagatctgattgaccctctcggtttggccatctgtctgcggatggtaagctgtactgaaattcaaacgggtccccaattcttcctgcagtttttgccaaaattttgaggtgaactgattccctcgatcggatacaatcttcttgggtactccatgcaaacacatgattcttgagagatagaactctgccaaccttttgcctgtataagtagtgtgcactggtatgaaatgagcaaccttcgctgtcggagatttagatcaggttgggtgaagatatatttcaaactcttgtgatccgtatatacttcgcagcggttgccaatcagataatgcctccagattttcaaagcatgaaccaccgctaccaattccaagtcatgtgttggatagtttccttcatgtgggcgcaactgcctcgaggcataagcgaccactctgccctcttgcattagaacacatccaagcctgtgacgggacgcgtcgcaattgacttggaagtccttcatctgatcaggcagaatcagaactggagcagacactaatttcttcttgagctcctcaaaactcttgtcacactcggccgtccacttgaacttttcttctttcttaagcaactgagtcataggtctggcaatcctagagaaattttcaatgaaccgacggtaataacccgcaagtccaaggaaactccgaatctgtgacattgccttaggcggggtccacttggtaactgactccacattcgacggatcgactgccacgccctgagctgtaatgacgtgacccaagaatttgacctccgataaccaaaagtcgcatttactgaacttggcatataactggtgctccttcaacttctcgagtaccagacgaagatgttgctcatgttcttcttcagactttgaatagatgagtatgtcatcaatttataccacaacaaacttatccagaaattccatgaacaccttgttcatcaggttcatgaagaatgcaggtgcattggtaagtccaaaagacatgacagtgcactcatacaacccataccgagtggtgaaggctgtcttggaaatatcctcttcccgaattctcaactggtgatagcctgatcgcaggtctatcttagaaaacactttagctcctttcagctgatcaaacagatcatcaatccacggtaaagggtatttgttcttgattgtgacctcattgagcgcgcgataatcaacacacattctcttcgtcttgtccttcttctccacaaaaatgaccggagcaccccaaggtgaagtacttggtcgaatgtaccctttctgcagttgctcatcaacctgcttcttgacctctgctagctctttggctgccatcctgtacggtctcttgtaaattggagcagtccccggtgccaaatcaatccggaattcaatctctctcttgggtggcatggtagtgaggtcttcggggaacacctctggatactcgcagactatggggatatcttccaatttcctcgaactcttctcctcggtggccacagggttttccacctcaatctgatttaaggagattccctgcttcggtgagactggtgacttgtacaccacggtttctcccttctcattggtcaaggtgactatgcaattcgcacaatcaatgactcccttgaacttggtcagccaatccatcccaagaatgacatctaggtctttggattcaagaaggatgaggttggctagaaattatgatcggtgtattcctattagcactgaagggctataactgaccgaggttgaactatttcccggggtatgaaccctcattggtgtactaagctcttcttttcttaacccatgcatcccaacaaacttctttgaaatgaacgaatgcgttgcaccagaatcgaaaagtactgttgcagggattgagttaacaggaaacgtacccagtatggcctctggtgctgcttgcgcctcttctgtggacgcgtggttaacacgggcttaagcaaaccttggcccggcacgccttggcttcggacacttgtcaacaaagtggccatgctcgccacagttgtaataggaccctggctttgttccaatctccttcttggcttgggctaatggagctgactgtgctggtgccattggtgggcgcggagctgcactgcggttgggctgacctccctggtgggtctggctgccacttgccccctggtggaaactgcttgagtttaacatggcgatgctggcggacaatcatggtggtaggtccaccctgctgtacgggtgtgaagcgcggtcgctgatggcttccttggttggaccggaactgagctacctttctcttcctgtccattttgttacattgatcctcctgacggattgcgttgtctaccagcttctcgaagtctgcgtaatccctggagatcaactggatggtcagtttgtcatccaggcctgctaggaacttctcctgcttctctgcgtcagtgcgaacattctctggtgcataccgcgctaggcgattgaactcatgcaggtactcagtcactgtcctgttgccctagtggagtgctcggaattccctcttcttctatgccacaaccccgtctggcacctgagccttcctaaagctgcgatagaattctgcccaagtgacctccatacctggcggacgggtagccatgtggttgtcccaccaagctgacgcgggaccctggagctgatgtgtggcgaaggcgactttctcctgatcattgcactgcagaaggttgagcttcttctctatggcatggagctagtcatttgcctccatgaggttgttggtgctggagaaggtgggtggcctgacgcgtagaaactccggcaacttggatagagggggagggggaccaaactgctgctgctgctacttggtttgctgctacatcctctggtgcatctgctggtgctgctgctgcatctgctgcatcatggctgccatcatctgagtctgatgagccattacttgggccagagtcggattctcggggagcggtggcggaccattgacggagtcgctgttgggatgcccaccgtcggtgcgttcttcgccgttgctgccctcacctgctgcacggctgccattcctggtgttgaccatctgaaggaagagcagacggagggggtggaaaagaagaaaaacagatgctcaggaactaagctttattttataggaatttaaactgcaattgttctgatcagaattaaaacacttaaaacagcaagcaaaatacttattaggatagccatatcataggcacatgatatcgaccgtcgactgacccacaagcgaacaaacctaaacacacaaactaacagacaaaaactaaacagtcgataaactaagggaaaacgtgcctaatgctcggaacggctcctgcggtcggtggagtcaaaggcatcctcctgctcgtcaccaggtccctctgagcggctcctggagtctggcagatacgtctcgccggtgcccggctctgtgccactagaactgctgctgctgtggtcgcggctgccactgggagtagcaggcaaccaacctccgttgccactggctggacccctagcggctgacgctggagcaaaggagagagcagacgcaggagctgacactgggactggagctggggctggagctggagctgcgggcactgcaagaactgctggaggtactggaggagctgcgggaggaggtgggttcctaggcgcaagctgaatgcgcatgggtacagtcgtcaacttgaggggcgtggtgcggatccggactcctcctgg

SEQ ID NO: 32644 - DNA, 23058 bp, Oryza sativa
gcctcctgacaggcgtgatctgcggtgcctccagatgcctgaaccaccatattagcaaggcaggtgtccacatagccatgaacctccagacgaacacggtgaggaagctcgccactgagcggtggaacagttgagtactctggcgcgttggggtagcccaccaccaaggtcatgcaagccaattcagccacaaaatcatccatgccttctccacggtggttgggtgggtggtcggccatctagagaaggcaaaggggtaggatcaatgcatgctcaaatccaatttaaataaagcaataaaggacacaaataaaataagcgaataagagcggaattttatgcatagatcatttttgcatgagagcgaataagtgagacggacttacatagcgataaaataatgagaaattagatacatactaataataacaataacaataggaacataaataacttgcaacccacatctcttagttagcacctaatgcactcctcccatcaaatcccgactaactgttaaataaatctcaaataattttactaaaaccctagactgacctgatttgacaaatctcacttgaacaagcgaccaagatttttcccttgaaccacaggaacaaatccaattgcaaagaacgtgtgcaatgaaaaggattcagactcttaggttttccatttggcttgtactacaatcaaggtcggctctgataccaacttgtcacgcccagaaattcccgaataggattccaaacagaatgtgcgttaaaacccccgtctaggaccggccgaggtacacaaacgacaaagttgacaaacagatccacgtcttacaaacatcataaaatcttacataaatgcagcggaaaattaaaagataactggagctaagccttgacttggactgcagcgggaacaccactccacaggcatccttgacggcacggacgaagcctactcctcggagaagccaccatctaacgcatactcaaactctggggtttggggaaaatagagcaagactgagtactacccactgtactcaacaagtcataccggaataggggtatgatgcagggaattaacaagggatagctatagaggttcgtttgcatagagcgagcatttataaatagtagttgaaagcagtaaaacagttgtaataattaatcaatattaaccacccactgtccaacgctaccccacgttgcaacaggcccaaccatccacctagactattcaattccattagactagacttgggtgagaataatcacggtgaatctggttgaccgcccataaccgcgggcacggctattcgaatagttttactctgatcagaggtgtacaactgtactgtcacaccctaaaaatccaaaatatataaattgtcgtttaattggaattattagaatttattttaaaagtctagaagagaagatctaattttaattaataaattccaatataaaatgggaccagataaaatttcattaaatactttgcttaattctataattcctagatttttctgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgtccgaaaccctagcgccgccgtctccttccaaattcggccgcgtctttccgtttccggtgaaatcaatagaggggaaatgatcttcgggatctcgtctaccttttctcttctggaatccccggctaaaatcgtttggaaagtgttggtttcgaggtcgagtcggatcggtctctctctctccgagccctaactttccttctcgtcgccggtcgccgtgggccttcgccgccgcctccttgcccctataaaaggacccccggtgtctcctcgacccgccgccacccttgctttcgtctctcgccgtcggaagcgccctagcgccgtgcaaccttgagccgccgtcgtcgccgtcgctccagccgtgcgccaccgccgttccggtcatcgtcgtcgctcggggaggtcgccatcgtggtcgccaagtcgtcgccgtcctcgtccgcccctgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccgccgcctccgagcccctttaaaaggacccccgagctctcctctacccgccgccaccctcgcctttgcctctcgtcgtcggaaacgccctagcgccgtgtgccctagcaccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccgaagcaccgtcgccgtcgtcaagcggaagaccgccgccgttttaacctcgtcgccgtcgccgtctgttggtcttctgccgctcctttggtcaccggtgagttcgccgcgtcgcgctctacccgttggtgccctccgttcgtgccgaagcgtcgccgttcgccgacgagcatgcgcgcccgagccgccgagtcgccgttgccggtggtgacgtcaccgctgacgtcatcgtcgccctctcccgtgagctggtcgtggaccgatcgatctcggccgtccgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagaatttgaagaattccaaggccagcaaggcaagtcacacagatcccaaacaactctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcaactagatattagatataattgcttagctctgcttagaaacattagcacactattgggataacttatgaatcactataatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcagagcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtacctgggtggtattgaggcacatggtgacatgatgtggggttgtgtcttgtgggtacagtggtacacctctgatcagagtaaaactattcgaatagccgtgcccgcggttatgggcgggtctaacaatgtttttcgtgattagtctcacacctctcatcatgataacaaatgctttaaatggtaataatttgtttagctcctggtttggaatggtacattcctggtttggagataggactgtgcagccgggatggttgttcagaatggttgggcctatagaacagggtatgttgtatagcgttggattaatactgcttaattattaactgctttattaaattctgaaatgtttattaaatgctgtttatgcaaatgaaaccctactatgccatcctttgttatcctgtgcacctgcatatttgttgcgtggcttgctgagtatgtcatatactcaccttgcaatcattcatcagaggaggagttctacagtgaagctgatggtgtggaggattaggtgtagccctggtcaagttgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcagatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgacgtcatcggggccgtctgccgtgagccgccgtagacccgatcgatctcggccgtctgttttggatggatcgatctcggccgttcgtttccgtgaaccgtcgccgtgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatctactgttaaaaatatccacatgtactgttcatgcttgtttatgtgctgttttggtgattttgctcttttctgcttagattccgacgtttccggagagtccgttttcgcaggagaagaatttgaagaattctaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgactactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatctaggaatggtgcgttgcggtggattgtgttatgcaaggggtattgtcacagctcctttccgaggtaccgtggtggtattgaggcacatggtgacatgatgtggggctgtgtcttgtgggtacagtggtacgcctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcttatacaacagggtatattgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtgaagctgttggtgtggaggattaggtgtaaccctggtcaagctgcctgtggagtggagtcgtctgcgccgtttatcttatttttccgctgcttagatctttattgattgagaggaactatctacctctgtaatgacattttattcgcttattaattagagtaataatggtactctattatctttgttattgtgtgcctcggctgattcctggacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaggaaaacgatagagcatttgtaatataggatcaacatgttcaagtgacaagcatgacttgccttgctctgctgctggaggaacctcggcgactatttcaaagtacaccggagcggtgggagagccggaatctaagcgacatacaaagcaaacaatacaaacaggcaataagactactgaaacagagaacaaaaccatttttaatggattctatgcatttttcttgatttattgagacttgaatgggcttaaactgagctcggatgaattagatatgaattttagaagattcactgtgtttctactataacagaaacatgcttaattgatttattgcgcaataaataaatcccgggagagggaggggcggcgccgacatgcgggccccacaaggcagtgactcggggagggcggtccacggtggaccgggtccacggaccgagggggagcggcgcaccacgtggtgcacacgtggcgccgacgcggcgcacacacggcggccacgtggcagccacgcaggcggcggggttgcacggccccgatctaccgcccggtagatcggacagcggaggcggctcgcggccgggcgcgcacgggcacggctcaagccgacccggcggtcgtggcgcgcggcggcgcagcacgacgcgacggcgatgcaaggcggcgaccggcggcgaccggccggcggcggagggcggtggcgtcacagcgacacagacggcgacagcggcggctaagcggctaggcggcggcgcggcggctaagcggcgcgggagagagggaggaaggggaggaggggtctcaccgacggcgaccgacgacggcgagcgacggagggcgatggcgacggcgagacgggctgcggaaccacctaagggatcaaaagggatgagttagagagggagggggaaaccatggatggctagggcggcaaccgaaggcgccggccatggcgaagctcaccggcgcgcggcgcggacggggctccggcggcggattgctacggaggaggggtggacgggacggcccgcacgacggtgaacgcaacaacgtcgacggcacggctcggcacggtggctagcggcagctagcgccgccggagcggcggcggcgggcgccggagaggaggacgacggcgctagggcggtggagtgcactggagcaggtgattgcacaacgaaaaagagagaggagggaacgggggtgctttatttagacccacgagggtcgatcgtggtcggggagatcgcgatttcgccggcggagtggggagaggtggggaggagagagaggcgggattcaaaaattgaatcccggccgtctcgagcgcgggcgcgggcgggagagagggggaagtgggcgcggggacgcgggcacgagggtgacgtgggcgacgtggcccgggagacgcaggagcggggcgcggtgacggttgctgggcgcggcggcgccagctggaggagggagacgggcccgacaggagggccccacctgtcggcgacccggggagagaggagggggctcgggcggctggctaggccgtggcctgcggccggcccaacggggagggggagggggagagaatgggccagcggcccattcgaaaagaaaaaggagggaaaaagaaaagaaaaagaaagaattgaatttctagggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaattttggcttgggaaagaacttcagggtgtgacaccgagttccttacgacaatccgtcttgaccatccaaccggggctaaatatggaggagtaccctccccaggaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaagtagtataaagaagaatattctaaataaagtacaagtcttacaaaagaaggaaaagctactagagccatacccgaattcttccgaagactccgacgactgaaaactctattctatttctattccactataccctagagactatactaagcatgaggatgtatgaaacttcttgcttgaggtgtgtggaagaagtgatgagaagagttccctaaatagactgccaatgacggttgtggagttggaatggttggaattgccctccaaccatcattgggaagtgatccacactgtccagggagggttcgactgaaccatgggccggctcaatccagcctatcatcggctggtgacctcctctcttgatatattttgcaggcttgtgaattttggcccaattgtccattcattgataagtttgattctcgacatcgtccaattgatcgatcacctgttttgatgtcgtttctccttcattttatgtacattctctgcaaaaggttagaatcctagtgctagtggaatatttattatttaaacataaatatgcatttcaagcataactagttcttttttatttaggtaatattgacaggcaaaactggtcgctaatgaccgtcaacagcaagcgtagcctaggagggagggaggcgcggtgtattgcaaggctaggagggagggcgctaccaggccacaacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtctccactccccagtacctttagctctaagccctaggaaaactgaggtgtttttttgttcttgtgttatttctttaatttttttctaagaaatttacgttcgcagcatgcggtgacgggaggagaggcggcagcggcgggcggccctctgctagatccggtgggaggggaggcagtggcagcggcggcggcccacgggcgacgtcggcgggctcacgtcttccagatccagcaacctctccgaccgcctctcctcctatcgcctacctcctccttcatccggtgagcagcggtggtcaacgctctgctgctttcaccctgccgattctctgatttggattggtttttaagatatctgatttaatgatgtgaagcactccatgaatttttgatcgtgtgatccaagaattgttgattgtgtgatggctgctgatatgcagttgtctttttggtagatttttggatgtttatatcggctcggctcaaatcgtatacgtcaattgctggcacctttgagtgttcttactagtgccgtcttcgtggtgccagttgggaaaaccgacatctttgtggtattcctaacaagcaccagtaaccctatctgggatagtgtattatgccaatttttgtttcgttggctcacaaaagtttattagatgttccatatcggctagaagtttaaataaaatacgtcagagaatctaccacgtctaataaactgaacccttattagagcggggcagctcaaattttaacattgacggtagaaacagtcagtaaaatgtagttcaatttttaagatgggactttacttttcagtgagattcgaataaacctgacggtgttaataacgtcaggaaaattcactgtgacggtcaaacctgtcagcactatttttcctgaagaatacacgtcaggcaaattaaaaatttcccaacaagccagttcggacagaattttcctgacagtttcacgtcaggagggttttggttgtcagggctagttgagtttttggcagtgttatacgcgtgattgcggaacatgaaagttcacacgtacaactcacagctatgcatttttgcatgtactatacctccaagtagattcatagtattggatatacctccaagtaaattcatagtactggatatacctccaaatagattcatagtactggatatagtactggatagtctatttttatccatgttttaccattagacttatttaaaatgttttgtaaatataaaataaataataactacataaacttttaataacatcgttgattttttatccatattttgccattagtcttatttaaaatattttgtaaatataaaataaataatataaatttctaataagacgaatgatcagttttataatacaatggtgtcatgcatcatgcattacaaaatgaatagagttagacggtgatcaaacataaaaaaaatcaatgatatcatgcattagaaaacgaacgtcatgcattagaaaacgaatgggcggaaaaaaaagaacagaaaagagaggattgagcactccatcataaaagaacaacctaaagagcatgtgcaaatttacccctggttttttctaatttagctaaacataccactcgaatgacagtttggttgtaattttctagtggcagtactgtaataacgatcgtagaaaattataatcaagattcaaagcagtagaaaatttataattacccaaaaagagggggaatctgtaaataccaaaaagagagggaatttgtaattaacaaaaagagggggaatctgtaattaccaaaaatttataattaccaaaaagagggggaatttgtaattaaaaaaaagagagtacgccttccgttccataaaaaacacaccataaaaaacacattataatactacgaatatgaacatacttataaaaagacacattgtaatactacgaatataaatataacacattataatactatgaatataaaaatacttcctagacttagcattgcccattgcccatattcatttagatattaatgaatcattagatattaataaatctagacatatacatgtaatactacgaatataaacatacttcctagacttagcattacccattgcccatatttatttagatattaataaatcattagatattaatgaatctagacatatacattagacatatacatgagtttagatatatgatgtttagattcattaacatctatatagactttttagcattgccatattaatgaatcatgtacatacatgtgtttaaattcattaacatctttttagcattgccatattaatgaatcatgtacatacatgtgtttaaattcattaacatctatatgtacgtggacacaatgctaaaaagtcttacattgtaaaacaatgtaaaacggagggagacggagggaataccttaaaaaaaatacattggaatactacgaatataaacatacctctattattcactcctatgttttttttaacctctattattcactcctatgtattattcactcctatgtagtatcatattcactcctatgtttttttttaagtcctattcactcctatggtttttttttaagtcccatgttgtttttaaggacggaagacgtaacattcagtcctacttcaaggacggaggagatactggataacaacattactagcaacattatggaaacattttaaaaggcaggcaggtacaaacttcataaatacaaggaaacattttaaaagacaggcaagtacaaacttcagaaatacaagaagctatgaccgatattaatattagcaacacattgaagcatgcaaccactcgtttttattcatccatacatcggagtattggttattctgaacagtgtacggccactccaaagctggagctaaactgaacctcaaaaagggctcagtgatggccaccaccggggagcttctccttgatcttctccatcatacccttcttctcgtgcgtcggctgcgtcgtcggtgtatacgccgtcccgccggcgtcggtggttgtaccagcggcggcggtgtgtcccgtgccggcaccatatccgccggtcgccgcagtggccgtcggctgctgctggccgcccttgttgccgccggggagcttctccttgatcttctccttgattcccttcttcctcctccctcccatcccgtcgtcctcagacgactgcacgtcatatataatacattgatgacacaggaagatacgtagacataatctagttacggttaatttacagtgtgttgagaaacgttaccgagcttgagcttgaactgccggagcggcggaggatgccaccggtcttgtgctcctctctcgccggctggaactggccgcctgcgtgcggatacgcgccggtgccggcggtggcgccgtgtggcgcccctgtgccggtggttccgtatgccatggtgtcgggtgttgtggtggctccgtgtccagccatgtgcctggtgcccaagccaccggcgccgtggtgggctccggtggttccgtacccggctgtgtgcccggttcctagtccaccagctccgtgctgagctccggtgacgccggttgttccgtacccggcggtctgccccgcgggtaaaccggcgccggcgccgtggtggactccggtgccggtggtaccatgcccggcagtgtgcccaggcattaaaccaccggcgtcatggacgccagtgccggtagcgccgtacgccggctgaccggaaccaccatagcccgcggcgtcgtgggtgccggtgccggtggcgccgtatccggcctgccggccataacccccggcgtcggtggcgccgccgaacgcatgctgaggctgcgcaacgttgccggcggcgccgtaccctccggcgcctgcctcttgcgtcccggtgatgccgtggccggccgccaccgggttgccgtactcgtcgacgcgcgccgccgggtggccgtgctgctgtccctggaagtgcgccatcttctcagcgtacgacgtcgctcgagcccgactcgatcactgcgtgttgtgtgtgctcgcctgctcgagaggcgatgagttgatcaactgtttcagttggaaatgatcggtgtggtgggtgaagcgaggaggagaacgaggcaaagcgttggacttataggcgaggcgcgcgcggcgcgagcgcgacacgtcgagggggcacgtgtgagcggggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctcttcctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgttactatgttttacctgtcttattgtgatctatgtagtgaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagcaataggccccgttcactgtttccttgcggtgaattcacctattaggaggggatggttagaattaattctccatggggacataaatgagaggaggcatgtccccgttggtttcacggggggcggggattgttcttcattccacgtccccgctccccgcgaagacccgcgtaggggccgggtccaactttaatgtattttagttatcctgtgtgattatattgtttgtagtctttgataaatgataactttatgtttttatcatgtgaattagtagaaaatattagtagatgtatgctaatatattcatataaagtacgaatatatgttgtattgcatatataatttgacatgtgtatatttttttaagcaagggtgaaatcaccgcggggatttattccccgtgcggggatggggatggtaacaaagcttcccccgctgtgtttcgcggtgacggggatgtctcgcgggggcagggatggggatgcattccccgaggtgaattctccgttgccatctcttgcactactaaacatgcatgcgttttcaaattttcttttttgtttaattgctcggtttatggcacgatttcttcactgtacttatcagattttgttggtgtaaaccctaccttctttaaatattatgaatttaatttccactttgttgtacgtatgtcaaacatattcgagaggtgattgtagttgttttcttaggcgttcggttttctccgagattcaagctaggaatttcccacgtctctgggttgtcggtatgtggggtcaaaatagagttattgcttttgtcttatagttaaaaattttagcagtaaatctactttgtgttttctctactatattccattgaatttgatttgttctatagtaggtatgaaatcggttcagatagtttccatgtctattatatattttttggcatgtctattatattaattaattattaattttattgttatatagataacattgaaattgagattattatgtggatacaacacatatttataattctgtgtttttcttaaaaaaataaaaacctaaagagtctaattttcaatggtatattatatttaacacaatttagtatattcttaattttgtaagcacggtacaaggggttttcctgttcccatagatattcatgaccatatttgttccaatacatatttactcagtatctgtattcgataatattttgcttcatttccttttacgattctgattaaaaaaatgaaaataaaatgatagaggtagtttctgttaagaaaccagtctactctactgatcagcacatgagcagataaacacaaacttatgttccccaaagttctacatgtgctatacatgtcagacacttataagagacatataggagattacttcttcaataaggttgtcctcatcatcgtccatatggacatcttcaccatccttagtgttgacaaacatgtcatcatagttttcaatgtgagcttcaggctcagtggtgaagtatgactcatattggctcattttctcattagagctcaaccagatgcttgggaacatggcagttacgagaccaatgctcaatgcctccacatctatagcaattatcatgttttccccagatgttccacatgtaactttcttgcattcggcttttgcctttgggcttacccttcccttgccccttgaacatgatacttcccttacccttctatctcttctccctgtggccccatttatggtcacgtgagtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccatagaaattaatttaagtaatccttaggattacagattgcgtgattaaatattatgaatcatgctaggaaattaattatataacattaaaataaaatgttacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgcttcaggaacctttcatcatctctagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaaatattatttgcatattaagaacaagatgatcattaggcattggtttctcagctgtttacctgtttagcttggtggagactcgtgctggtaacattttaagaagccattctattctactgatcagcacaatagcagacaagcacagagttgtggaacacagaaaatatggatgaatgaaagctttatttcatcggattgcgtacaagttacatgaggagattaagtatgaaaatataattcaaaatgatgttttagagaagattgagtatgaagatataattcaaaattttatttcaaagaatatcaaaaggattatgtttttcagtagaacatgaggtcaggtcaaactattttagcattaatgttttatatgttcctaagaagaaacatatctaaaaattttatgcttttgttatgctccgttttcatatttttggggcccattttacgttttgcacatgggccccaaaatcatagatacggccctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaa

SEQ ID NO: 32645 - DNA, 4410 bp, Oryza sativa
tttgctataaagaaacataataaattaatgaagtatattgttggaatgtaaaaatttattggatgagactattatatttatgagaatgtgatgcaccatattatttgtgacaaatttacttttacatatgatataaaaagttaatacttatttattagttattaaaagttcttttatgtagcatatgtgttttcatagtaatacaacatatttatttattactatcagaacacatatgctaaaaaaacttttaataactaataaataagtattatttttttatatcatatctaaaagtatatttgtcgcaaataataaggtgcataactatctcataaacataatagtctcatataacaaatttctatgcttcaacaatatactctattaatttatatgcttctttataccaaagggcaaaatggacttttttataagaatttaacggtcaactaacggtcagctagctgaaagggtatggaagggatccaaactaaaattcagagatatgtaagggattgagcaaaattcaggggtatagaagggattaggtgaactttcacattatgcccgttatgcccattttctaggttctgcattttcaagttctggaggagcagaacgtatccatgctggtattcaattacacaagcagaacttgatatggggaccagaacgaaaatgttctgctcttgtttctgctggagccttttgctctaatagtagattgaatcgtttttgaaggaacagaaactattccgtcacatattcataattataggaacagggagattagcttctgttgcatgcgtatacatatttctgttatgcagattagctgctgccatattattagcctgttttttcgtttgccggctagtatatatcttctgtcggccaggagcagaaaatcaattccaaaaagagcagaacatcagttagttagttaggagcagaaaatcaatttgaaaagagcagaacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagagcagaaggtattctgctttcttcttgccaaagcttcctataagtaaacggactttgttttttggagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgagcagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccgtcaaaaacggatacggagaaaaaataggtggctgttctgctaatttttttatgttgatgttctgtcattctttttaattcatggtctgccattttttctgttggccggctaatatatatgttccaccggcacgagcagaagataatatgtcaggacgagcgggtgggaggaagaaactgcatccgagaagttggtttgcatgcagccgatgatttagcaactatctgaactaacaaactatttaattaaacaacacgggtattcatcgttattggatcctcgtcactccactaactgaatccgatccataataggagggagtaactaccctcggtagtaggaaataggtgtcctatctatctatctatctataatataatagatagatatagatagatagatatctataatagatagatagatagagagagagagagagatttgagctcggcattgacaattttaatgtggagaacatccaggacgagaatagtcacgtgcaaggcattgtcaacaaattagatgaaagtctgaaaccatgttactttgttgaaatgttaccgacaagagatacttgattaatcgattttcttttggccaagttccgagagaatatggttgtgcagcatatgaaatttggttcgccatatgtacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtggttcacttgatttttttttatttcaatactagagtgccaatcttctttatgtggtctgaatgtgccatgaagaaaagtatgtcatgcatatctcattgaaaaaagataatgtggttcacttgaattttgatttcaatacaagagtgccccgagatccattatggcgagttgtagattcatgcatatctgtatagtatccttgaaaaaaaaaagtcactccgcagatgtgtgcagtttgtacattcaagcatgccattcagaaaatcattaaaaatgttcttctccaaaatgacattctggaaaatgatatcagttaaaaccaatgtaccagttaatttatattacaaaaacaatggatctccattcaccataatgagatttttacaaaatggtatgtctgttacatctccatactgacattataccaaaaaaatgcacatgaactaagattttttacacaatccaacttttctttctccaaatataacaaggtcagaaattagcatcactaatcactgatccggaatcaagaatcccagctcacttgctctgccatcttaatcagtcgctccagattcctgctcacgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctgttccttctacttcctcaccggcttcgtccgaccgtgggggatcgggagcagaagggcatttgagaactggagaggggtagagagatgattgaggaacaggggcgtccacactccacaatttccccatggagatgaaggggtcagtggatgaagggcattttgggaaggacacggtacaaagtgcaccatccatcagcaattccgcagcgcctaaagggaggaaagcaggcatggtacatcctattatcatcagtcccaagattcgtgcaggggaatggagggtgtagattgcgagtgcatgtgcactcgggtgcaaataatccaattcctatatatatatatatatatatatatatatatatatatatatatatagacataataatccaattgtgagtaataactaaaacactccccctcacaccctacccccacctagggatgaaaacggagcggatagtttccatccgctccggataaaaacggatacggatacctttcggatcggataattctcggatatttcatatacggatacgaatacgaatattttctcccggatacgaatacgaatatggtatcagggtttccgtcggatacggataataattcggatatccggtgaacagtgttattcggatatccgcaggacccatgagacataccccatttctttctaactctataaccttcaatatacctttatagattttaatagtagtttatctcttaacattagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcaagataatccgtatttgtttccatattcgagctatccgtattcgttttcgtatccgataaaaaatatgaaaacgaatatggtatgagcattatccgtccgtatccgctcctttttcatccctacccccacccccacccccacccccctcctaccctgtgtccccagcagccacctaccccgcaacccaacctttccctgtagcaaacaattagtaacttttttactgtcaactttacctgatatatatattac

SEQ ID NO: 32646 - DNA, 10209 bp, Oryza sativa
aggccatccccagcccggatccggcggcaacacccgtccctcgcggcagcgtcgggtgacggcaacggcatgcgtcagcggtggcggctcgggagcaaaaccctagctcctgccgtggccgccctccttccctcctctcctccacattcccgtcgtcgaagcgcgtctccaggagagccaggcggcgagtcgggatgtcggtggcggggccgtcttctctgccttcccgcgccggtggacgaggaacaggaggggatggggccggcacgtcatccggcagcggcgccgcggtgatccggtcgctgctccccgcccgctgttgctgctgctgctgctttcctgtcttcttgctctggtttttcccctctcatggcggttgctctgtctagagactactcctcctttggaatccttttcagttttggttggattaattggagttcgctttgctgcgcgattgcaattgttcttgattgatttgcttggctcagaatagtccaaggctctgtccttgtttctcttcgcatactgattcctggttaagaatggtcttcgctttgtgcactcgttcttctgtctccacgaagaaaattggctttctcaaaaacctgcaaaactggaaacaataaaaacgaaacgaattgcatatgattattatgttgctcgcaaacggaatagattgaatcagcacgattgatggatacagtacatagtccttgcttgtctctgactttgctctctactgataggtacagatgagcctgggaagcaagtcgatctggagtgctgtcaagatcaagaacatcagcaagtctaaatgtagcatttaaggtaattaacagagctcctctctgatggcttcttcatcaaattaaatgctaataccagtggttttgcaaatgatggtagttaccagtaactcagtaagtagtagccagcagtccagctcctgttaatttcaaagatgctgctcggattaatgataacatcaatcctctcaataactcaggttgaaggtgaactgtattttaggatgaaatcaatcctctcaataactcatattaaaggtgaactatattttaggattatctgtcaatttagagatgttcatattttaacagatgactatgtattgatctccaccataaaaatctgttggttcagtccccacctacactaatttgatggctactaataaagcactaatttgatgcatgccttttgttctggttccaaataacagcaccaaagagttgcttcataaaacctccaggtggcatacttgttctagcagtacaaacaatttcagcttttcctagtttagagatttgattctggcatgactggtatggggaatatgattagtgcttggcttttgggctatcggctcataagtcttcggacaacatttaattgataagccaatagtttctgaaattttctatttgatgtgctagtagattcttagattttctagttgatattttattaggctattagcttctgaaatttcctagcttggaagagtattacttgataggcaatacagttctctgaattttttttgttcacacagacatgtgcagaagtgataattttttaatccgtccagtggctgctctcaactcacctgttgatttgcagtggttattgctgaatgaaagatgggagaattttcgttcagagaaattatattcagagttctgagtgtcatgttctctcagtttgcaagtacatgcccttctcataaatttttagtttggtcggctggacaatttgatacttacagttgtgtcaaaagctctgaaatgttatgaaaattatggggtttatagacaaatcatgctctaaatgtcaattagaaatatgtcatttgcaaatttgtgtgtgcagtattctgagaaatctgctctcatctgaattatcatcatcatgttctctcatatgttggcgggttccagggtgaaggttggatcctcggtggagcatgccgatgctaccgactccaccatggatgtagctggcagtgggattttgacgtcgaccgtgagtcttcggcaccggcgatggtatttggcgagttgggatgtactcgcttcatctcaatatgtagcaacctcttccagatttgtagttctagtattggtttaatctcatcctagattgtaacatattgcgacggagggagtagtcattggttacaatcttcttgattttttttatcaaaatgaatatgtgtatgtctatttcccatctgtaatttttattggtaaggaaccagccaacaccgtaatattgtattcatgttgtgtaggatatataatttgaaaaaaaaactcttctcatatattgtcatcaagtaaaacatttactatgcgttaataagcgttcatgataaaaatactaatagattgatacatagcattaaaaataaaaatcacttggcagtaaaaatactactaccacaaataaggcatcgagctactgaaaataactaaaaaatcattactaataataaggaacttatctactaatatcattactaataataaggaactaatctactaataataagaaattaatctagtgatatattcgtgagtaactgatttactgaaaagatctaacatgactaaaagccaataatttatttaccaaatgaagattggttgggtgaagtaatctgttagtaatttttttaccgatgcttccgcgagggaagaaaaatagcagatgtgaatgagaaaaaaaaaaggaaaaaaggagggagcggagggagtacggacggttggaaaaaaaaagaaaaacgtggcctggagtgggtcagccgggggggggggggggttagggtatctgaggggagcgtttagttattacgcaccctgggtgtagtttagctctattatatatatagtagctctattatatacccttcccttagaataactattctacaccacctccccaaccaactcccacccgatcccgccctcccccctctctcgtcgcgatcccgcccttccccccagtctcgtcgcgcccctccctcctccctctccctctctcttttttcgatctctctcccactcctggcgccctggtattttctccctctccctcatctcgatctctctccctctcctggttttttctccctctccctcatctcgatctttctccctctcccggcgccctggttttttctccctctccctctctcggcgccctggttttttttctctcgcccgttggcctctccccctctaatttttttttcatctcaccttggaaagaaaatttaaaattaaaatgacaaaatcaagactttaacccatgaccttatgattcaaagaaattctctattaaccaattaaccatatgagatcttgtgattagagtttattgcatcaattttatgtctctattcaagctttatgagagcaaatcacatatattgttgtgaaacttataatctgttattatgttccagtagtaatattattgtaaaagtgcaataacacgtcacgttactgcaaaagtatataggttgttactgtagttctgacaacatcatgtgaactagctgggtggcccgcgcaattgcgcggctagcgcccaaacaaaatcatatatttttagtatgattttacttaaaatttattaaatacctatctcgttgtcttaagactttgaatgactaaaccttatcatccccgtatttctagttatatagtttttaaaagtcacaccaatttctaccccttacttctgccatctccttctttatttgctggctagatctaccactttctattcattcttcttggaacctttaaaaattggatcttatagtttttagagtttttagagtctattgtcttgttaggtttctttttataatttctagaagtcacatcaaacgctgccattatactactctacggttcgtccaatgtcttttctctttattgtcattgggattttaaaaatcgaatgtaataatcgttcgggtttattttttactttttagaagtcccgccaaaccgttagtggctttgccattgaaatcctctatggcttatctgctgcctcccttctttattgtcattgagattttaaaatcgaacatgattatcattggtttttttttactttttagaagttccgaacctttaaaaattggaccttctagtttttagagtttattgtcttgttgggtttcaattttcataatttttagaagtcccgttaaacgatgccactatactcctctacggcccacccgccgcctactctttattatcattgggattcttcgaacataactactgttggaattcattttttattttctagaagtcccaccaaccatcggtggctctgcgactatactcctatacacccagcccgctgcttctcctttttattatcattgagattctaaaaatcgaatatgattattaatgtggtttattttttttactttctagaagtcctagcaaccgccttgtccgtttgcttcacgacatacctgttgtccctccttttaatcgtcgttaagattctatttggtgttttattaacagttatatgtcgtatcaaccgccaccactctactcctttataggcatgttacttaatttatcttgtcatgtgttttaggtggtcttttctttcaatagtccttattttctatcaccaattagttatcaataaattgtattccttatggaaatttttttttctttttctaatttcagaatttattttttttttcaaattttaaccaatactgtatattgttcttttaatatttttatttttcaattccagttgtttcaaaattgtattcctactcaaccctcttttactttttttatattattttattttttattcagaattttaattaatcttgtatcgggttcttatatggattcttctttcaatattgcttatttttaatttcgaatttctgttaattttaaattgtattcctacttgaactcttattttctttttgctaattttagattttatttttatttttcttctgaatattaactaatatcgtattgggttcttgtattgactcttctctcaatatttcttatttttaattccgaatttcagctatttttgattttgtatttctacttggactctacttttctttttctctgattaatgtgggagtttctctgattaaaaattgaacataactatcattggaatttattttttattttctagaagtcccgccaaccatcagtggctctgcaactatactcctatacactcaacccgctgcttctcctttttattgtcattgagattttaaaaatcgaatatgattatcaatgttgtttattttttttactttctagacgtcctggtaaccgtctagtccatttgcttcacgacctacctgttgtccctccttttaatcgtcattagaattctatttggtattttattaacagttatatgtcgtatcaaccgccaccactctactcctttataggcatattacttaatttatcttgtcatatgttttaggtggtcttttctttcaatagtctttattttctgtcaccaattagttatcaataaattgtattcctaatagaaatctttttttctttttctaatttcaaaatttatttttttaaaaaaatttaactaataccgtatagtgttcttttaatatttttatttttcaattccagttgtttcaaaattgtattcctactcaactctcttttactttttttttaatttttgatattattttattttttattctgaattttaattaatgtcgtatcgggttcttatatggatccttctttcaatattgcttatttttaattacgaatttctgttaattttaaattgtattcctacttaaactcttattttctttttgctaattttagattttatttttatttttcttccgaatattaactaaaatcgtattgggttcttatattgactcttctctcaatattagttatttttaattctgaatttttatttgtcttccgaatattaactaaaatcgtattgagttcttatattaactcttctctcaatatttcttatttttaattccgaatttcagctatttttgaattgtatttctacttggactctccttttctttttctctgattaatgtgggaatttctagcccccacagtgaacgtggtgccttctttcaaagctgttttaataatataatagatattgtagtaacacggaacatgtatgtagtagtaacgatacttctacagactacgaatgttgttactacgagcaagtaatcatatgttagtacagtatggttgtcttgttactgtgcaattcctgcgagatgaggatacgaaagaggtgggcgtggagggaagtgagcaacacaaaagatacataatagcaaactaaacacaagtggattatttgaaattctaatctttaaacaatcgtatctctcgcatcatatataatatttttgaaccgtttccaccataatgctttaaaaaaaaagctttacaaaactagatccgtcatcactatattttgacaacgttataatattgttactgcaagaaagtaaccctgttactgcacgatggtcgtcttgttactgctcctgcgagacgatgacaacaaagaggtggacgtgggggaaagtgagtgggcgggtttgaccgaggtctgaccggcgggaggatgctttgaccgacctttgaccggggtgggaggggggtttcgggctctatggagggtgggggaggtgggtttgacccatgggaggggggtgtagaataattattctaggggaggggtgtagaatagattatatatatatatatatatatatatatatatatatatatatatatatagagagagagagagagagagagagagagagagacgtttatcctggataatcctgcggtcctgccaatcgcgctcaactttctttttcccagactcaatagttgagccttttttgcatgataaaagaatcatttctgagatagattgcttggttttgtttttcgacccatcatggttttatgaattggaaccatagttggttgattagcagcacatccctgaacataacaaccatgaaaatagcagaacacacgctccaatatatttttagaaagtgcatatctcggctggaacaacgcacatcagctattcccaatttttcttttatatgctattcccaatcttctggatacatgattattacctgctcgatctcagtataagcagcagtgtctaatcactgagacatacaaagtgcagcagttagcctttgtgtcctctgctcaccttttccttgtagttgcactttggaaggcattgctcaagggttggatagcacagctggtcctttgaacagcaatagaacccaccggcggtcacggcgcaaacattaagtttaactccaatgctggctgccttttttactcccatcaacatattgcttccgatcttgcttgcagtttgacctagagatgcaaggagtcattatgtttatcttgccagtgcaaacaaaatgatgaaacggcatatgaatcacggaaaaatgcaatctaattttctaattacctcttgcttgtgtaggaatagaagagcacaccacaagaaccaagaaaaagaacaggaccccttgattggtgtgcttcacacattttgccattgtgaaagatatgtttactagtatgttctatatctgtcttgttgtgactaatgagtgtgaaaaagtatagcagttatatatcgaagaagactagcgtgtcaaaataggtgtatgtcttatccttgaatccctaagtaatctgctattaaagccacttctaaatatgggttttgaaaatggttatgattaattgcctgttttatgacaagaaaattatagctctagcatcaaacaagggaaattatcctaaagtctaattttaatagcggctaaatatgtctgtgtcttatcctaacttgtattatcgactaatgccattcattaacaatgattttcaaatgggcatatccatacttttctgattaatgatcataaattaatttttattttggtattaaatctgctaaattgtcctaaagtctaattttaatttcacttccaaacatgtactgtcaagctgcttctatccattgcactatacaatggtcttctaaatcgttcgtctattcatacttatattgattgggtactttctaccgatttttttacaaattgacccttttagaaaacttatttcaagaataaactatgccaaaaacttattgcaaaaatagaccgtcagctcagcgccatagagattgacgctgaggtataacggtttagcgtcatagatattggcgctgacatttcatccgacgtggcaaaaatttgacaggtcagaaggggtcagcgccaatgtacttggcgctgagttattggcaataaaaaaaatctacagaacactctgctgcatgtacactgctggtggggtggttagatgctactgctcttacttttttcaatgttttttttctttcatcttttttcaccaaatcctactcggtactaactcttgttttcttttgaaactacacattttccctggaactatatattttaagtattaaatgctatatactacatgctctcgtatttttattatggttttttcactcctaagtatggaaatatgtactatataatttatgttgacatttacctcctgatgtttattttaaaattatcatgtcttatgtttacgtaatgttcttgttctaaacatgaaacataggaaatgttaaatgccgtatactttcaaaattttatgaagatctttccctttgatgaatataagtattaatgctatacaatatatgttttcaaatttcgttgttcctaatttgtaagactaatataatattttatgaattagaaactaataatatagtatacgtattattgtaatcaaagattaactacaaattagatatttgtatttcgttttttgttaaaatataataatttgaaaaatatataagttaataatacttaaatattctgtaatatataagattggtagtaaacaaattatcaaacattacacaacctggaactcgaactgtggaccatgaactgtggaccatgaggtgagatggtaggcttctagccgccacacgaagcgagcacatttgactagtttgatccagcaaactactttagatagccaatatctcagcgccaagcaagccagctctgaccccttctgaccttggcaaatttttatcacctaggatgaaacgtcagcgcaatatatatggtgctaaagagttatatttcagcgtcaatctctatggcgctgagtcgacggcctatttttataataagtttttggcatggtctattattaaaataagttttctaaaagggtcaatttgtcaaaatttcggtacttttttggagctctcatgttatctagaaagatctaaccattgattagaatgtttgtatataaaattgagctcatctttactgactaacatttgctaacaaaactaatctttttgactgaaatttgattacagaactagcctatgttgactcaaatgtactgacagaactaattattctgggtgctgataaaactatacagatatgttggtgcctaaaattgttagaggcacacaaaactaagcattgattagttgacatttgcacatattttcagtgaatcaaaatgacctaaatagaactctgaaataattatagtgaaaaccctcctgaatttcttcaggccaagaacaaaaatagtgaattgtggataaatgatagaaattaaattgttgttgataaaacctaaaatcataaagtagtcatcaagggcatccccttgctctaattccacaaaatccatgtattgttaatgcatatatcaaggatcgatattcaagcaggtcttgttaataaaataatctcaagaatatcgaacagaacaaatatgcccccattgccagtacttgaaaatgctctaaccctcccccaaccctgttgccagtactgttacttctacacatacaaatcagcatagcacaaaaaagataatagaatcactaacctaataaaagatcaaatacatcctccccaacaggggcggatccaacgtgggt

SEQ ID NO: 32647 - DNA, 6087 bp, Oryza sativa
cccacaagacccatagatacccccggagcaccccctttaatttttgtagtatgaatgataaactaaaagtccctagatggctgaaggttgaagaaactgtataattgagcccctctaaattttttttcctggatccgcccctgctccccaaatgtatatagcgtcacaaactgcattatacatcctcccctaatgacataaaactttagatccaacttaatcaaccaaagtgaacgcacaacatgagacagatgacaaggatctaggagtactagcttagaaaatggaaataaactgttgcccacaatctgagccgtaaacatcacattgcctgatttttaggagctgaagccacagctgcaacggcaacctcaggattcatctccccatcacctgacgattgctgcatcgccgggataccttgtcgagtcagcggagtacagagtggcgttgctgcacgagagaagaatcctctggagaagactaacgaggccgtcgtcgagaagaaatcgccggagttggcagttgcctcctcccatcgtcgccacgacagcatcacccaccaccaccagtggaagatggaaaaaaaaaaaagtaaaaacctgacccccaccgtcgaacaagggtggaaaaaaacagatccaacccgaaaatagctttcgggcccgatgaaagaagcgctaatcttgaagagattggacggctggaaattcgagtgcgagttagagaaaaaacacgccggtgatgtatagcaaataccaataattaatatgtattacctagaaactcaaaacagtaagaagaatttaggccgtgtttagtttcccctgttcccaacttttcattacatcatatcacataaaaactttcctacacacgtaaacttttaactttttttccaattaaactctcaactttctttaaacttttaacttttttcaggaacttagcacaccgttatatacaaattcatgatagtaagaaattttatgtagctatctgcattatagtttgtcaggtcaaggactacgaccaagtagttcaccggataaattagtagcaaaatgtaatggtcgctatattagagccgatagcgtaagttgtaaatgatgtagtagtaaacgctttttattcactgtgaatggtacatcaaacttacacacagttgtacagggctattatgacttccttattttttattttttagggagcactcctcttctaaatctaaagtactacctccatttcaggttataagatttttgattttagttaaagtcaaactgtttcaagtttgactaagtttatagacaaatatagtaatatttataatactaaattagtttcatcaaatcaataattcaatatattttcttaataaatttgtcttaggttgaaaatgttattatttttttctacaaacttagttaaacttaaaccagtttgactttgacgtctcataacctaaaacataaaacggaaagagttgtcgctacttcaaacttcttgtgatcgtgcaatttctcgatatacgcctccttctccgtaggttccttgtccttgagctcctcacaatcttcatgcatcttcacagtatgttgccgatggtaaacctttgttgggtccacatagccaactggttttctcaacctttcagcgtcgtggaagtgtgacttacagacaacagctagcttgtgttctagttacttttgctttattgtataaaaatataataaatactttattgattgattaagatgtatctttttagttgtcttttcataaatatatttatatgtatacagtagatattaaaaatatgtacactacaaatgtaataatattattttaacttattataatgtcagaaggagaggagtattttttggaacattaccaagacttaggttcatttagttttttcatcgtatatccagtttaattattattaagttatatacggtgataaaatctattcattattttttctcataattttataattttttgaatcggacacaaaggtcggaaaatataaccaaaagttacatatatttttaaaagttgaattatagtgaatgtggacccttaaatgtaaaattatataaagaatgcggtgcgtatgtagacatggaggtcttttgattaaaataacattatttatataatttagatgtcatagctgcttaacttttttgcacaaaatttgatttctaactaatatattttgggaacattacttctgtgttctttgctaaacggtatgtttttttaaaaaaaaaaatctatacgaaagttcctttaaaaatcatattaatccattttttaagaaaatagctaatattaaattaatcatgcgctaatgagttgttttgttttgtgtgctcaagagattaggtcctgaacatacgctcaatgaggaagcccggttttcatggaagtggcggagaggcgattgctaaggtttcggctaaaacctaattggatctacgtgattcgatcatgatctctcctgtttctctatgggagtctcatcaagatctaatctttagtctctctttcaccgctacgtttagtcgggagcagatttctgtctgttttgactcggctttgaccctgtaggacttggtccgtctgctatttttctagggtttgtgcttccgtcgaaaccctagtatggctttgatctgcttcgtttgcctcgcctgttgttttctcttcctaggagttctggtggtctttggtgggggcgatcaaggggatttcggtaaattatgatatgtatgcatgaagagattgctcttgctggagttggttggagttggtgagaggtgatgttttcttttgaaccgaatgaccaccggctaacacgtgctggcattggaattttttgcgcttgtctaaccagttggggaattgaattttcagatgatatcactgaattgcttgctgcatcaatagatcaatttatgctagtccgcctgcacagaacattgagcggatttagacacaggagcctcagaatcgaaggcaaccaatcaatgctacaggattgttgaagagagcataatagtccatcataaaatcacatgataatgaataatgacttaagatcgttagtttaacgactctgcctattgcaatttgccataatagattaatccttaatctgattaatgaatcaatcgtaccagcatatgtcgacattggcgagtggcctggaatacaatgaactcatcgggagtgaaagggaggttatcgagaacacgaatctggctcgtagttagtgacgatggcgcccgcctggaccagcctctcgtcgtgcttcagcacagcacagagtagggttttttttcattatgtctacgctgttatgattcggtaccacacagtgacacagggtttttctttctttttttctagtacacaggcttttaattacatgtttcaatgggcttttagttgcacgtttattaatgggtttttaattgcacgctaattgtacggttaagatagaatgatcaatctaatcaatagtcagatctttttgattaacatgaaagctcgtagaaagtgcctaattagtataggtatagatagataatattgcggtttgaggatatgattcgaaatcaacatcaatattagttaaaaaagtgcactttttccttgtctgaatggaaatatggaaggtggtacagatagagtataggacgtgcgtcggctgggaatgtggctggtgagtgcaggcatgcccacgtgtgagaaatacagccacacacaccaataatagagtatcggctaaatattttcttagagatctactgcaacttgcactatttgtgcacgatataagagtttatgaaatatatcgctaggttttttcatccaatcatgtttttttatggttcgtcactccgaaacacatcgatgtcctaaacataagcaccaagagactgtcatctcatactcctagatattattagacagtacatatcggatggaacacatatcaggtattcataattaatcttaagtgatggatggaatacaagatattacggatatatcacttgctcattataatcttctgtgaacctttgctatgcatttcgctgctcacccgcggttcattatgatcctctgcgcacctttgatggtgtgcaggctggtatacatagctcaagggttggatagcacagctggtccagttcacagcaatagaacccaccgcgggttcgaacacaatgatcaggtttataataaagttctccaaagctgatcttgttttttactccgatcagcatatcccttcttatcttgtatgtggtttgacctatagatacaagaaatcatatgtttatcatgccagtgcaaagaaaatcatgaaaatgacacacaaaatacataaaaaccaatctaattttcgatattacctgttatttgtgcaggaatagcagagcacattagaagaaccaagcaaaacaacatgactccttggtgggtgtgtgtcctgcattttgccatttgcgaaagactagttactacgacttacttttcttactgtgactaattagttgaatgatgatgagtttgcacttcaggagctgcggttcacatatatatacatagaacatagaagatgttatatatgaaagaatttaataattatttactttcatatcttgaggattttactctaacagaatctggaagattatgctgagatatagttttaattgcacgtcagagcatgcacgtatatcttatccttaggtgatgtgttattaaagccacttcggatgtggcagattttcctaattaaaatatactttctatagcacagctaaatattttaagtgtcctatgctacttaaattgtactttcaatgcacagctaagaatagcaagtgtattatcccaacatctattatgatgtcaatttcatcgcacttccaaacatggattttcgaaacatttgatgctaaatcgcttagttccatggcattctttcttaaatatacttcattcgaaatattggtttgaaccctttctttctctcatttttgtcaatttaatttcatgatattttctcaacaataacatgccacttgctctctttagttgaaacccatggagaaggaggtgattgtacaccgtgttagttttgtgttcagccggggtttatgcaaatggacacatcaatgctttgttctttgtctagctagatgttgaggtacatttgtgatatgtttgccaactaatatcagttttgaaatcttttggtctctccttctgtcgcaacttgatattggcgaagaaacattagaaaaaaaatatttatatagggaaatattgatctaaccatattaaacattgatcaaacctttagattgttcgcttcaatcggtcatagagcaattttttaaattttaaagtttagtattaatgtattatcaatgaatgtgacaaaaagatttgggtatattgttctcatagagaatagcttgcactaaacagttattagtgtaggcggttccttgcgacaaccacttcattaaactactgagagaattggttctatgccaccgagtttactgtagttcaaggatttgcccttaacacaattgcgtttatctattttttctacaatatgctagttgggcagatactttaaaaaaaatacccaaaatgccattcaagacttacaagaggttacaattaaagttacgaaaaaaattaaattattttacgtagcctccttacataatatagaagtatgtttatatttcaagatttttattttgcatgtgttaacttttaaagaaaatataaattatgttttataggctaatataatgctcttgtgttaatgttcttctatatacatcattattgatatgctatacaatttagttgttgtccttggaagaatcctgttcttaaattatacacacatgttctctgtggatacgataccctagaatactcttaggtaaagactataatggtatctgtatacttgcagattattctatggtcgtaataaataccaacaacactatgtaataaataccaacaacacta

SEQ ID NO: 32648 - DNA, 6681 bp, Oryza sativa
cacctttcattgatgccgcagccgccatggtacagtgacgccgccactgtgctcttggccaacaccgcagcactgcatgcatgctcactagtggacaggctgctatgccctacagtgataatgatcgcgaccgcccaatcatcacaatccgaccattccatggcaagccaccactccggcacctttctcacccactctaggaacaattgcctggcccaaattagaacaggaccaccgacacactagagtgcgcgcgcacgcgcgcgcgcagacgggagaagagaagaaaaggagaaagagagaagagagagaatgacagccaggcccacccctaaaagcttttgttaaaaactaggggaatttgcaaaaaacatcccatacggcacttgaagtttgatattccactctataagtcattttgatgcaaatgcttacccacacacttagttttgttgaaccatcccgtacgcatatgcttaaccacatcaagatgttttcataaattatgagatgtcaatgcaatctttaccagaattaaatatttatatagtatagtcttgacacgtttttggagattcgacaaacagaaatattgatgagagcttaaatgtcatcgcactgagtatggctatatccacaaaagaagttcaatgaaacatgatgaaaaaaaaatctaatacaagcacttggacaagattgactcgggtagcttagcccgtggtagattcggttaggctggcaaaaagttaggatttaaagcattgtcacatctatgtgatttgttatatagaagatccctcaatgcattctctaatgcctcaaaattatctaatcctcttgttataaccattaacacttctggatcagttcagcatggtgcagcatgtgtcatcattaattgtcaaacaccaaccatattgtctggtttgtttgccactgttagggaagcaacatccagtatatattggttgtgccattattgattcacaatagaaatcacctccatggaaataattgcgatgtgcccatttggaattaacaatctcgtatattgaacaacataaatataaacagttagtacaatgagtaacaataacattctctgtctctattttatgaaaaggtacagagaacacacacattgtgatgttgtgatgtctaaccttactgaacaccaacacgtgaacgttagatatgataaaaatttgtaatcttggattgaagatgcagtagacagacgggagaatgctgaccactattcaaagaaccaattcttcatctgtaattattgtcactggatgcacctttctcatttgtttcgtcatgaatcctaccatcgacaaggatatttggaagaaaaacactttgcagcaaattaacaaggtcaatgcaagctgtgttttggatggcaattcattaatcaactcaagtatagcacaaaatagaaagctttatgtttgatgaaattatgaaagggtatatagcctagtggttgcagtaatctgagtagcactgaatgtcctaatgtcaaatcttcataggagcgaatttttgggttatttaagggctaagttccctatttgataggctaagttcctaatttcaaaaggctgcatatatcctaatttaaaatatttgacaaaactaatgaaaattccaaataatgagtataataattgttcgggctgaaccaatacactttcaatctgcaaactacaattcgcaaaccgacaaacgtatttcacacaatcaacccctcatctttccatgaactttgaggatagttttaactagcaaatcagcagcgaaacaacaataaacacatgcacacaagacacggtgatttacgtgaaaaaacctcctcggtgtgaggagtaaaaaaccatggaaccaacggtccactccaagcttccacaataatcaacaatgggtacaaatggagtcttctctagaacatgtagaggtacatcacaacagcagctacaacatcaagttacacacttggtatcatcaacatcaaccatcaattagctacaacatcaagttacacacaagaggtatatcaacaaacaagcaaagaaatggcagattctatcctcttgattagaaccacatatgcaaattgcacgaaacttggcaaaaatgatagtctatgagtcccttcctatatttccaaaaaacagcccaatcagacaccatttgaccccacaaactgacactttactaactgctgcacaatctataatttcaataactcgagctgaaaaactaccactcaaatctagtgctctacttaaccaatcctcatccatactgaccagattgaagtgctcaaagtgaggaacaaactcaccaagtttggtgccaatccaaccacgtttgagcctccaaacgctggcttgatgaagatcgggtaagagcccccactactacagaacccctaaatggtgctggttgggaaaccctcttaggtgcggcacagatcacataagcctaaaggtgccggtttcaaaaccggcacatttgaggtgcatatgagccaaaaaaaaatcggctcgttgcatcgaactgttgagccgatccctagaatacccaaaaatactccaaatccatgaacacatctagatcaaacaaatcacaaatcaacacatcaacaaatatcaacaaatcatcacatcaacaaatatgaacaaatcatcacatcaaaatatcaacaaatcaaaaatcaaaaatcagccgctgatgacgatgccgctgccgcagatgggaggatgatctcgggccgctgctgtcctttctcccgccggatttggcggaggaagagcgcctccggaggctgctgcttctcccgccaaacgccgccgctgccccacgccgctacagcggaagggactgcgctgtcgggccgccgccctccttcctcccaccggatctagtggaggggatggcgctgtccggccacacgccgacgacgccgacgccggcaccgacgcacgctgctaacgacgccgacaccgatgcctccgctcctcccaccgctcttcctgccgccaggagaggagaagagaaaggaagagaagagaagaggaggtgtgcggtggagaagagaaaggaagagagaccgagagagagagagagacacgtgagaaagattcggtctcccttatccgcttgatgagaccggggcactctcccttatccgctcctcaggcggctcggctcacggctcgatctgaaaggtgccgttttttttaaaaaaaatgacatctttaagtaaataaccgacacctataataaattaaaggtgtcggtttttttatagaaccgacacgtataatagcttaaaggtgtcagttttctgtgttttcggaccgcggaggtgggaaaagacttataggtgccggttttagcaaaaccggcatctatagtgccgacactatagatgctaacacctatttgatgttttgtagtagtgccccaagctgaacaagctgcacttcttcttctccactctcctctccctctcttgtgtttgttggttgtttcttcacctcaaaggctgctctgctcactctccctccaatggaaactagggtttttcttcccaccataaaggatgaggcaatctcaaccgttgatcaaggcatgaatcagtggctcacaattgttggacattttgggctgtaaatgggctgagaacaaaatgtccatatggagggaatttagcccaagaataattatgtggactttattgagctttagctttactgctcgaacctggtggtatcatccataattttattcctgccgaagataaactgtttaagtatgataataaaatttcagtagtatttgaaaaaatccacatgtcaggccaagttcaagtattcaagctaattcactccaataacttgtctggaatactcaacttcaaagaaatgctaaccagtcaattcttcaagtgtgtgtgctactggtgccagtgccggcgccttgccctccgcgtgaacgctgtgtcatactatcattgccagcctcacctctggcgttagggctcccattgtgtagtctagcacattcctccaatcacagttcaccacccaccagcgcaaatcgaatcactgatttgggatctagggttagggattgacattgggcacaaatttaatcattcgaataaatgcaaaatcgaatcagtgattagggatctgaggtcttgagtataccatacctttgagttgcagagcggaaagcctcacattgtaagcataccatcctcgtcgtcagccttgtccacctccttcccagctccgatccccggtgatgtgtgcccctaccgtatctggccttgctagcatgtggtgaccggatcgcacaggaggggattctggtggggaataagtttactttgactcccttaactagtgaccgaatctgattcgtatccctgaaccacaataccggataattaaccgctaaactattaatttaaaaccaattgaatttgactccctcggtggttttggaaggcggtttcaccgacgtggcgcctacatggcggtgttgactcggtctttattacacgtggacctgacgtggcgtttaggtgcactagaattaaaaatagtatgtgcgggacacatttgtcatttacacaaaaaaaattgtgagacccactaacatttgggggccaaatgtcatcccctttccctccttcttcctcttttctctctctcccttatatctctctctccccatttctctccagtcttcacgggagggccggattatcgacggcggtggcagatgggggctggagcggcagctgatggcgcctcctccaacccatctcgccggctatgcggtactctccttcgacaaacaacgtgttcacgctcgtcgccaccaaatcatcatagagaatgccgcctcctcagatggcgcatgccgagtaggagccggggcgggggaagcgacggcgtgtcgtcgaccgtgaggtggctgcagcaggatgaggaggaggtggagggcgagaaggggagtggaagggagggaacggagaaggagccctcctccaagccgaacgcaagacgtgccctgtcgccctcactcagacaccccgccgctagggaggagcccatcggcactcggcaccaccattggggaggagcctgccaccaccggcactgatggggatggaggaggcgccggtcgctgcccctgtcgttgctcctccgatctggcccctctactatgaagaccgaagagaaacggggagagagagggaggaagaaggaaaggggatgacatgtgggccccaaataaatgccacgttagctccacgtataacaaagaccaagtcaacatcgccacatcagcgaaaccatcctccaaaaccgctaagggagtcaaatttaactagttttaatagtttgggtgttgaaatatctggtattgttatgggatgtgaatcatattcggtcactagttaagggagtcactactagaaaatcaatttttcatggcgtttggaaaatatttttcatggcggccacgtggaaaaaccgcaagcgcagaaaattgtgggggtggggggtcaagggccgccagtggaaacacatcttcgctagcggtctacttaagaaggccgccagagaagatatagatatcttctctggcggctctcttaagctcacgccagtgaaggtattgtatcttcgctggcggtaaggggatgtggcccgccagcgaagatgtaggtgttttcgctggcgggcctcttaacttaacgccagcgaagataccatatcttcgctggcggtgtgatgacggggaccaacagcgaaaatacctgcatcttctctggcggcatccttaacctctgcaccatctcaaataattttcaatggcagttcgaatgaaccgacatatgacgaccgccagggaaaatgcgctgaactatatgaaccagctacagtaacctcgagcaccattaggagcacgattttctctctcttaagaacacatacatagggggaaggttttgatctcgaatcttttgaaagatttattgtaccagacttactctttttgtcaactttttttttcatttttattggttgtatgttgagatttttcatcgcaaaaaatacatgacatggaggaagaaaaacattttttatttgttatttggagctcaaaatggcaaactttgcaagaaatattgtgcatgatcgatgttccatatatatatctagtttttgtcacgtcctgatttttcgctttctgttcatctcgcctatttgcgaaaattcacattttgtttattcgtctaaaatagcttaatgaaaaattcattaaatcaaaaggttttaaagtgattaattagttaattacgttgttcgctttgtgattgttaattggagttagttggatttaatttgtatttcgaaagtggagctcaatccctaattcaaattccatccaaatccaatattccttttcaaatcctaaatccttcccaaaaattccaaatactttatatttggaattttccagagaagaccctgtctttttccctttttccttcctctctttttctctattctgcccttttgcagtttagcccttattcttctttcttttttctttttcccccaccttcttctacctccagctctc

SEQ ID NO: 32649 - DNA, 8860 bp, Oryza sativa
gacgaacgccgccgacgccgccgcgctggagccgccatggcgccatggccagagcacgcccaggcttgtggtggagcagctactcctcctcttccctgtgacactgacgtgtgggacctgccatccaaaaactcaaaataatcacagccgtccaaatccctagatcaaatcccaaccgttggatctacataatccctaacatatgccaccttagccctagatccaaccatgtcagtaccaccgcatcgccttgtgtcgccacgtgtcattccacgtcatcgagtccacatacaccgagtccacccatacactctatgccactgacagtgggcccacatatattttcctatccaaaattaattcaatttccgaaattaaatatccagagaatattctcgaaatattcctttttcttttaccttcggattttccctgaattcaaaattccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgtaatcgtgtagacgttggagctgaagagcatttcgcttcagaacacgctgtgcaaggacagtactgggatcaaggcaagtgcactctttgaacatattgaacccatttgtgaaatgttttgttttgaatacatgcattgttttgtttataaactatcgaagggtagcgtgacctaattgttattattatcctacctttggtaattattgattgcccatgataccttgtcaccctagtctttgtgagttgaacattaggctcaactcaaggtagagtagttatgcttagccgctcaaggttgttctacaagcaaaatataattttgattaatcatatacttataatcacttttatatgaactgtgtggctatgtgctatcttttcggtagtatgtgttgcaccatgtaaaacaacgggcggataaaacatttttgaccggggtgatgggtggttctgtgtgaacctggttaggtggtaatgtatctgtgtgatcgttcccgggtatggtctctgtgtgagtctactgttgagctgtgtgctattgtagtttggcaagagttcttggtcaattaaggacttcacttcataagtcatggatctgagcctaacgtgcaagcacatgttctcatgggaagaacctggcccagtaggattccgagtcttggcactatcggcccaggtggctagatgataggagtttaggttcgccatggggactttcttgtctgtgtgagggaaaggtgtctcatgggggaaggcagtgttgggacggagtttctaaaaagccttgttacagtctccttggccacacacaacctgaagtgtgacacttgcgcatggccgttaaaaggacgatgtatcttgtgggtcaagctgtacaacctctgcagagtgttaattaatctattcgaatagccgcgtccacggtcatggacatgcacggtgatatctcacgaggggtcgtttgtgaaaactagaaatgaactgtgtgcaggttaatgaatatagctatgtggtcctgtgtggatggatagttggtaatacccattatttataactattattttaaacctgtttataaattgattataactacaaattgctgtgttatgcaaaatagccattgcctttgttgtcagctttgcatatgcatatttctgtgtgcttgctgagtattccatgtactcaccttgcaattcccctaattctagaagaatggttcccgctgtttcctgagtcccagtttgctgctgaagacgaggaataggtcatgagtcccagttgactgcctatggcaagttgaatggagctactacgcatttattatatttccgctgctactttaatattgtccttaggccctttgtggcagaataaatgtaaactttagccataaggcttaacacagtcattattattgttaaatattaggattccttcatgatgttggctgtgatattatctttgagtctgtgtgtgctagcttgatcctggactagcacttatacacaggaggtcctattttgggtcctcacagagttggtatcagagctgcgtcgactgtaggccgcaaccttagttagcctggtcttatttcaaaactgttttcaagaaacgcaaaacaatataatgtgttcttcctttccttgctctttcttgtcttcctcctttcggaatatcttcttatctgttttaatctctaccgtcagccatgggaggatgttctacatcagtgctgctttggagtcttgatgaagttttgtcggaaaccaggtttagttgtagaagtggtttttgtcgtaggaccactttgcctctagttagtagttcacgttagtaagacgttaagcttgggtgttagaaagcgttgcttgtttttaatttttggttcttccggtttgttgtacggtatgtttgaagctcccggctttcaaacaatcgtacgtgtgtttcgttaggatgtgtagttctacccccttaggttgccttcttcttagagttgtttttttcttcttagtacctttctaaccagccatatgttgtatagatggtgaacactaggaccggaggacatggttcagagcatgagaacactgatgcccgcactactagtcagcaaccgcctcaagcaccccaggtgaaccaacagaactttgaagtcttcatgcaagcccagattgagctcatgaggatgatgatgcaacaacttcggaaccagcagcaacagcagccgcagcaacaaccccaaggcggtccacctccacaaagcaagatgtttgagtttctacgtaccaagccaccaaccttcaagggaatgggtactccactagaagcagaagattggatgcgtaccatggaatgaaagctggacatcactcagtgctccgatggagagaaagttcgtttcacagtccaacagttggaaggagctgccttagactggtatgagaatctcaggggaggcttggatgacccggaagccttgacctttgaggagttccatatggcttttcgtgattactatgtcctggcatcaaggagctgaagaaggaagaattccgtactcttcaataggataacaagtctttgcagcaatatctgactcagttcactactcttgctcgctatgcaccagaggatgttactagagatgcagatcgccagaggcatttcctgaaaggtctcaactctggtctcaaggtgggacttgtggcacatgattttagtagtttccagagcctggtgaacaagacccttttgttagaagaggaacgcaggaagcttggtgaagaccgcaagcgcaagatgaaccagcaagcaagtggtccgagccagaggccacgtggagcattccagcagaacaataactgtcagctagctgctccacagttcaggactattccacagacactagtcctagcagctcagacccctcgtcaggctactccaactcaatctgtgcgaggtcaaggaagctaatcattcattcgtcgttgctacaattgcaaagaagtaggccatgtcaccaaaaattgtcctcatcccaagaacattattactccagtgaagttcaacttgggaaataccccagccaaggcgccagcaccaggagtagcacaacaaactgcaccagccactcagcagactatcgtcaggggtcgtgtgaatcatgtcactgctgaggaagctcagacctctacggatgttgttctaggtaagttcctagtaaactcagtacctgcaacagttttattggattctggagcttcgcattcgtttgtttctcggtcttgtgcttctcaacatcagtttcctactatccctcttaagtgttccttacttattcaaacaccggggtcagagatgagaactcaaactggatgtcctagagtaaagattgaaatagagggtgtagagttctttgccaatctgattatgttagatactcctcagcttgatgtcatcctagggatggattggttgcacagcagtaaagcagtgttagattgtggaagtaggtctatcaccttggaaaactctaaaggagaaagagtaaatttcaaagccatagttaatccaccttggaaaggagccctagtgcacaacatggaagtttctgagctacagaaagtacctattgttagagaatatccagatgtcttcccagaagagttgccaggcatgccaccacatagagatattgagttcgtcattgatctagttcctggaatatcacctatattcaagcgaccttaccgcatggcagcaaatgagttagctgaaatgaagaagcatatataagagttgaaagagaaaggttatgtcagacctagttcgtcaccatggggagcaccagttatctttgttgagaagaaagatggaactaagagaatgtgtattgattatagaagcttaaatgatgtgaccatcaagaacaagtatcctttaccgcggattgatgatctatttgaccagatgaaaggagcaggagttttctccaagattgatcttaggtctgggtatcatcagctcagaatcagaacagaggatatcccgaagactgcattttctactagatatgggctctatgagtttacagttatgtcttttggattgacaaatgcccctgcttatttcatgaacatgatgaataaggtattcatggagtatttggataagtttgttgttgttttcattgacaacatactcatctactccaaggatgaaaaagagcatgagaatcatttaaggcttgtgctagaaaagctaagggagcatcagttatatgctaagttcagtaagtgtgagttttggatgaaagaagttgaattccttggacatgttgtgaccgccgctaaagttgtagtcgatccaaagaaagtaagtacagttatcaactggcagccgcccaagaccgtgacacaagttcgtagtttcctaggtatggcaggatattacagaaggttcatagaaggtttctccaaagttgctcgtcctttgacacagttgttgaaaaaagagaagaagtttatgtggacatcagagtgccagcgtagttttgaagccttgaagaagagtttgacgtcagcaccagtgttggttttgccagatatccacaaagggtttgatatctattgtgacgcctctcgtacaggacttggatgtgttctgatgcaagaaggcaaggttgttgcttatgctttgagacaactacgtccacatgaggagaattatccaactcatgatttggagcttgccgcagtagtacacgcattgaaaatatggagacattacctgataggcaatcgatgcgaggtctacactgatcacaagagtctgaaatatattttcactcaacatgatttgaacttgagacaaagaagatggttagaggtgaccaaggattatgacatggggatccactaccatccaggcaaggctaacattgtcgccgacgccttgggcaggaaagcatactgcaacaatgtggagatcaaggagagccagttgtcactctaccgggagtttgaaaggctgaatttagagatagtacctaaagggtttgtggctaatcttgaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaacttgccggacttctacaaccattgaaggtaccagaatggaagtggtatgagattggtatggatttcatcaccggtttgcccaagactcagttagggtatgattccatttgggttatagttgatcatctcaccaaggtagctcactttattccagtcaagataacttattcaggtgacaagcttgccgaattttatgtgaaccggatagtatgtttgcatggagtaccacggaagatagtctcagatcgaggaactcagtttacctcacgtttctagcaggctcttcatgaggcaatgggaactcatcttaatttcagtacagcatatcatccacagacggatggtcagaccaaaaaagttgatcaaattttggaggatatgcttcgagcttgtgctttagcttatacttctaattgggacaagaatttaccctatgtcgagttctcctacaacaatagttaccaagcaagtttgcagatgtcgccgttcgaagctttgtatggacgaccttctagaacaccgttgaattggaatgagactggtgaaagaatggtttttggaccagatgtaattcgtgaagccgaagaaagagttgctctaatcagggatagattaaaggtagctcaatctcgtcagaagagttatgcagataatcgccgaagggatttaacttttgagaaggaagattatgtgtatttaaaggtaaccccaatgagaggaaccaagaggtttcaggtgaaaggaaagctagcccccagatatgttggtccattccggatcattgctcgtcgaggagaagtcgcatatcagttggagttgccgtcttcaatgtccggtattcatgatgtgttccacatatctcaattgaagaaatgtcttcgtgtgccagaagaggaaacaccgctgcagtcagtggagttgcaaccagacttgacctatcgagaggttccaatcaaaattcttgagacagcagagcggactacaaggagtaagaccattcgtttatgcaaagttcagtggagtcatcacaccgaagctgaagccacatgggagcatgaggatgatttgaaggcagagttcccagagttgtttccaagccagtccgaatctcggggtcgagattctgtttaaggggggaaggtttgtcacgtcctgattcacatttgcgaaaattcacatttggtttattcgtctaaaatagcttaatgaaaaattcgttaaatcaaaaggctttaaagtgattaattagttaatttcgttgttcgctttgtgattcttaattggagttagttggatttaatttgtatttcggaagtggagctcaatccctaattcaaattccatccaaatccaatattccttttcaaatcctaaatccttcccaaaaattccaaatactttatatttggaattttccagagaagtccctgtctttttccctttttccttcctctctttttctctattctacccttttgcagtttagcccttattcttctttcttttttctttttcccccaccttcttctacctccagctctctctctccttcttgagttgcaggcccggggaggccaagccccgagcccacgtgccgcctcggcccggcctcctcctcctctctgcatcgccggcccaagccgccaccgaccgagcccgcgccggccgcgccacaagcccaatcgggcgccgccaaatcccgcaagccgcgccgccaaattcggagccgctgcctttccaaagtttgtgccgtgcgccctaaccctagctactctcctctataaatagcgctggccaccgcccctttttccccctttttccaaagccgccgccatctccaccgtgagcagccaccgccgccgttgctccgtgccgccgccgggagccacgccgtcgtcgtcaccatctccttcccgtgccgccgccgctggtaaagccccgaggctgagccctctctccctttcgcgctgccgtttctctctccacctcaactccggcgtccgcctctcgtcgccgtgcgccatctccacgccgtcccggagctcggtgctgcgccaccgcgttggcctcgacctcctctgcctccaccgctgtttgccacagccgccgtgcgccgtcaccgacgaacgccgccgacgccgccgcgctggagccgccatggtgccatggccagagcacgcccaggcctgtggtggagcagctgctccttgtcctcttccctatgacactaacgtgtgggacctgccatccaaaaactcaaaataatcacagccgtccaaatccctagatcaaatcccaaccgttggatctacataatccctaacatatgccaccttagccctagatccatgcatgtcagtgccacctcatcgccttgtgtcgccatgtgttgttccacgtcatcgagtccacatacaccgagtccacccatacactctatgccactgacagtgggcccacatattttcctatccaaaattaattcaatttcagaaattaaatatccagagaatattctcggaatattccttgttcttttaccttcggattttccctgaattcaaacttccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgcaatcgtgtagatgttggagctgaaaagcatttcgcttcagaagacgctgtgcaaggacagtactgggatcaaggcaagtgcactctttgaacatattgaacccatttgtgaagtgttttg

SEQ ID NO: 32650 - DNA, 8280 bp, Oryza sativa
agggatagggagggaaaggggactttttagagtttttctttttataaaatcattttaactttgtttatttcttaataattattatttgtgctctgaaaattccactaaaatttatttacgcattttaggcttttaggaaatatacaaaaatcccccaagccttatttgacttttaactttgcaccttttaattgttggaggctttcacacggattttaattattctaggcataatttagaggatgtattttagagtcgttttgggacgtgacaaacctaccccccttaaacggaatctcgaccccgagattcggaagaactggcgaagagattgggatgggctgccttcatctcgtcttcacgctcccaagtaggttcttcctcagcgtggttgctccattggatcttgcaaaaacggattacccggttcctggtcctgcgctccatggtgtccaggattttcactagtctctacacgtaggtcaagtcttcgcaaactacaatctgctctgagtcggcctgctcggacggcactcgaaggcatttcttgagttgcgacacatggaacacatcatgcacgttgcccaaggaaacgggcagctccaactggtaagcgacttccccgcgtcgagcaatgatacggaaaggacccacaaaccgaggtgcgagcttccctttcgtctgaaacctatgtacacctcgcaatggcgtgacccgaaggtacacaaaatcatccactacgaattccagattacggcgtcggttatctgcataactcttttgccgggactgtgccacctttagattatcccgaatggttctgactttagcttcagcttctctcaggatatcagccccgaacacttgttttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaattgggtacccagctcttcttggagcttcttccaaaagtgagaggtgaattggcttcccctatcagatacaattttcttaggaacgccatggagactcacgatcctagcgaagtagagctcagctagtttgttccctccataggtggtcttcacaggaataaaccgagccaccttggttagtcgatccacgactacccatatagaatcataaccgccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgctagggtggatggaataaggactttcgtgagcttcctgaagtatcagctgtctaagttctttgtcgtctggaacgcacacccgatttccgttccatagggttccgtgttcatcctctgtgaaaccagcggctttaccctatttcatattcttgaggagtccacgcatatccggatcattcttctgggcctcgcggatttgatcgagcaaggtaggcttggcttccagcgtagccaagaatccacgaccaactatgcttaggttcagggcttccatctgttgattaagtttggctggaatgccacggacgttaagagtgttgcaatggctttttcgacatagagcgtcggcaaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggctaccagatgaccttcctgcatgagcacgcaccccaatccttggcgcgaagcgtcacagtacaccatgaagtccttgcgagtatccggtaagattaaaaccggcgaggaaaccagcctttccttgagagtttggaatgccttctcgtattgcgggctccacacaaatttctcttctttcttcaacaactgtgtcatgggtcgagcgattttggagaagttctcgatgaacctccggtagtatcctgccaaacccaaaaaactgcgaatttgagtgactgtcttgggttgcttccaatcagtgacggcggtcgctgtttcggggtccacagcaactcctttagcagatatcacgtgtcctaagaatttgacttcggacaaccaaaactcacacttgctaagtttggcatacaattgatgttcccgcaactttcccaacaccagacggagatggtgctgatggtcttcctctaattgtgagtacaccagaatgtcgtcaatgaaaaccacaacaaacttatccaagtattccatgaacactttgttcattaagttcatgaagaaggcaggagcattggttaaaccaaacgacatcactgtgaattcatacagtccgtatcgcgtggtgaatgcggtcttcgggatgtcttcttcacggatgcgcaactggtgatatccggaacgaagatcaatcttggagaataccgtggcacctttaagctgatcgaacagatcatcgatccggggaagagggtacttgtttttgatagtaacttcattgagagctctgtagtcaacgcacatcctctttcgtcttgtctttcttctccacaaaaatcacaggagcaccccagggggaaatactcggccgtatataccccttttctttcaactcttccaactgtttcttgacttcggccagttcatttgctgccatacggtagggtcgcttgtacagaggagcggttcctggagcaagatctatccggaactcaatctctcgcttgggcggcataccgggtagttcttccggaaacacgtctccgaactccctgacgatggggatttccgacagttttatctgatgaagttctgaactgccgacagaggttgggggtgcaaagaaaacaaccggttgttccggccctcggtacagagtgatagtgcgtcttgcacaatccactactccttggaattgagccaaccaattcatcccaaggatcacatccaagttcttggtgtctagaagaatcagatccgagagaaaaggaattccctgaatttctataggaacggcatggctataatactttgctgtcataacccctccaggggtggtgatgagcagagggttcctaagcctttctacccccaactgatttctccccacgaatggcacagacataaacgagtgggaagctccagagtcgaacaaaatggtagcagggatggaatgaatggggaacgtaccaaagatgacgtctggagttgtcagcacgtcctcggccatcacgtggttcacacgaccccgaatgacatccttaccaccgttgttggagcggggaggcgcttggccttgctggcgcctcggctttgggcatttatccgcaaagtgcccaggctcgaagcagttgaagcacagacgctgctgaccttgagcgtcccggcggccttgaccaggctgcacagctggcgtaggaggacggggcgcacgagtcccttgctgactctgctgttgctgcggctgtgggacacgcaccacgaattgaggtcggggcgcggagcgaggttgttgctgctgttgctgctgcaaggaggatccccctggatagggattggtgtagcggaccctttggttagccccctgttggttgcggaaattcgccaagcgacgcttgtgcgactccagttccttgtgcttggcttccaagcggatgctcttgtccaccagacgttggaaatccggatagtccccggagacaagacgcacggacagctcagggtccattcctgccaagaacttctcttgcttctcctcatcttcacgaatatcctccagggcgtaccgggccaggttgttaaactcatgcaaatactccatcatggagcggttgccttgcttcaactctcggaattcccttttcttaagggccatgactccggcgggcacatgggttctccggaaagcggcggtgaagcgggcccaagtaataggctgcccctttggctgcgtagcctggaaatggtcccaacatagagatgcgggcccctgcagttggtgggcggcgaagatgactttctcctcatcactgcactgcacggtgtctaactttttccccacggcatgcaaccaatccaacgcatccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctgggcgaggatttgggtgaggatggcgttggtgtctggtggtggtggtggaggagggggaggaggtggaggtgggctgccatggttgttgtggttgctgccttcggggtgactgccttcaccggtagcagcacttctcctggttgtcaccatctgaaaaccccacccagaaccagcaaacagagagagctgacaattaaaactaaccacccacgactaccataattcttgaatttattactgctattaaattggtccattaaagttcaagttgcttaagcaaataaaataaagacaggctccgacacagttataccacacaccggcataaccatgccccatacgactctagcagaaaaacaaacgagaagaacacacacgcaagcctactaactgctcgtctactgctgcgacgggccagggcggaaggtgagcagcagcgcatcctccgtgctgccaacgccggaggctccatcctcctgaggaaccacgggcgcgggctcggcacaaggggtctcgacgaagcaggtccacgccagggactgacgaacaagctcgggcctggaggtactcttgcgggcagtgatcttcaggctgcggcagacgcggcgacacttggggcgaccgacctctccctgggcgatcttgagctgacgcagctgcgcctccactgcgtctaggtccttcttcagctgcagattctcctgacgcagctccaggatcttcatgttgttctcgaccaacccgcgacgcaccatctgatggaagtcgatacgggccgcgtcgtacgcctccaccatgcgtgccaggtgcctgatggtagcgtcatcctccgagctagcatcccggaaggtggcgtagtcgcgggctcctccgcggcgagggtggtagcggtagggcgagtgctgcaactcgtccgggtagagctggtgaagagtgccgatggcaaggagagcggcgttctggcaagcggcggagaaagaatctccacccacggtgactgccaacgaagtcctctcgggtgagccagtgaggatcactacagtaacctcccaagcagcgtggggctctgcatcgtcaccctcctgctccgggagctgcttgccctggtagtccactccatgcgaataccctaagacaacgcacatgccccgcagctccaaaacgaagccggtcaggtccagaccacgacggttgatgctgccggccatcttcaaacaaaagagaaaagcaacattttaaagatcagattttgacgataaatgaagcagcaggacagagagagactaaaggatttttacaaataagaaaggatttttggccgcacacaacctgaagtgtgacacttgtgcatgggcattgtcacgaccagaattaacccaacgggcgttccttacgtgtgtgcattattccttgtcccgggaggtaaggtacaccaaaagttgacacagttcagagtttaacaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcctcatccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacaacattaaaagacatttagttgctcaaagctattttgtaaatacgatcctagagctatacaatattattaaacaaggccatgaacccacacgaacctgccttaacccaaggcctacgatgattcagaccgaactggcaacccgaccctgggtcccagctcgtcccaagccaacctaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcctttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggaatttaaataaagcgataatgcagtaatttaaatcaaaataactttataaactgggattcaatatgttcaaggatgatgtgacttgccttgctccctttcccaaacgtcggcttcaacttccacgaagagcggatcttccgaagctgcagcgtctacacgaccaacggaaaagaaaaggcttttactctaataaactccatataacaagcaggaacaaagcccaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgcgtcagccgaggggagggggcgagcggaccgggtccaccccacgcggcagcctcacggtccacggtggaccgggtgcacccgggctcacaccggccggcgccgtgggtcccacgcgtcagccgcacctaagggcgcgggcggctgacggccgggccccacgcggcagccactcgacgcgcccgagggcggccaaggccggcgcagccggcgggaggcagcgcccgcgcccctatggtcgccggcggcggccataggcacggcggagcggcggccgagagaggggaagggaagggggaaaagaggcggcggtccatggctcaccctaggtcgacggcgacgacaaaaaaggcggtcggagcgagggaaggcgacagcgcggatcgggtcgacggggtcgacggcgttccggcggtcggcgaccgaaacggaagggtggacgagg

SEQ ID NO: 32651 - DNA, 1267 bp, Oryza sativa
acaaaagtacataggcatggctagataaaacagtgataacgcgggaatttaaataaagcgataatgcaataatttaaatcaaaataactttataaactaggattcaatatgttcaaggatgatgtgacttgccttgctcgctttcccaaacgtcggcttcaacttccacgaagagcggatcttccgaagctgcagcatctacacgaccaacggaaaagaaaaggattttactctaattttaaaagggtttattgcgtcagccgaggggagggggcgcgcggaccgggtccaccccacgcggcagcctcacggtccacggtggactgggtgcacccgggctcaccggccgacgccgtgggtcccacgcgtcagccgcacctaagggcgcgggcggctgacggccgggccccacgcggcagcaactcggcgcgcccgagggcggccaagccggcgcagccggcgggaggcagcgcccgcgcccctatggtcgccggcggcggccataggcacggcggagcggcggccgagagaggggaagggaagggggaaaataggcggcggtccacgactcaccctaggtcgacggcgacgacgaaaaaggtggccggagcgaaggaaggcggcggcgcggcttgggtcgacggggtcgacggcgttccggcggtcggtgaccgaaacggaggggtggacgaggtcgtggaggatgcggcgaagccgaaggaggcggcgccgaggtgggaggtggtccggggcgacgacggcgacggaccggagctcgacggcgacggcggagagagagagagcgacggcgcgagctcgattccggcgaggaggaagggcggcgagaggcggaaacggacggaggaggtgcggggagggtttaaatagagccgggtcgagagagggtggcccgggaagggaggaaaccggcgcgggaggtccggccgccatcaatggcgccggcgagatttgcgggggcaaatccgcccgtttgaacgcgagagagagagggaaaaaatggggggaaaggaagaggggatcacgtggagtgatttccctctctttattgcacgcggagacggcgggaggcggcgggattcgcggcggcggcggcgctagggcgcggacgaggcggcgggagcggcgggaggaaggggatgacgggtgggccctacccatcagcgagggtggcgggcgggcccgtccgtcagcggcgggcgcgcggggagaggccggatgggccgcggggagaggagagggaggggga

SEQ ID NO: 32652 - DNA, 5645 bp, Oryza sativa
agggggagggagatgggccgagccggcccaagagggagagggagggaaaggggactttttagagtttttctttttataaaatcattttaactttgtttatttcttaataattattatttatactctgaaaattccactaaaatttatttacgcattttaggcttttaggaaatatacaaaaatcccccaagccttatttgacttttaactttgcaccttttaattgttggaggctttcacacggattttaattattctaggcataatttagaggatgtattttagagtcgttttgggacgtgacaggcattaaaaggacgatgtatcttatgggtcaagctgtacaacctagtgttaattaatctattcgaatagccgcgtccgcggtcatggacatgctcaatgatatctcatgaggggtagtttgtgaaaactggaaatgaactgtgtgcaggttaatgaatatagctatgtggtcctgtgtggacgaatcctgtgtggatggatagttggtaatacccattatttataactattgttttaaacctgtttataaattgattataactgcaaattgctgtgttatacaaaatagccattgcctttgttgtcagctttgcatatgcatatttctgtgtgcttgctgagtattccatgtactcaccttgcaattcccccaattctagaagaaaggttcccgctgtttcctgaggagtttgttgctgaagacgaggaataggtcgtgagtcccagttgactgcctgtggcaagttgaatggagctactacgcatttatcatatttccgctgctactttaatattgtccttaggccctttgtggcagaataattgtaaactttagccataaggcttaacacagtcattattattgttaaatattaggattccttcgtgatgttggctgtgatattatcgttgagtctgtgtgtgctagcttgatcctggactagcacttatacacaagaggtcctattttgggtactcacagttttcgataggtttatttttagcagatttatatattagttaactgcaaaagaatgagctagctaggaagagaagaagagaaagaagggtagtttggtaattcgtccgagggatagatgtatgttttatatatgcagatttttggttagctttaattatcttgttcaaaatatttgaactaactaaagttgtattattttttccgcaattaattaattaatacatagatggcggacagggcatgggtgaataaagagagatatcgggcgtcatacattgaaggagtcgacatattcatgaaagcagctaagaagaatgttgcatctaagaagaccaaagatattagatgtccatgcgtgcattgcaaaaatcagaaaagttggaacgatccatctgtaatcgagcaacacttggtcacacatggatttgttgagggatacacaaactggtcatatcatggagagatcccaagcaagcaagttccgaaccaggctacagtacacgacgaagtgttgagctgggacgaggatgtcattgtagtagctaaagaagaagaagaagaagaagaagaagaagaagaagaagaaaaagtgcatgcagtagaacccgttgatgatgatgatgttgttggtggcaatggtcagcacagtacagttgatgatgccgatgatggtaatgtcagcgtagatgttagtaattttgcatatttgccagagatgttgcgtcatgctgaacctgaggttgttgctgagtccgctcgtgggtaggataactttgatgcattgaaaaaggcagcgaatgatcttttgtacgatgaggcaaagggctgtgagaaggattccacattgttgtggacggtgcttgagcttatgagattgaaggccagaaatggttggtccaatagtagttttaacgacttgttggttctgttgaagaaactttttccgcaacccaactccctgccaacaagcacctatgaagcgaagaagcttatatgccctttgtcactgggtgtgcgaaagatacacgcgtgtgttaaccactgtatcctattccgtaaagagtacgaggatttggacagatgtccaacatgcaagagtagtcgatacaaaacaagccgtagccagtccgagagtttggatgttgcccttgacgatgtagaagagtccgatccatgcaaagacagtaacaaaaagaagattccccagcttgtcatgtggtaccttccggtgaaagatcatttgaagcgtttgttctcaaacccgagggatgccgaattgatgcgctggtatcatgaaaagcgaaaaaaagatgggatgattcgacatcctgcagatgcaagacagtggaaggaatttgacagaaagtatcataagtttgcagaggacccaagaaacgtaaggtttgcattgagcaccaatggaatgaatccattcaatgacttgagcacctcacacagcatgtggccagtactcctaaccatgtacaacctcccaacgtggctgtgttagaaaaggaagtatatcttgttgaccatccttgtacaaggaccacgacaacctagcaatgacatggatgtgtttctagagcctttgctggaggatatgcgcgatttgtgggaacacgggatccgagtttgggacgaattcctgcgggagtacttcacgctacatgcaattatctttgtcaccgtcaacgacttgaccgcactgttttccctattgggacagatcaagggaaagacgggttgcattatttgtgtagatggtactgtgtacaggtatcttaagggatcgaagaagctagtgtacatgcgacaccagcgtttcttaagaaagaatcactcgtaccgctcccaagcaaaatatttcgacggtactgttgagaaaggtgtggcaccagaaccatggaagggtgataaagtgtttagaatgaccaaaaatctgaaggttggttttgggaaggtaaaaaagaaggaaacaaataagcggaagagaaatgatgccgaagtgccagcaagccctagcgttccattcaagaagcactccattttctttaagtaccttccgtactggaaagatttagacatacgccattctatcgatgtcatgcacctagagaaaaatgtcttcgatagcaccattgggactatactggacatactaactaagaccaaggatggactaaaatcacgtaaggacctcgtggatatgcaaataaggaaagagcttcatcctgtggataaaggtaataatggaaaagtgtacctaccgcctgcgtgctacaccttgacaagagaggagaaaatggcattgtgcaaatccctacatcgggtgagagtgcctactggcttctcctcaaacattaaatgactagtgtcgatgaaagatctgtcgctttcaggctacaattcccatgactgtcatgtaatgctcacagtattcctcgccattgcaattagagcagtcgaaccagttcacgtaaagctggtcatcacaaagctctgttatttcttcaattccatatctcagaaagtaattgatcctgaagagttaggtcctctccggactttcgctatacagacagtgtgcgagcttgagatgtgtttccctccatcatttttcgatatgatggttcatatcgtgcctcatagttcatatcatgcctcatagttcgatatttttcttcaacgcctcatagttcatatcgtgccttagataattgcacttgggcccctatacctgcatcagatgtggcctttcgaacgatacatgtccattctaaaaggctacgtacggaaccgcgctcacccagagggatccatgatagagggatacacaaccgaggaggtcgttgagtgttgcattgattacctaaaggatggaaaagcaattggtttaccggtacctcgacatgaaggtagattatctaggaaaggaacaaaagggaagaaaagaatccacgacaatgactacaaaaaagtgaaagatgctcatttcactgtgctgcagcaattcgcaatagtggagccgtacatagagcaacacctgcatgaattacaagcaacaaatgtgggtcgatctaatagatggatcatgaagaaacacaagcatcactttactgaatggttcaagaacctcgatctaccagatggccataccatggaagaaagaacaattaaaatgctagctgacgggccatcaagtgtgtatacctcgtggcaagcatacgatctgaatggatacacattttacacaaaagcgaaagacaaaaggagtgcatgccaaaacagtggcgttcgagtagaagcaatcgacacaactgggcaaaagagcacatactacggattcatagaagaaatctgcgaactagactacgggccaaatatgcagattccactgtttcggtgccaatgggtgaaacacccagccagcgtgtctgtggacaactttaggctgacaatagttgactttgacaacgtaggccacaaggatgacccatgggtgcttgccgatcgggtcgctcaagttttctatgtgacagatccatctcatttgaagaaagacatagttatttcgggaaaacaaaggattttgggagttgatgatgtcgaagatgtcgaggcatacaatcaatatgagaacatgatactattcacagattttcgaaacaagatattacgcgtcgaagaatcaattggtgaatcgccgaagccatacatgagaaatgaaggtgtagggaaaagtgttagatgctaattcattatatatgtatcatgttggacgtatcgatgaattttaatgtactataatgcgtgacaatgatggatgagatgaatttttgtatatggaatatggtgacatgataattgttggatcaagaaatagtttggtataaatttatttgtatgcatgcattaaaaaaatatcaggcgcaaacattaaaaaatcatattttatttttttgataaattaatcatatttgtgtaaaaataaataaaattattttttcagttgagaatgacatgtggggccaaagggttttcgctggcggccggctttgcccaccgctagcgaaaactattttcgctagcagcccacataagcttgccgcaagcgaaaatgttttcgctagcagtcggcgcgttcctccgctagcgaatatgtcttcgcctataagtagctagcgcgcggctgaaaatttcctaagtcccagaggcgcgcgaaccctaaaatttgtgccgccaggctgccaaaatttcgagcgccgcttccagcgataaccacagcgcccgccactgccgccgcctcctccattcacgccatcctccattcggacacagctcctccattcacgcctccaccgcagccgccggctcctcctcttctcggcccgccgccgccgccgctagatccattaacgcctcctctccaccgccgccgctagatccagctcctctccgaccgacggccgccgcatcctcctcctctccgccgcctcctcctcgatcggcccgccgtctccaccaccgccgctgccagatcgagctccacctctcccccggctcctccttcctccacctcgggagttgtcgccaccaccgggactcgtccgccggctcctcttctccgccgccg

SEQ ID NO: 32653 - DNA, 14064 bp, Oryza sativa
atatatatatatatatatgtatatatatatatatatatatgtatatatatatatatatatatgtatatatatatatatatatatatatatatatatatatatatatgctgatctgaatatgatgcattgagatgactgttgggtgaatatttagatgcacaaatttgttagtttgactgaaattgagtaatttgttagtttgatactatggcgatcaaaatgtgttgtttgaaatttagttcaaatggaataattgatagattggccgcagatttaatgtagttcctaggttatcaaaccatcacagaatacaaaatgcatggggaattttggtggattggtcagtgtagtccatggacggaaccaacctagacaccaaaattctccatgcattttgtattctgtcattctttgataattaaggaacttaattagatttcaggtttgaaatttagttcaaatggaagaattgatagattggccgcagatttaatgtagttccgaggttatcaaaccatcacagaatacaaaaatgcatggggaattttggtggattgggtagtgtagtccatggacggaaccgacctagacaccaaaattctccatgcattttgtattatgtcattctttgataattaaggaacttaattaggtttagggtttgaaatttagttcaaatggaagaattgatagattggccgcagatttaatgtagttcctaggttatcaaaccatcacagaatacaaaatgcatggggaattatggtggattggtcagtgtagtccatggacggaaccgacctacacaccataattctccatgcattttgtattatgtcattctttgataattaaggaacttaattaggtagtttgaaatggtcagggttggtggattgtaatattgatgtcgttgccgatctcattgattggtaacaatatttatacttgtagtacaaaattagtatctaaatttttccttctttttggatttacaataagaaaatgattccatttcgcaactaacattaattcacattcaagcgatatcaatggacaaacccacccaagagcaacccacgggtgacaagggcaaggaaactcagctagtcatggaggaagatatttgcacgcaagtagtcgtggaggaatcttcgtcgtctagctcaagtgaaccaggcagtggatcgtatcacttgccgagtgacccccatccttctccggcaaagaagagaaagggcggtagcgacaatgaagttgactctggctacgttccccccgaactggtggtacgtagcatataatatatgtttagttccaatcatattaactgcaaactatggattttaattaaagtgcaaaacagtgcatttaaaaggtattaccagcgaggcgaataacacaaaaactcaagagaacgcatatccgtccgcaataagtggccggtaagtacatttatatggatgccaaacagtactacttaattttcataaatgcttgtgtgtttccatgtaatcacctattataccttataattattttgatgttgaaagtgtcacaagcaactggtgggaacagtactatgcggatattaccgttgtgagttcctaagggttaatgggaaatattgtgccaattacaacgaggtaagtaatacacacttgttaaattagtcgctaacttgtattattgtgaatagttaatttccttaattctgtcatgatctgatgcagcttccaaaattccccaagtctgcaagagagctcaatgatacatccattcagaatattcaggcggacatgtgctacttcatccaccgtgagtgcgcacatcagcttgggctgtttttcgacaacgaaggagtcttagctctactggagaacgaatccctgtctaactggaccaggcgtataatatagctagggtttcgtaattcattcaaaatacttgtaaatgttatgtcgtcggtcgaatttaatttgtcaatgtatatatatatatatatatatatatatatatatatatatatatatatatatatatataggtgcttccgaatatttatatatatgtacattattctgcttcatatatactcaatgcgtggctctaaaatacgcgaaagagaacatactctatcgatacctcgattagttatatcaaccacgtctgactctgaaatacgcgcacgaagaaaagaaaaaatagtatatataataatgttttatttttttaaaaaaaattgcatcttcactggcgggccacgtgtcagaactaggacggtctatatcttcgctgtcgggccacgtgtccatccacagaagccttacttcatttttcctagcgtgccacgtggcctaaaatactgtgagtcgccagcaaagaattatcttcgctggcggccgacctaaggctaacgcaagtggagatacttctttgctggtggctgcgttatgtccgccgccagcaaagacatgtcttcgctggtggccgtcctaaggctaccgccagcgaatacatctctttgctttgctggcgggcattcctttcttggccgccagcgaagatgcattttggctggcggtaaataaccgctagcgaaaatcgacattttcactggcctttgctttctggcggctgcgatttccgccagcggaagcccaaaatggccccacaaaagatgattttcgtagcagtgagtgaaagtgaacttattccttctggtggcgacgggcaaagcaggcggtgattgggctgccatgtctcgtgggcctcctcatatatatgtggtcgtcggcgttacaaaccaactcttctggactgcttgcaatcacagagaacgaccaacacttaattactcttggtggttaataatcgaatatctagtagtgaggaaagtttaatctgaactagctgcaccataagaaaaatagaaggatgagatattgattaccttaggtgagagctaacaattaatctgccatctagtgtccgtgccgattcactgtagacacagggaattttccaattcaacaataaagttgatctaaggcaaatcaccagtacctacggtggagcatttgagcagatttggcatcgatcaaggtgagagagtgtgcgttgatttcaaccagcagcaagccaaaagagcgaccagctggtggctaccagccttatgttgagccctccagtcctagagttgtggcacaatgaacgtttgggtttctgacttcgtgcatgctgttcgtgcatgctgatcacggccaactcttggtttccttgcaattcctcagtgtatctctgggttaggcctcatttggctgtttgtgtttcgatgtggaacaggccccaaacccacccttccgtggaatgcagcccacgcctggatcaattcccacatccggcccaaatgtgcatttggctgttcgtgtattgctgtgtattgcggctcgatacatgccgacccacgggtgagagaataatcctcacccgaggcctggaactctctcgcgtgcacgctgcagctcgcgactcctcctgcaccgtcgccgttttttccaagccgtccaccgcctcctcgccgtcctactgcgccgccgacgccgccgccttctccgagctgtccaccacgtcctcgccgtcctcctgtgccgccggcgctgctgccttctccgagccatccactgcctcctcgccggccgccgtcgtctgtcgcctcatcgccagcgtcgccccggcagcctactcgcttgatcaaggttcaaagtcctctcctccatctcctccttcatctcatctcattttctttgcccatcttctttcatccacttgttttgctgctaggaccttcaagatctggaaagtacagccatcctgctagggtttgacgatctgcaagagaaatattggagacgaggtatgtcaatgcttggagatatgcaaagtacagccatcctgaagggaacaaaacacagtagggaatcactagctttgatcttgtattagtgcaaagagattttgagcagaaataaactacagctagtagtactcctctacacactgctaagactgtaccaccaccactgcatgatataccaatgtatagcaagcaatacacattacagtattttacactaacaccattgaatgcacaaaacagcatgctagcatagtagtatagcacttctattaaacaaagtgagtgctcagttcatacacatgcataattagctttaattatttatgaacatatatagtgttgaaactaaaaactagagtgctgaaaccttttttcttttgctaactgcagtcatcttaaatattcagtattccttctagttagaaggtatgaattcgctaattaggaagagaaaagatgaggaggatgaggagattattatgttctggttgcctgccctatatcttttaactagtaatggagggatagagaaaagagtaagcatactttaagttagtacggtgaagaaaaacccagaaatatttttgagggacatgaaaacaattgccttgttgcattccgcatggagcctaacatatttagagcaatagcgacatatcttcgagagggcaagaagtaatgtgcatgaggatgagttcctgatcccagtatgcattgctgttgtggacagcatggaagatatgtcagatgatgagaaggtcctggcttatgatgtcttcaaagatccacaaaactgggccattttcatgactgcaaaagactctacatgactcaagtggttaaggaggaagattacaattgcgtaaatctggtattgctcctttcgtgttattgcctctatgaaactgatgaatatattaattagtactacactttagtcatattaaacagttggattttgtttgttgtatcacctaaaacttcaattcagtgatgctcagcaaaactattttttggggtaaatgttgtgcagattggcagatgatacatttgtagttttcacattgtagcatcacctgagatgcaggtatactatttatgctaaaaatgatgttcattatgccttacatattattcatgctcttttgtttttttggaagtgtaaactttttatacatatattctaaaatattgttgttgctctctccgggtgagcagtactgggctctgaaagtatgatttgaatttgctgaatgaatgataacgctgatacttggagtgagcttatctattcaaatttgaagatgcatagagtgaatttgtttaaatgtattacatccgttctaaaatataagcatttctacttatttatcaagatatagcttgtaaaatgcacaattaatttcatcttgctccaacttttcttagtcccctagtgctcttgtcctaggaatttgcaagcttccttattagctctgttctctagtttctctgtgttgctagcagtcagtttgccacggcagatatgaagccaattaatcttttgccttgtactttgtttcaggtgatgcatggaaaaaaagatgcaatggaaagtaaggagatatgctgctgttggagttgtctgtcttttgcttggatgtttcatgtcaaagaaattattcgtagatgaaacacctagtagacttcaaattaaacctctatggtagacttagctatcaaagttatttattactgtcatatatgcttggatgtgtatgtctggtgtgtgctgtttctacctggaaggtttatgttgaatcaattattctagttcacctataaatatttcatggatcagtaatatgttcatccatgtgcatgcatgttaatttctctattttctatgtgaaattctactcttgtgttttttttttaatttttaaagcaggatttttagagttacagatggatatacatgttggattttctattctggtattttatttcttaggtttttcagtattttttatattaactttttacttaacaaacgagacctaaaaggtaaaaggtaaacctaactctgcccaaatctccatgcataccactagcttagctagcactacgtacttgctgtggagtcaaacctgggcatcaccggtcgaaccaccagcccaccctgtgtattgaatcatgctgtgtattgggtgggtggtgtggattcactcaatacacaggtggaactattcacacatgtataatatacacgggcagccaaacgaggccacaatacgggcatggaatacataaacggtggagaagaacactcatctgattaacggttcacatcagagatacatgtcgttccaacagctaacatcattttgatgatgtgtaaaaacattgaacctgccttatactaattaatacgtctagtgggttacacttatataaacgataagttgctgggttttttttgtccaatcaagttttttttttatgtttgaaattatggttggtccaagacacatttccggatcataggcaccaagagactgtctcatactcaagatatttgaagaaactgcatatcgttttgaacatagaaatcaggcatccataactaatcccaactgctgggtggagtacatgattattcgtaattaatcacttgctcatcatgatcctctgcgcacctttgatgatgtgcattctggtatgcacagcccaatagttggatagcacagctggtccagtgcacagcaatagaacccaccgggggtttgaacacagtgatcaggtttataataaagttctccaaagctattcttgtttttcacaccggtcgacatatctttttggatctcatttgtggtttgacctatatctgcaagaagtagtatgtttatcatgccagtgcaaatagaatgatgaaaatggtgccaaataacataaaaaggaacctattttttaaattacctcttgtttgtgcaggaatggcagagcacagcagaagaaccaagcaaaacaacatgacttcttggtgggtcggccttaaacatttccccattgcgaaagatgacttactatgctttacttttcttgctgtaactaactagttgaatgaggatgagtctgcactccaagaaccatggttcacatatatatatagaacagatatgtatggatgaatttaatgactatttactttcatatcttggagattttactctaaaagaatctggtggattgtcctgaaaatagttttaatagcacatcaaagcatgcatttatatcggatccttgtgtgatctgctattaatgccactactgatctgggagattgtcctcattaaaatataatttctatacaaacacatgcaaaaacaatttgatttcatgatattttctcaactacaatattccactctttttagtagaaacccgtggagaaggacctaacgtgaattgtacttgtacctcgggttagtttagtgctcaatttatcaaaccttgattttgttcacttcaatcaggcgtagtgcggttcttttaaacaattttcaaagtttaggcattatcaaagaatgtggcaaaaagctttccgtactcagttatcatagggaacagcttgcactaagctatagtgcaggctatggcaccctcagctccattgatttaggcacagtagaagaaatgaacttgttagcggactgatcaacacatgaatattgatggaagtagggattacaatatatagctagcctctgtcttatttatctttgtaaccgattaatagaaactgggaggagatcggcgaggcggtgggtttgggatcgcaacagcaacaccaattgtggcgtttcggacgcgctacagtggcgcatggcaatgggcagggaagcccggcagtgcccgaaaatacggacgtgactacacagctagtggtagctaccactccatctatgagagattttgtctacatatactttaaataaaattttctcttaagctactcatccgatttacaatccgattacaccattgtgttcgtaacaattaaatctttataacaagatctcacatgattatattttgatgaaaaattataaattacttttataatatatttaaattacttttaaatttcactaaattacttcttagacataaaagtaaatttaataaagcctaaaagtaatttacatgtattatataagtaacttataacaaaaagaaagtaactttaatacatgcctttttttcatcggacgtaactacacatctagtgatagctggtagtactgtctcctttcaacttgaaaaatacaatagtatgtgacaaaatattgtttttaagatctatttgcatcattgtactccactcaaaatatgtgacaaaataagattcgtattgaatatattcaaacattttattaatttaaaagtaatttattacatgttagaaagtaacttccatattatcaggaagtaactattacatcttatacatagttaattcttattagttattccatcaatgtgatttacaatccataaaaggttttatcttcttttctcattctacatgaaaaacaaaaatgaaaagaaaaaaaacaatcggtgattaaacagatttatagagagttacttctgaaccatgcaaaagttacttccaattaacattgaagttacttttaaaaattattaaactttcgtgtgttgatctgtgctgattaaatttaatttctagataaagtcatatttttatccctacgacgaatttacttctaatttcgtgacaaagttacttccgttttgttttaagttacttttataatatatgtaaattacttttagactttattgaatttacttttatatgtctaagaagtaatttagtcaaatctaaaagtaacttatatatatgataaaagtaacttacgtatataatttacaaatataaatattttttcatcataatataatcatgtaagatcttgttgtgaagatttaattgtaacgaatataatggtgtaatcaaattataaatcggataagtaatttgagagaaaactttatttgaagaggaaaaagacatacatatctattaaaaaaaggcacgcactatgttgatccttctcattgcgccattagagcgtggccacgcggatgacgtcaggatgacatgcgcgatcagacggctatgaggcgcgtcgcgtgatacgactaaagcgataagcctctcggtttagattttacgcgaaaatatctgacaacccccgcaatcacagcagcgggaaaggcattgagactggactggaactttgtaaatacagtagtagtagtagggagactcttcgtgaatatgtcggcgtattgggacaaagttggaacgtataggacatggacctccccaatgtgacatggtcatggactcacggacgaagtgaagattgatctcgatgtgcttcgtccgttcgtgctgaactgggtgggtggataagtagatggtgctgatgctgacacgatcgagctgatcactgttggcagcgtcatccgtacattcaccgacattgtcttcaagtgattgccaccaaagacgtactcgagcttggtgccaccgccggcctcgcccatatggcgccggcttcatcttcaggtggctactgttgataacatgctcgagcagggtgagctatagcctgccggactcaacatgcattttctgatgacatgtctgagctcgacattgctaccgacctctacctctattggattaatttcagattaagcataactaactgagggcagtaatgggatagactattggactaaatttcaaattaagcataactaactgagggtagtaatgggagagacgcccaatgaagctatccaatgatgtgcgactcacgaaccaattcatgcccgctatgttcgggggcattcccaatagaatcgaggcactctcatcagaattggtttgaacccctatcatatcgtgcatataaaatatggccacgtttacctggagtgttaccccgtcgctcgtaggttatgctacgtcctaacattccctaaaaccacctaatcctaagagtttgttgtaatgatgagaaggccgactccatctcgtaccacgatgatcgttagccagtacttgtggagaccaacagggcgatactaccttgagtgccaatgtgttggttgatgcacaattacacaaatccgtacctctacagcgaggcaaatgattactccacggaatagataatcaacaatccgatggcatcattctccagtgctgccaacactgtactcgaggtcgacaccaccactggcatcatgcattcaccccctaacaccatctccttggctgccgccgaggatgtgctcgagcttggcggcacaatcaagctcatttgtacttctaataacgttggcttggtggctgccgctggtgacgtgtaggagcttgtcactgctgctggcatcaatgacgctttgccgacctcgtcgttgtactcgccactgccgccgatatcacactactatagaaaagcactttggtgccggttaggaaccctctttagatgccgttagtcccaaccggcaccatggaggtggcactgatgactttggtcattggtgtcggtttcaaaaccggcatctatatgtgtaatagatgccggtttgtagttttcaaaaccggcacctttgagatatacgcgagccaaaaaaaaggctggatgcaccagctcaaatcgagccgatgcatcgagggcatccaccccgcattgccccaaaatattaatccacaacatcataaaacaacgaacacccgaatcaaccaacatcagtcacagatcaacaaacattgaagaataagaccaacgcggaaagagagaaggccaactccaccgctgctcaccttcgccatctgccagatccgccgcgggagaagccgacgccatcgccaccgctggatccgcccgcggaagtgttccttcccaccacctgccctccctccagatctggcagagggagggcaccgccgcctcctacactccctctgttgcctgagtatccgtcgctgccgtcgctcgtagatttgccagtttgccaccgctactgccgttgcccgaggatcagctgtcgcctggccaccatctgccctccctccagatctagcggagggagggcgccgcaactgggccaccggcgcttctaccggatccggcccgcaggagttgccgcctcctatgttaccgtgagtcaaaagagaggatgggggggagagggagagataaacgggtgagtggataaggcggagacgggaggagagacgggatcccacgtggtgttatctcggcgctaaaagaaaaaaacggctctccgtcggctcggctcgactcgtttacacctataatatacatatagttgtcggttcttgactatgaactgacatatattccttttaccacaaagatgcgggtttttagatgggccccatgccaactactccgatggaatgggtactaaaaggtaccagattttcaataaaaaccgacatctttctctgacaccagtaataggtaccggttctttggattttggcacgtgaacggacacgtgggcgggaaaagtaatataggtaccggtttacatactccggcatctataatgcaggcatctatttgatgttacgtggtagtgtcatgcttgagtcctcacccttgctcgcgtgagtcatgaccatcatgattgccgtttaagacgtctttgtattcttgctcccgcgctgcggacggccgctggcggtgacctcgaactcgtcgctgccgccggtatcatcctcacctgctcatcaccacagtcaacatcattctcatgctgtcctaggattgccactggcagtgacgatcttcgacttgctagctgcctccatcagcatatttctcatccatcactgctgtttgcgacaacagtaccctgtcttcaccgctgctgactatatctgcatcaatgacttccgcagtgacagttcttaccattccatcatgctagaatcaccgccatactaaagtcacataacttcgtgactacatacaggcaggcttatgcatgcatgccttactgttaatcaatggacccttgcaagtcttagaatcattatactaaataactttatgcataaataaaatatttttctaagaaattttatattagaacaaataaactacttccacaaatcatggtttataagggacaaaacttatagtatatctagaattgaagctaaaaactaaaggaaccttttcttgaacaccttatatatggtgtagatgttatatatggttcacatatatatacgtagaacatagtagatgttatatatggaagagtttaacgattatttactttcatatcttgaggattttactctaacagaatctggtagattatatgctgagatatagttttaatagcacatcagagcatacatatatcttatccttatgtgatatgttattaaagccacttcggatctggcagattttcatacttagaatataacgagttatcgtgcacgtgcaaggcacgttttgacattatatacacaaaatagcacattaaatgatacttttttatgcagcactccatagaccatagtgggatgataatttgaatgatctctataaaacttgcaacgtctattcctagagtgacaatataagatgcaatgcaccatccgcctatattaacagaaattccaaagctccatatgagtgcaaagcatatttttatagagatcattaaaaaacatcgtgcacatgcaaagcacgttttccaccccttagtgccacattaaaaggccaagcatacaataacatcaaaatataaaggacatccatagtaatataaaaatttatgacataccaaaatcagtgatgtaaacaattggtgtggattaaacaaattaacaattggtatggattaaacaaattagtggtgcagatagttagaaatagacatattgttattagcttataagcatgccaatgtgaagacatgttgtatatgaacccccacagcatatatactctgatatatatactttttgttagaacacgccgaagataagtgtatcatttcattaacacaccctaactcttaaatgaaaaagaaggaaaaaaacaaacaaaacgacctccctaggacacaagggctatcgacccaaccaacacatcttggagctttgatgttccatccaagcaccaaagtgtgcagcttcaactattagagaaacttcatagtaattggttagaactgatgaaaatgattagaggtaacatttgaggtcaatttaagccatacccccatagatggcagtctatggccatgcttaacatcttcttaaacccaatatggattttttaaaaaaatatataatatgactatttccagagcaaacatatatttaagcatcgagagaatagattcacaagcaagattttattatatcgttgacatgggtacaaaaatgagaccgactatgacaaacaaaaagaacctttggttatcccaggtaaacaacctgaaatcatgaatttctataccatgaatcaaatttaatttaacaatgatataaaaatgaatggcgtgtctcgaatatagtaaacatgtagaaaggtcaatttctcatttaatatatgcaaaaccagctgcaaccaatattgaaacatcagaatgaaaaagaattctaacaaatgattagggatttttccacttaaatcatctcagtaatatccttacaggcttacatttgcagggaagctaatcatattaatagaaaatatattaatgataaatatgaagcattttagcaaacaaatgatcaggagattataaacgctccatccagtcaaagcattttaacaaacatataatcattggataaaatagaatacaaataatcagataaacaacaggagtcacatgcatgaagcatattccttctttcctctgcttcccttttttcatctcccttggaaagcaaagtaggtagctatatgaatattgaatgacatttgtttcatgtacatgtgaaaattttccaaacagatcaagaaccaaatacctagcatctagtacagcaa

SEQ ID NO: 32654 - DNA, 9681 bp, Oryza sativa
  unsure (1)..(9681): unsure at all n locations
gatatgggtgaggcagtgggtctggcggaagggcaaaccaccccggcgccgtcggaggccgaggtcgagttcggttccggcagcggagaaggggccgaagtcggctccggcggtggctccggcggctgatccgagtgggagaagcacgatacggaggcggctccggcgaggacgcggcgtagcgccggcagcggggcggaggagaagcccgtgaggaggacaaccgccgcggtggggaagaagaaggacggccgcgggctgaggtcgatgtcggttccggcagcggagaaggggccgaagtcggctccggcggctgatccgagtgggagaagcacgatctggccgcgtctccggtgaggacgcggcgtagcgccggcagcggggcgtggcggtggggaagaaggaggacggccgcggcggctccggctaggacgcggcatagcggcggcagtggggagcaggaggatcgagcgaggaggacggccgcggcgggtccggcaaggacgcggaggagcggcggcagtggggtgtcgctcctgcgaggacgcggggggtagtgagcgaggaagagaggcgcgcggtctccgcggccgcgggtggagaaggagcgctgtcttcgcgcgtggaatcctcggctgtgaaatcgtgcggtggagaaaacttgcgcacggatggacggtccagattagtccggatgatttggcctagtattggaggggaagtaactcctactttttatattagctaaatatttcaagtgtcatatgctacttaaattgtactttcaatagcacagctaagaatagcaagtgtgttatcccaacatctattgtgatatcaattgtattgcacttccaattaaacatgggttttcaaaatgtttcatgctaaatcgcatagttccatggcattctttcttaactatacttatgaaattatattgttttgaaccctttctttctctcatgttgtcaatttaatttcatgatatattctcaactataacatgccactctctttagttgaaacccatggagaaggacctaaggtgattgtatcccgtatttagttttgtgttcagttgggcttatggaaatggacacatcaacgtttcattctttgtctagctggctgttgaggtacatttgagatatgtttttctactaatgtcagttttcaaatcttttggtcttccttctttcacaacttgacattggcaaagaaccatccgaaaaatatttctatagggaaatattgatctaaccatactttgttcacttcaataggacatagagcaatttttaaaattttaaagtttaggcactaatatattatcaatgaatgtggcgaaaatattttgatatattcttctcatagggagtagcttgcactaaactgttattagtgtaggcggttccttgggacaatcacctgcattaaactattgagaaaaccttgtctatgccaccgagtttactctagttcaacgatttgccattagctttgtctccctctataatgcatcattgactttatctgtttttttctataatatgctattggaacggatacttttaaaaaaatactcaaaatgtcgttcaagacctacaaaaggttacaattgattgatctattagatgttccaaacaaatatatttttttaagtagcctccttacatactatagaagtgtgtttatatttcaagatttttattttgcatgtattaaactgtttgcagtaataattttctaatgcacttttttatgccagcttcgtgtggaaatgttactgtacaaagaatggacccaacctcgcaataccataagtaagtcctacgagtttccacccacatcttaaggctacaaaaattgcttaccatcgcatccgtgtttgagctctgtctgcttctgctggccaccaccagtcaccaactattggcagtctttaaaccataaatataccagtaatattctaataaaaatgcaaataatagataggttccacaagtttcgatgtccccaatacattttgtaggaacatgcatgttaaagaaagagaatttcggctgcttagagctaattctaggtaggcattacatcaaccggaccgagacatggttcagccggcctccacagcccgagtgacctaattacctggtccaacaggccagagtaatccagccaacccccttccatagcacggctggccactcagctccattgagccaggcacagtagtagaaatgaaatgacggacctaaatttgtccgataatacacacttaaggtattcaaattccttagcaaccatatatggtctatatgtcacgagcctactcgataacagaatggttgtcaaccatcctgatatcatgaaattgcgctaagacatacagatcattactagcatcaatagcaccgaatttgatattcattacatcccgcaactcctttgtttcggtcatgtacatatacaccccaaccaaacaattgcaatgaatgctaagaatacatcccacgaagatagtagtgacttcctcaaatttcttctggttgctagtactaacccaaaagcatttcatagccatcaaccaatgagtaacccttatgtgccatctcgtgaagtgcatatcagtgaatttatgcggctttagtgcatcggcaaattaagctctagtaaaaccatagtgcctatagtaaggtttttggactattgaaaacataattgcatgtagatttaatttattccataaataaatcatgaggttaaaagaggtaaactagctgaaccaagtcagttgatctggacttgtatacaagatagctacgaataacaaatcaaacatacgaaacatgattgagatttaccgatggttctgtttcgattgtggaagaggatcagcttgaaggggcaaaccagctagcagtcacatagagcgcttccaagaaaccatattggtgcctttttcctactgtaagtcatcaaaggcaatggttccagagactttctctcctggtggcgcggtatagagaaagtggcaaaccctgattgttttttgtgtgtgctacgtgcaggcagcaactccgtatctatagagataataggacatctacatgatctcgaaaatacgtttctttgcataagtggatgttgataaccgttaaatacaaatttcgaccaccaactatcacaataaacaaagggagaactaacatttcttacatatatatcatttacaaataatgtagttccacttatattgtagaaatactatggatgcagggattatacactaaagtgaaggagaattgagccggcatgcaaagaaacacacctctagcgaacacacgtattgaggggctcacaagtcagatcaaactgacctaaagttgggcctaaccaccaggaacaaaccaaggagcccacctgttagccactcaccaaaggcggtgccaattggcgttgggtctggtacattcgaaccctggttcggctgaaccaatcgtggtgcccccatttcctcccttctacgtggtgatcccttgttggctcctgatggcggttgtggagttaacgacctcctcaaccatcataagccagctataaacagagatcacctcttcactctcaaagcacacactcaaggtgtaaatctctcactccataccttgcattctctctagtagcagtggagttaggttatgagtaatctttgagcctatagtcttcttggagattccggtatgtctttggtacttcacctttcttgtaagactatagttgctttaatagaattatcttctttattctattgtgttcatagttgatatgctaattcattagttatatgctctatgaatagattatacttcatttatatgattcacttgattagattagtcgatctatgctatggtaatggtccagtgaccttaacgggttgcactagttctaacttgtccatccgaagggtgggagtgccaggggaattagtgtcattatttagtaacataagcatggtgcttaggtcagcaaaatgttgttggatgcgggtatgtcccacggaaagtgaggtagatgagaggtggtgacaaacatgtccgtcctttgtgttcctccacatctgggtatgatgtaagagttcgtaaaatgccataaccacgctggcaaaccaacaaggagtggtctctcggtagtacctaggtgcctagaactaagtcctaaccttctaagcatgtatgtattaagtgtaaactatacattataaatacaaaagtacatttaaaccatagatctctttagttcttctccactacctagtgtatcatttttagagatgaatctcctatgtatcacactacccttatccatactatcaattaacccctatttagaaaagtaattatagcttgattaaggaatgcatgaacttatttttttacaccgccgcttttcctgtgaaaagataaatgtgatacccttggaatactccttgggtgaaatgctacatatgtatccatgcgcttgcggatttatctaggaccttaagaaataccaacagttgctctaaactatcctaactagatgtcgttccacacactagaaaatccaatccgcacaaatcacactaacctatccagactacacgtcattccatgcaccggaaagtccgatgtgttttcaaacaccgaattacgcagcaaaacaaaattacaaaatgaagttgcgtctctgcaacaatgaggggccaattttggcatgtgcattcatctagttctcaccactacaagtttctaaggggcgaggagaacactctttgacggaggtaccgctctcctataataggcaatgtggtactaaagatttacatgcatccattcttttaaagtgggcatttatgatatttaaagaaattaatcttcatatagggtcttcatccacatatcaattccaatagcttcgagcagttttgcgaagtaaaacgcaaaatctttgctataaaccagtcacatggctatctgttagcaaaaacaagggaaacttaatctgagccagcttccctcataaaaatagaaggatgagagattggttaccttgggtgagagaaaacaatgactctaccatctagtgtcattgctggtacactgcagaaatagggaatgttccaactgaacaataagttgatctgaggcaaagtaccagtagctatggtgaagcacttggacagatttgacatctctcaagaggagagagagggtgctgatttcaaccagcagcaagccaaagggcgaccggcaggtgatgagcctcatgtggtgggattaaagcacggtggctaccattaaggttttctttttcttttagaacgactagtcctctcacgcatattcctttactaccaaagtaacgcatatacgtggaccttttcagcatacttcttttcctctatcaaaaagccaataccgacgctcgcttatcagcgaagttctatcgatagagcaagaaaaaattacaagattacaaccagaggagatcataaccagaaaaacgaaaaaagtataccaccacctacacaccgacagcgccaacacacagacccaagagaagttgctaccattaaggtgaacccttcagttttgtttctgtgcttcctagatttgtggcataacgaacgtttgggtttctgactatacatgcatgctgaagatggccaattcttggtttcctgctggcagttcgttagtgtacctctgggttaattcggccacattttgggcctggtttacaccaatggtggaaaagaacactcatctagcggttcacatcaaagatagatcatgttgatccaacggctaacacaattttgatgatgtgccaaaccatggaggatgctttatagtaattaatactttttagaagaaagggtaagttgtttcttttttccgttcaatcaagtctttttttttatttttatgtttggaattatggttggtcgatccacaacacatctcctgaacataagcacccggagactggcatctcataaagatatttctagataacacatattggttagaacaaacatatcaggtatcataattaatttcagtcctcagctgctcgatgcagtactttttttttttgcggggaagctcgatgcagtatatgattattactgatcaatcacttgttaattgtgaacctctgtgcacctttggtggtgtgcagtttggtaagcatccctcgagtgttggatagcagagctggtccagcgaacagcaatagaacccaccacgggtttgaacgcaatgatccggtttataatcaagtcccagaaatccgtttctgccttttactcccatcagcaaatcacttctgatcttgtttgtgttttgacctattgatgtataagaagtagtatgtttatcatgccggtgcaaagaaaatgaggaaaataacacacaggtaactgaaaaagcaatccaagtttcgaaattaattacctcttatttgtgcaggaatagcagagcacaccagaagaaccaagaaaaataacataactccttggtgggtgtaagtcatacattttgccattgcgtatgacgagttactaatactatgctacttttcttgttgtgactaataagttcagtgagatgagtctgcatctcaggagccatgggtcacacatatatatagaataacaagctgttatgtatggaagaacttaatgattatttactttcatatcttgaggattttactctataagattctggtagattgtcctgagatatagctctaatagcacgtccgacaatgcactatatcttatccttgtctgatttgttattaaagccattttggatctcgtagattatcctaattaaaatctactttctatagcatggataaatatatcaggtatctattgctacttaaattgtagtacttttgatagcacagctaaacatagcaggtgtcttatcccaaagtctattatcaattactccctcattccctaaatgtttgacgttgttgactcttttaaatatgtttgaccgttcatcttatttaaaaacttttgtgaaatatttaaaactatatgtatacataaaagtatatttaacaataaatcaaatgataggaaaagaattaataattacttaaattttttgaataagacaaacggtaaaatatttttaaaaaagtcaacggcgtcaaacattttgagatggagggagtacattgcacttccaaacacgtgttttcaaaatgttccacgctggtttatgaaaatggaaacatcagtgttttattctttgtctagctagctgttaaagtacaaattcccctataatattatttggggtattaccatttactaatgtcgagttgcgtattctttggtttccttcttatgcacaacttgtcattagtgaagaaccatatgaaaaatatttccatggggaaacattgacctaacaatataaacattgaccaaaccatgatttgttcacttcagttggagatggagcgattttgtatgaattatcaaagtgttggtattatcaaagaatgtggaaaaaaggtttccataggtagtacaggcagttcatcaggacagcggcctgcattaaattattgggttattagtgctagcggctccttaaaaaaaacgcccacactactttttcaagcgattgtcatacttgctgaattatcctccgatggatattataactacgaaaattaaccaacacccactgaacataaactactcaaattttctgtcgtttagtcagaagtgatcgaaataacgaactctagttcatagatgactaggagtagtttggttgggagacgattcgagtttagaaccagcctgtgcctgcaggagtgtcttcagaattttgtagtgattcttgtatctttccaagtttgtacatttcagtcaatatatttcctagatttcatatttccatgtatctttttttgtaattactttctctgtgtatattgtgtgctgaattattcttcgatcgaaaaattggttgttcaccatgtgtattagagtaggaatctgtggtttagagtttacaagcttcttgctcattcttagttcacctagctaagtcttggagtcttctgttttgatcgttgggagtactttcgtgtatgaccaaggcatagtggcctggccatatagttccaaggaaggttaactagacaaacagacgtacgtagtcggcagggtggtgacagccccatcatcctttgtggttgtccatggtaggtcaagtacgttggcattagagatcagggatcccagctcaccgattgttggaacatgtcccctgtaataccagtcatgctgagataacttgagccaaaatacctgggagtcagaagactcctatgaaactcctgaactagatatgtacgttcgccccttataaactcatttgaaactcccgtgttatatatcatatatgtattataaaggatcgtacccccgcgtgtggatagtataaatatccttagacaagcaaggtagaaagaaggtaacattataagccatccatgggtccgtgtggagaatataaatatgataccccggaataatccgaggtaaagtgctaaatcactaattgcgtgcgcttgcggaacatttttatgaaagcagcatttctagtatcattgttgtttgtacttttaaagttgccttgataagtcgaaacttgtgtattttcttagcaagttcatgctagaaaccaggtgtccctacctatgcccacggcatcaaccatgataaaccaaggctgagtttctccttattgagaaagatagtttcttgacgcggcgtgccaacttgcattgcctaatctgacacagtcagcaacagggcaccttgacatccctgtacccgcaaggtttgcttcttccttcttcttggcctcttgggtgctcatcatttcgtagagtagtgaccaaattcattatagttaaaatagcggatatggatcttgccacggccaccaccacctaaaagcctgcataatctttgcgtggttggtcgctacaccaccctttgcatggaccatgccacgccctcgactgccttggtcacggatcccactttctgtaggagcttttttctttcaggttgatagtaagtggatgctgttcttgaagcacacctcccactgggccagagtggcagagtgaggagcacctggatgtccgcactcatgccgatggtgatactcttctcgcgtgcgttctcctcgaacatcttcaggtgctgccgatcatcaccttggtatcgaatagcttcctcactagtgaagtgtcactcagggtacccccaagatggactagcacactgacatggccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32655 - DNA, 518 bp, Oryza sativa
gcagcccctcaaaactctagaacactcggacgtccacttgaacttttcttctttcttaagcaactgagtcataggtctggcaatcctagagaaattttcaatgaaccgacggtaataacccgcaagtccaaggaaactccgaatctgtgacattgccttaggcggggtccacttggtaactgactccacattcgacggatcgactgccacgccctgagctgtaatgacgtgacccaagaatttgacctccgataaccaaaagtcgcatttactgaacttggcatataactggtgctccttcaacttctcgagtaccagacgaagatgttgctcatgttcttcttcagactttgaatagatgagtatgtcatcaatttataccacaacaaacttatccagaaattccatgaacaccttgttcatcaggttcatgaagaatgcaggtgcattggtaagtccaaaagacatgacagtgcactcatacaacccataccgagtggtgaaggctgtcttggaaa

SEQ ID NO: 32656 - DNA, 1569 bp, Oryza sativa
caaaaggcttgttatacatatcagtgctataggcagcatcaaacataatgagatctccgaaaatatcatactcgatcctcaatcttgcatcagtccagaagatgcttgtaactgtgttgtcctcatctttttgcattacgtacagaaattctgggttttgaatctgcaattctgtgaagtgcttcaatgcgctttcaacatctgagtttgcttttctatgttctgtctgtgctatgttgtgctcatctttattttcaaatggtatgtctccgaaacaaactcttagtttcctgaaaatcttcataattttcttaggaggtaccctattttgttgcagaactcttaaaaatgacttctctccagttgacatttgtttgtggtctactatgaatcttgcaagcaaagggcttgggcataacggatgattgtgctcatggcgaactgctgtgaactcccattctcccttatcgagtttcactatcacccttgccttgcattgtgtcttctctacaagattgcttctcctcttcttcattgggttttcagatgacttcgttaacttcattttgccactcttgttgcattctaagtgaaacttctttctcttgtagttggttcccctctttcctacaaaaccagtaaggagagcatgtgcgtaatagaatctttgtgcggcttgaagggatggaaatttcattccgggttctggtggtcttgaattcttcagttcgtcgaaactaggatagaagtacttcccaagctccttatccgactcatcacctgagctgctgtctgaattgctttcactgcttgtatcctcgcttggcgcttcactgctttccacattatcatgtgatctgttatgctcttcagtatgctgaagtgaatggtctatcgagcttgtttggtctcccaatttatctacaattggtcgttctgtatttttgtctatgccatttgaagattgctcctgcatgcaagagaataacttacgttaagctactatttgataccttattattggtactcttgttagatttcaccttttcatacctgataatcaccagctcgctgtagtttgtcaacaggttccttctctacagtagatatactaatctctgcatgtctaagcatccttttgttgtttacctgaggtacaaccaggataacagatcattaaaaaatcacttccatcacatgtatacaaaacaaaaatatctggggaacctttgttagcaagcttacttcatttgaatcagctgaaataaagttgcgacaaccgttcctcaaaattatctgcctgtgtcagttggtcactatttctctgaacatccaactgtttctggcttggaggatttcgcctgcgtttgcgctttgagaatctaagcgaatagctaggacacaatggatggttgtgttcattccggactgctgcatactcccattgtcccttattgagcttcactaccacctttgcctgccattgagtcctctctataatatttttcttcctcttcctctgtgggttcggagttagctttgatgtgccagtcttgtggcactctatgg

SEQ ID NO: 32657 - DNA, 2254 bp, Oryza sativa
ccaattccattaaactaggactatagtgtgctccaagccctttatctgattcatttcctaggcttctgtcagaatcgccatcactgtttctatcatcgcttgacacttcattgctttccatattatcatgtgattggttttgtccatcagtatgctgcagtgattggtccattgagttggtttgtctccctaattgatccacgtatagttgttctgcagttttgtctatgccatttgaagatagcagctgcacgcatgcaattgaatatttcttgttaaggtagctattcactgccatattcaaatgtccatattaaacctctccataagcattgtctggttttcatacctgatagccatcaccagcgagctgcagtcttccttctgttatcacttgcttctcaacaggtttctgcatttcgtttcgcagttaatgccaggcacaaagtgattctaaaaagtcaaagtgattctaaataccttgatcaactcaactggagttatcaccgtttgcccatcattgttactggtctgtaatacatgtatgtgagacaaagcaattagccaagtctttgttactacctatagctgcattttgccaaatttatgtatgtcattgtctgatggatgaacgcggtacgtaaacagataatgttcaagttaaaccttttcgccgcgcaactctggttggcaccaggcttgtacaggagaaatttcattccccagattgtttacacgagcaaaaacctggagaacagatctcttaaaaaggtcaatttcaccgaaagcacttaaccgattccaattctctgcaattctctgcaaaagatgcaatggcgagggtacatacattggctatatatatgtgaagcgatctcacctgttcggaatcaactggaaggatgtgcatcagcacgtcctccatgggaggagggccggcccgtgccagcagctcatcatctccaccatgaacaagtgcctgtttctggattggatttgggaggagacgaaatcaatcaaaaacccccctcacagcacagcatctactacctcgcacgggaagttgcggagaacagagtggaaatcgcgagttgcgcgcgtcttcgaccgtacctcatacatgtcgggaggagaaaaaaggcatcatcactccatagcccgcacggcgttcgttcgtggacaccccacctcccgccgccgccgccgccgccggtgacggagattgcgccgccgcgtgaggaggcagcagcgggtagggagggcggagatgaatcgattcccttcccggagaagggcggaggagagggctagggttcgcggttcccggcggcgaggatgctagggcatcgagaagggaacagcggccgcggctgccggggggacaggagagttttttcttttttcttttttcctttctcttcttttgtttttttcgtgagaaacaagcccatacatctggcttggtcggtggatgggccgggccgcttgtgcttcgtgggccgttgccatctgcggccgaaataagtccaccggcctttcctcaactttacgtcgagtccgcatgcgagaatgctattgggcgatcagtcgcgcgcctccctccccgcgcgactggagatgagagggggcggcgacgcgccgcgagcgagtttttcgttttttccttttttttcgtttctgtttgttttgtttttttctccggtttttatttttctgtttggatttttttctctggttttttctggtcggtttgttttttcccagtttatcttcttttggttttttctttttttaagatgtataaatataaagtttgtattcgtatatataccaagtttgtattcgtacgtatagaactttctatacgcgcatacaaactttctatacgcatatacaaactttctatatgcgcatataaactttttatacacgcatataaactttctataggtgtatacaaactttctataggcgtatacaaactttctatacatgtatacaaactttttatacgtgtatacaaagtttatatacgcgtatacaaactttctatacgttatgtattttctattttttttattttttagtacgtatacaaactttgtgtatgtgtgtatatattctttatgcattaaaatatattcgtatatatatatatatatatatatatattatatatatatatatagtatatacatacgtatatacataagacgtatatacataagatgtatacagtagctggggggggggg

SEQ ID NO: 32658 - DNA, 1749 bp, Oryza sativa
  unsure (1)..(1749): unsure at all n locations
ggttggacggccgtgatcgcttcaagatccgtgcaggttgttgctcgtattaaaaatctagctcttttttattaaaaaaaatatttaggaacaactttggttattcagaaacagagtacatgatggatgatatagattgcagtagagaaataatatctaagatttcttgcatgacaacttctattaggataagtgatgtgagatatgttgtgtcgatcatgaagaggtatgggcggctgataagattttacttaactagcttgtctgccaccctattgatctcccttggaatccacatgacctccatggaaccttctagaatatttgtttgactccaatggcctggatcctcatcaaatgggcctgtttagttcgctaaaagagaatttttaggtgtcacatcagacgtttgaccagatgtcggaagggattttcggacatgaatgaaaaaactaatttcataactcgcctggaaaccgcgagacgaatcttttgagcctaattaatctgtcattagtacatgtgggttactatagcacttacggctaatcatgaattaattagactcaaaagattcgtctcgtgatttccccactaactgtgtaattagttttcaaatttatctatatttaatactccatgcatgtgttcaaagattcgatgtgatgtttttggaaaaaagttttgggaacgaaacaggaccaaagtttctcttcttggctgtgtctgcattcactactacatgatagattttcctgtacgccaccccttttgtttccaagcggttcgtaagtggaacagcacggaaaaataaggggaccggcgcggggctgtcacccgcacaggaaaatcgattttctcaggcgggcctcctaatctgaccgcacgggataatcatcattatctcatgcggtcgatttaagtggacctgcactgactaaacatctgattatttctctgtacaagnctttttaagtggaccgcacaggaaaatacctccctccttcccacccatccacttcaaaattttcacatcctctctctcttactttatcccctattatctctaaactaccccctctctctctactttatctttcctttctctaccttatctcttccccagtcaactccctccacaccttccactcctcctccccctctcctcctccccttcccctctgtcaggccggcgaggcgacaaacggagctaggcggcagaccggtgcggcgagcgggcgaggcggcggctggtcgcggcgacagctgggcgcggcggcgagcgggcgaggcggtggccgggtgaggcgacggccgggcgaggcgacaaagaagcggatccatagagtcaatggcctcgacgataccgcccaccaccaccgcaagccatccccgccgttcgtcgctgctacctcgagaggcgcggcggtagcttggctcagcggctgctcgccctcgccgctgcctcgggaggcccgcctcgatgacgacgacctcgacgtatggctgacctcggcgagctcgcgacaacgttgacgggctcgggggagacggatccgttgacggtgggcgtagtagaagcggatccgtcgccgatgagcttgcggtggcgacggccggatgcgggtgggcggcgattttcgattttttttttatttttggtatttttggttccgtgcgggcggcattatttgactgcacgtgataatcgattatcccgtgcggtccacttaacccgaccgcacagaa

SEQ ID NO: 32659 - DNA, 2553 bp, Oryza sativa
  unsure (1)..(2553): unsure at all n locations
ttgcaaggggtgggggtgaaacctgtggtgtggtgtgcttggttagagggggttatgcgaagggtcctgtcacggtctctatccggtatgtagtggtggcatgtcggtgcacagaaacgtgttgtggggctgtgtcttgtgggtacatgtcacgcccgaatttctatcgaaaattccaaacgctttnacatgtgtgtaaaccctcgtccaggaatcagccgaggcacacaataacaaagataatagagtaccattattactctaattaataagcgaataaaatgtcattacagaggtagatagttcctctcaatcaataaagatctaagcagcggaaaataagataaactgcgcagacgactccactccacaggcaacttgaccagggctacacctaatcctccacaccatcagcatcactgtagaactcctcctctgatgaatgattgcaaggtgagtatatgacatactcagcaagccatgcagcagatatgcaagtgcaaaggatagcaaaggatggcataatatagtctcattttgcataaatagcatttaataaatctttcagaatttaataaaacagtaaagtattaattaaacaatattaattcaacgctatacaacatacccgttgcataggcccaaccattctgaacaaccaatcctggcttctatcagcaaaccaggaatataccattccaaaccaggagctaaacaaattattaccaattacagcatcatttattatagtgagaggtgtaatactaatcacgaaagacattgttaaacccgcccatcaccgcgggcacgactattcgaatagttttactctggccagaggtgtaccactgtacccacaagacacaacctcaacatcatgtcaaccatgcatcgcgatacttaacaagtacccgaatagagattgtgacaataccctctatataacacaattcaaagcagtgcaccgttcccggatcataatcacccccttgtaaacaaggcatggactccccagcgacccccgtgggcttatttccgccacttcacagtctgttgctctacaatgaaccatactgtacagaaaataaagccgttgcccacgctggcttgtggttggcacggtaaatgtttcacaaccgaaaatcgtgaaccggtccttaattgtcatgagcacgaccatcaaaaccatgtgctcacaacccacctttatcaggttttagttggcaaattaattaattaaccaatcagattaaccatcgtgagctatcattaaaccatgattaaataataatgaatcataagtatcccatttatatgagctagtgtctctaagcatggctaagcatcctattcactttaggtaaaaccatataatgttctagctaatcatattattacccaagtgacaaagaataggtaatcaataacaaaagggctataacaaagcaataggttatctccacccaatgacattcgaaaataaatgcaatagttgaatagaaacaatagctttaaacgggatcaacatgctcaaagggttgtttgggatctgtgtgacctgccttgctggccttggaactcttcaaattcttctcctgcgaaatcggactctccgggaatgtcggaatctaaacagaaaagagcaaaatcaccaaaacaacacataaaaaagcatgaacagtatatgtggatatttttaacatgtagatctcaattttagaaaaatttagagacttgaaccaactaaatccgagctaagatgaattagttatgaatttttaaagattaaatcggattaaatcatttatatagattttaattgaattatgacgcaatatagaattatttttgaaaaggaaaaatgaattattgcgtcatcgggctcggctcacggtggaccgggtgcacggcggcggtctacggaacgaacggccgagatctatcctatccaaaacggacggccgagacaacttgatctaccgcggtctacggggaaacaacgacgacgacgtcagcggtgacgtcatcaccggcggcgactcggcctcgcacgctcgccggtgaatgacggcgcggcggcgtaaacggagggtatctacgcgtagagggcgacgcggcgaactcaccggtgacccaaacgacggtggacggcaaccggacggcgacggcgacgaggatgaagcggcggcgacgatcgggtcaacgatgacggcagtgctccggcaatcctcggcagaaacggagggcgggacgaggacggcgacgacttggcgatcccaacagcggccttcccgagcgacggtgacgaccggagcgacggcggcgcacggctggacaagcggcagcgactgcggcgcacgggttctagcggaggcagcgctacaggcggcggcgggctaaggcgatggtggcggcggagagaggaggtcccgggggtccttaaataggggctagagggcggcgacggaggcccatggcgaccggcgacagcgatggaaagttagggttcgggagagagagacgaatccgattcgagatcgaatccggctattt

SEQ ID NO: 32660 - DNA, 3520 bp, Oryza sativa
accatcgggcctagcaaggcttggttgcttcagttcactataagtaaataacttgttattatcatacatgcttagtttgtgatcaacaaattgttttgtagtaacatttcattattaattgtaggcggaccatctccaccctgacgctgatgattactcggtccgacgctcccttgagacgtacctgctgtggttgttcgggtgggtgatgttcactagcacccacgggcacgctatggactgctggctggtccactacgcacggtccatcgcggatgctcagccacaggacgtgccgcagtggagctggggttctgccgtgctaacagccacgtaccgtgccctctgtgaggcatgcacgaagaccgacgcgggagcgatcttcgctggttgtcctatgttgcttcagctttgggtagccaagaggtttgccataggtcgaccagtggtggacagcgcaccctacggggttggtcgcagcgcgaagtggctagaggacggtcccacaatggggacttactggtgtcgacgtggggttagtggaactttgctgcgttataagtttatcagtcgtcttctttttttatcatcacataacatgtctaattccgatcatgtttattccaacgtcgttacgctcacgtccaggtgagacgagattacccggacttcgtgtttgagtttacgcagcgccgggacgtcgtacctccagctggtctggtacaaccacggcctcgcgcgcctaccgtcggagtaggacctcgacctacggcaccggtttcgcacggtactgctcagaccagaggtttcttaagttttgtttctgtttttgtacgaaaacctcaccccgtcgtaacttgacgttccatcctcgcaggacctcgtttgccttcgagcgcccctagcatcggagcagtgcgacctacagcaccggtttcgcatggtactgctcagcttagaggttagttcatttttgtttcagtttttgcacgaaaacgtcaccacgttttaactgcacgttccatcatcgcaggacctcgtctgccttcgagcgcgtttgcaagcacgaccgacgctttcgcgagctcttcaggggcgttcgccagcacttccggcgcgttcgccacctcttcctctcacggagcgtcgatccctcgcccacacggtactttaatttttgttactactattaaatacctgtatgaaactgatggtccttgtccagcaggatttccagctgggatcttcggtacaggtgcctcttcctctcacgccggtggtctggtcctactagccagttctacgacgatgacttgcacgatgcgcacgaccacgacatactaggctcctctcagcttggaggagctccagaggcgcacactcaggagcagccaaaggtcacacctatacaggcaggacgggttggccgtgccataccaccggaccgactcacgtactcctaggggcacgttagggcacagggtaggagggacaggggtaagaggcctcgtcagtagtgttctacaccttcagtgcttatgtgaccctttcttttggcttacaaatatgtaaagcagtactacttttgcttttactactgcagtactacttgtgtttctctcgcctatatagttgttttcattcatatggtgctagaacaacttatgctcacgaaaacacactttcggcgcttcacggtagtgtcagatccactagctgcacagtccaccacagcacacatgaaaagcgccagctcgagtagtcactatcaactttcggtgctgcctgctgacataaagtgaatcacgcccgcgcgtgctcgtcttgtcacatctaatgaataatgtatatcattaagtgcacaaatattgcactgaaaacaagctgaaggcaacctcttcatatcttctttccaactagcacacacctaacgagaatggaagcgccattacttgagcgtctcaactggcgaagcgatcctttcgctggttggtttctaccatggtgtgaccgtcctttgtgcgattgtggagatggatgcatactcaagtcttccctcatgatacaaactcggggcaagagattcttccaatgcacgaactttgatcaggtatgattcatctattcgaagttcaaatggataaaaactaacttcttcgtacacaatcgtaacatcttacgcagacatatcgtccaatgtgcaacttcatcgagtgggtagacatggagaacccacaaaacgacggaacacgtgcatacccatgtagtgaaacaagatcggactacctaaggcggaaggatgagcatgaacgccgaattgctgctgaggctttagaatggcaggtaaatcccctaggactccccacgtagcgtgagtgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctctgtactatcattaacttaactatccccacaatggatgtacataggaggatgtaaggaaatgtcaattcgtacaatggattgacacagtcagagttacttccagtggcgggccgataacgtaacctgaaccgaccacacagttcattcatgcttggatggagtacgaacgtcgggtgaaaattgcaagcttagactggaggaacaatccattagggttacctagctggtccgagcgtccaaagtgtgggtgcagagatcgctgccaagtggctaccacatttgcagaacagacatttggaaggagatattttgtctgccccaatgtagacaacaatttcgttgtatgtctaaccgtttccaaaatctgctatgatttgcacaaaatttctacccaaactgaataacattactattttttcatggcaatccaaggatgtgtggatttactcggtggatcgacaatgtcactccatcatatcatggccaaaagatagcagagtcagaaacacaagtagagtatcaacgattgaaggaccacgagaatgcaatgcatattgaccaacctagaaggggctgataggttaccacaggctagattcgtcgggaccgacaaatttgtatcgtgtatcgatggcacttcttacctatcttatcattacaatgtttaattatgatggtgtatttttgtatgcgtaagactaaaaaataataaaattggattttaccaatctttgagattttaatcttgtattgagttttcaatataaaagattggataactattgataattataaaaatatctatttctcaaataaagggttgcacagtgtaaaatcgccctcccccagggcggaaagggggccgcctgcaaaattccaggccccctcgccgcccatttgcaggcggccccccgcacaatgtaaaatcgccctcccccagggcggaaagggggccgcctgcaaatttccatgcccccctcgccgcccatttgcaggcggccc

SEQ ID NO: 32661 - DNA, 4713 bp, Oryza sativa
ggggcacggcagcgccgtcgactggtggacgttcggcgtgttcctgtacgagctgctgcacgggacgacgccgttcaagggctccggcaaccgcgccacgctgttcaacgtcgtcggccagccgctccggttcccggacgcgccggcggccagcgccgccgccagggacctcatccgcggcctgctcgtcaaggagccccagtccaggctcgcctaccgccgcggcgccaccgaggtcaagcagcacccgttcttcgacggcgtcaactgggcgctggtcaggagcgccatgccaccctacatcccggaggcggacgtcgccgccgccgccgtggactgccgctcgccgctcgcgcgcgcgacgcagggcggcggaacgccgaagaagagcgccgccggtgggaaggccagctcgccacgggatgatccgtcctacgttgaattcgagtacttctaggagaaaagatcgattattatcgcgttaattgttttttcgttggatttttgtatttcatatatttgctcggatctttcatgtgaaatatgccaaagttaaggcatgctgtgcttaattatgtagattgtcctctttcttaaactgagatttttttgccgattcctgcagaaattataacactgtaaaattccaatgaaatcatgcactccaaaggacgaaaaggatatttagcgagagatcatgtgtgggatcggattgtgatcagatcggaatttcagtttttgacaaccactgcttaagaccctgtttagatggaattaaaattgtttggacacgaattataaatattaaacttagagtgttaataaaacccatccataatcttggactaattcgcgagacgaatctattgagcctaattaatccatgatttacatatatgatgctacagtaaacattctctaattatggattaattaggcttaaaaaatttgtctcacaaattagctttcatttatgtaattagttttggaaggagtctatatttaatactctaaattagtgtctaaatacagagactaaagttaagtccctggatccaaacaccaccttatcctaatttctttttcgagtttccgcaaggtctccatttttttcttcaaactttccccacgctgtcctattttgtgtgatttttataggttggacctttgaaactagtaaggccgaccctatttgatttgttttttacttttgaattaccagaaaaaagcccgtgtattgcaacgggtaaaatccattttaatcttattattgttatatggtttagttaagatgaaatttatggaaattcacttggatatatatttttagaaaataatgagctgcaattaggagtccgttcgtctaaagttaccatgcgagttttcttatacgactccttctgtatttccaaaagcgaacgaacttaaaaaccgattcaaatacgtatatgtatttctaacagcaaacgaacttaaaaactgactcaaatacggatatgtatttccaaaagcgaacgaactaacaaccgacttatacatggatgacgtaccaaagtatcggtaaaaacatcttcaatttttataatagtagatattataatttatttatttacttttatgatgaccaacaaacatataataatatcatatttaaaataaaattttatatgtataaaattgtatgcataaagtttacatgttcaaagtatcaacgaataaagtttatataccaaatattttattataaagtttttttgtcaatttttttaagtataaagtttatatacctaatgtttctattttgtatgtataaactttttatatagagctttgatgtataatatttttgggccaatgtaaatacaaataaatgtgtgggtatttttcctagtttacacgtgggccacaagggagagggggggagtgggcagagcggtcaaccgcataatagacccttcaaagaaggctatttagtgtcccaaaatgttagcattgtggttgatttttttttccactggaccggcaaaagccagccaaaactttattgagatgcaaggaataaaaggtaacaaagtaacaagcaaggctattgaagaaaaaaatcgagaaaacacagtaaaccccctcccaacgctagaagtgaacactaaaaaaaaaaatttacaccgccatcctgatcaacatagcttcgtgtcaactccacaactcttccatgatcttatccacaacagtactaggcgaggaagatattgcccgaaaatcctttcgcttcactcttttcaaatgaaccaagtgaccaagattactatcgagttgaaaaaacttctgggttagtttggttagtggcctaaattgactttactaattttcttgtcaatgctaaattttagaaaatttagcatggctaattttaacaaagcatagctctgttaggattgaagtcaattttttgtttttttcaccttcatgttgatattctatacatcagtttaagattcagatcaccaagacatgcaaaagccaacatcttaattctttgataattctatgttttgcaactaataagcaattggttggctatcggcaaatgtggttctataaaataccatagcataaagtattttcttacctcattttgccattgtagttagtcttctgtcaatagcgctctattaacacagttgcaaaatggccattttacccccaacaagtgtatctcagtccaagaagtgctttatgttttctaggtgtaacatggactattaaatggtcatggaaattccggatagtccaagcaccgtttccgtataaaaggcactgttattacccttttcgttatatataaattttattctttctaacttctttctacatctgagtagtttaaatgataatcatggtcaattaccgattgatcgagcgttgtttccaaagaaatgctaccaattccgactgtttcacccctctatttgcataagattaattaacgagagactgacgtagatgacaaaagaagaaaagaaaaggcttatacactggcatttttcataaaaccttagttagatgatggcaaaacatagaacttactgttcaatggcaattgacaaaaacaaaattcttagagattcttccttatgcgtttgaaaagttacagtgatctgagtagtacccaaaggtcctgagttcaaatctcctatggagcgaatttcaaattgggttgtttgcggggctaagttccctatctcaatggccgtatatatccggttggatatggaggccgggtagaaaatacccttctctaaaaaaaattataaaaaaaatgcgtttgaaaagttagtgccctgaatggtcttaagtccagttgatctggcccaagatggggaaatatagtcatgcctaaacagcagcaatcaggaagcttcagcccagctgatacaactggggcttttcatctttttaatgatgagctgggcttttggtttcgtccaaacgcaatagaaaaaatacaacataatttgattacatttgctccattttttctgtcctggggacagttaactctttttaaacgttttcctcattatcctaactgaaacattaatactataataatttacatatatatagttaatcattcaaaaacacacatataattaatctataccatttttatagacctataaaacaagtgtgatgagaacgactgaacaacgtcctagatcctatgcattacagcataaaatgatcactgtagcaatagggaaaatacgtctgctacagtaatctaacgcgtgagtaagcagcgtcgttgtactgtatgcccccggaaataatgtacctctgttccagaatataataagttttagagatagatatgattattaagagaataggtaaaattaagtatggagggatgttgtgatcggttgagaaatagagctagacagaaaaattaaatggtggaggattgtgattggtttggaagatatattggtaaaaaggtgaacactagtacagaatggattttttttcctggcggccaatttgcgttttctatagtggccgacgttgccaccaatgactaaagaccaatgaaaatcaaccatcttcacaaacggttaggttaagctgactgtcagggttacgggtaaggtataccctctacccttcgatatatgtcacatatcgatatggtatacttgcacgtatacggacgttttcggcataagttaaggaaattcattatggagttcacagatgtaaggagtcctactcggatagaactgggtcgtcattgtatcatattgggtccgatgtctccgagtcttacttgaagaccagttgacctgcggtataaaagggaccccccggaggacctaaggcatcgaatcttaccgccaacatatccaccacagcctacgaagccggagcttacaggagccaagtcgccgggtgatctagtcgaatcaactcgactacgatctcgtcggtatcgtcgagttccactattccctttgtaatctgtggtttccatcatataatcccatatcaactggattagggctattacctatcaaggggcctgaaccagtataatctttgttttttgcctgcttgatgtcgtattacgtagatccttgtaccagcgtaccccaataccctctatatccggtctacgggtatcccccattgacactgaccatcaaggaaaaa

SEQ ID NO: 32662 - DNA, 1029 bp, Oryza sativa
atatgaaaaacccaatactatcgtatcaaaatttagtaatttaagagggtttcgcccttagaaactctgcaaaactttaataagggttcgaacaaaatagaaccaccaaaattaccaaaatttgacattttagtgtgattaaaaatgacagcataaactaaaccggatctagtatgcaactcaggccctgtttagttcccaaacaaaaatttttcaccctgtcacatcaaatgtttggacacatttatgtaatagacaaaaaaataattacacagattacgtgtaaattgcgtgacaaatcttttaagcctaattacgtcatgttgacactgtggtgctacaataaacatctgctaatgacagattaattaggtttaataaattcgtctcgtagtttacaggcggaatctgtaatttatttattattagactacgtttaatactttaaatatgtatccgtatccaatataacacgctaaaattttttgtcacgcgaactaaatagggcctcactttccattttcttctccgtttgaaacaggcaaaaacctttgcgtgtgagcgtgtcagacaggcgcaagaaggttcatttcgaattttgtagatggaaacatgcatggtaggagtacagaatatccccccacccaggcaagtaaccgccgagctaaccatcgatcgatggagccaagccaactagggtttccaaagccccaaatgcaacgtatactccactacgtactcgacttccatttcatcacgcatccacggtcaagaacagctggcgcggaatccaataatccaacgcacatatacacggaatcaaaggttggagatgccaaccgttgtctgtacgagaccaaaatcattggccaccaaccagccacagccgcccaaccgaactgatcaacccatgcgaaacacccatgttaatactactgctaagagcaacccgcaatggtaaagtaaggcgctatctataaaacatgtatatctcagcaatagactagattaatagtaacccacttcaat

SEQ ID NO: 32663 - DNA, 7125 bp, Oryza sativa
cctgcagcccgctaatgacgccctaatcctggattattaatgtaaccaaactcatcattgctaattattagtaaccgccagccatatgcatatgcacccaggctgcatccttgcattgcatgccaccgaactcgatcatgtttgttgtgtttatatatatgctcttttcctattgctaagtaagggatataagtggtcaactcgtaaacctacttagagcaaatttaatagtaaaccccactactagctccaattcatttatagccaatctaatagccaattcatacaatagttgcttactatactactaatatatggtcccacctgttatacacacattgcgtcttggagtccgtgctgcagctggctacagatctgtagcccgctgctcttctctctcatcttttatctcattaaaatatgtttacagctggctaatagcctgctattgtatctgctcttatagataaaattagtaggcaacctgcggattaactcacggttacctactaatttgatctattaatggttttaagggtcgatccacttgatgcgatacgccaggtcacaatgtggaaacctgcggattaccatttatttaacatataaataggtttatgagttagcccgtttgtatgcctagctaattttgtacactgatccgatcgaaaagaaaagaaggaaagctagcgcactgttaggttctttaaagaccaaaaggttaatacagtgcaccatcaatttaaatatttttattttgttgttcgatgtcgaacaatattgacttaaaaaaatcaattgttttatcaaatgtggacagactaacaaggactttgcagtaagaacaacacaaggcaaatgaacaatttttttttactgctaacagaactgattttacttctacatgacccaagggaaaaggcaggtactaacattagacctagaacaatcattccatcggccattcctaccgtcagagagtcttaagaaaagaaaaaactgtcagaaagttgagtcaggttactcacatgaccatgaacggtggcagccagcagccgatcgatcgaggacgcacagctctgcgctgagacacgcgactgctcgattgaaatcgaactacggttccctgaatttggctcagtgatctctcataaattagatttatttaatttttagaaaacttctatgcatatggttttcataaggcatatcgtttatcagtttaaaaagtagcatatgccaatagtgagatgttcatgatgatttcgttaatattaaaatatactgattcattgtctcagatgcgctaataaaagtaagatagtattaccatgtttttttaaagagaaaaaatgtacttcctccgtacttataaaggaatcgaagtcgttttggacagcgactcgatctacaaaacacaactttgactttttatttctataaaaatatttattgaaaagtgatatatgtactacctccgtcccaaaatataacaatttttagctaaaaatgtttatattttaggacgaaggaagtatacttttatgaaagtatttttcaagacaaatctattcatataatttttatattttcaaactcaacaacttaagagttatttataatttatattcttaagatttgactcaaatattattttaaacgattttttttttaaaaaaatatggagggagtatatatgcttaaaaaaacgatcgaacgcacgcgtcacccggtcactctgaatctgaccaaggcggcgccggaaacggagccgcggattgaaacgagatttcgggggagaggagcaacggcagccacggtggcaagcggcagcgtagccagcgaggccacgtggtcggcggtctcctccgtcccagcgccgggccccacccacccctcccccgccagtccaccaacacgaccgttgcctcctccccctcgccacgctccagcgccgcacggcatcggtggccgtgaggtggggaccgcgctcgtttgtggggcccacctgtcagcgcgtggggatgggcagcacgtatcacgcatcaatcttgggacaccgaggcgggcgcgaggccagacccgaccggcaactgaactggcagcgcattgccagctgtgcctgccaactgtgccacgcgctctgcccccgtaggtctgggatatttacgccatttgccactggtgacttgcctgattagcagaacagagatgggatctccgtgctgaagattagtaaaagcattgtgatagttatttgattattatttagagatgtaggggcagttcagattgatgctatttttaactatatcatttttttaagtaaaggtgtaaaaaaaattgtacatttagtttgttgccaaatttaataatacataagaaatcctatcatcttgccaatactaaaatttagtgatgtttattttagctacaatctgaacagcccgtaatggtaacaattgaaagcaaattcatcatgtactataacttttgtgacatcagtactatgctagtaccatattttcatcattaaatctacaattagcacataacggagattggatctccgtgctaaagattagtaaaagcactataataatgttatagacttaattgtttgattatgtagagttgtaatgataacagttaaaaccaaatatattacctaccataagtacgtagtactagtgctttgtaccattatcggttttgttcacattttgatcatctcctgcggtttctgcaatcttaaatcttgtagtcataccagcttataaacccattccagactaaacttagcatcatatgaatctggacacgtttacgatagaagggagtctaataaacattgcacataatcagtacgtagaccggagggcaaattggtcatgtaggccaacacacattctaatcatcatcgggcggttcaccatcctgcagaagctctgctggcctccggccctggccctggctggaattccgcccaattattagcggccagtggcattcccgcaattcctgacctcttctgctgcccctccccccctccatttctataactgcagccaccccagcggcgcccatcaaattctgcaaaaaccacaggccgcacagccacagcagcgtccacttcacgttccatcatctcctctacctccaaccacatcgttgcttagcctcgccaccgccgccgccgccgccgatcagtggtagatcgatcgatctagccggccatggattactggaagaccaaggttctgccgaagattaaggtcgtcttcgccaagggcggcaacgccaagaaggctgccgccgccgaactcatcaagtcgtttgatgaatctaaggtacgccgccgccgccgccgccgtcgtttgattcgtctggtcgatcgatctggttgattgcgatgagatgctgatgattgtggtggtggtggtgcaggaggggatcaacggcgagttcgaggagaagaaggctgacctccagcccaaggtcgtcgagatctacgaggctgctcctgcgccgctcaaggtaaatataattcagaaactaatcacacgccaaccgtatcatccgtcctactaattcagtagttaattaactcgatcagtgctgccaactgcacgtattagtttgcggtaattgagacttaggcccatctaatcatgcaactaatgaagtgatgatcctgatgtatcgatgcttggctgcatcatgctgcatgcgttctgtacgtctagtcgccctcgctggctcagtgatgagcagtgatgcgtcatgcatatgcatgtaccctacacatatgagtagtgatcagtaaaagactgccagccagctagcttagcttagctcatactatctgccaagtttacagctaattaagtataggtcactgaaacatttgatgtgtccatggttggcaggttctgatcaaggacagggccaaggtgtccgggatcaagaagaactccgccgccgtcaccaagttcgtcgacgatctcgccaaaatcggtaatatataatcaacaaacacatctcatcaaattcttttttaatataatttcgctgatcattaattagctacgtgaaattttcatggtggattgatcagagttccccggagcgaagcaactgagcgaggggatcgccaaggtcggcccggcgctgctctccggcccggtgttcgccaccttcgagaaggtctccacgttgctccccgccgacgaggaggagatcaagcccaaggaggctacggccgccgccgccgaagaggagaagaaggaggaagccgccgccgccgccgccgccaccgacgccgccggcgaggagaagaaggaagaagccgaggagaagaaagaagaagaggccgccgcccccgccgacgagccagctgcagccgccggtgagagcgcacctgccgccgccgaggccgagcccccagtcgaggccgcagcgacgccggcggccgctgaggcggcgccggcgaaggccgaggaggaggaggcaccaaaggcctaactagctatagctagctagggttcatcgccgccattattgatggacgcctcaagccctagctagagagggatgatcgatgtcgtcgttgtgccatgtcaccagtcaccaccaccattctttgctcttacacatatgcatgatgatgcagatattccattattgttgttcattatttttctctaccatttcttcccctctttatggttagacgtgtaagcctataatttttgtctgtacttaaattaattatatgcagtgtgaggacatgtatgtatggcatctgtatattatcgccagttttgttcatcttggaagcatatgcattattaattcattgattggttattgttctttctttcatgatatatctctataaatattctgaaaatttcaaaaggtttgcacaatcttttcttgcacatatgtccatgtatgtgtgcagttgttaacatgtaccattgaggcattgacacaatgaatcggtgctgtgttgatctgtttctttagcgttgggcatgcaacaatgtaaggggatggatggggcccagtggtcatgtgctccgtgagttgttgttttccgggcctgactgcttcgtgttggatcttctgtggtctactgctggactgggccatgtatgcgtgccagtttagtgagggcccactttgtcggggcatggtgcatgtgccaccgtgcagccttggatacctactccagctatgccatggatcttgctgactcgaccaaactttggaaatggcctattttcagtgtaagaatatgtataagttgggggggatgacaggtgggatattcaaccgttggaaagccacacttcagtgcatgcatagccgttcagacagctacaatcgtatacagtactctaatttgatccacggtactctgaatatggtatatggtatatgaaaaaaatatcattatagttcgcgttattggttggatgtcactgaaaaattttaaaattgaaactatgtcactcccatcactatttttgtcctcctctctcatgtcgtcatcctcaccgtcaccagtagatgacgcacatcgccgtggagaagtagcagcggcggcggcggtggcggcgatggcagcactccggcgtgtgttgatatttcttaaagtcattactaggaatatagtaattcccagcaatgactcttgaaacattactcggtattctttacggttacagatataatctgcaggcatacggatataccgctgtaacatttcaccggaaatattccaaggtatatatcgtatttatttaatcacaagggatgatatgataagagagtactatgctgataatttatatcacttatatagatcaaagtctaattcatgggttaattgattcaagaatatggtaggttgacacacaaaagaaactaaccagaatacttttattaaaataataatctaaactaagtggagaaaaaataagaaaaaaataatttctgaactctagtatagtcattttagtctacacttgctattttacaattatgcagccaatatccctaactatgccctcctggtatatcgagaaaccacccctaattgtcgagttccttacgataacccgtcgtggccatccaaccggtaatgaatacggaggagtacccacaccaggaaattctcttatattatatacgcatgtggaggaatactcgtactgagctgtcaccatcagcggcctacctgtatatagacccgtggcatataaccctatttaatgatatctgataatctaagcattgcgcttacattattaaatactactctacatctttgcagatcacatagagcaatatataaatgaacattaaaccaataccattgcatatctccagtaagctagctacataattattacgagacaagtataagctaaagccggtactcgaataattatataaatgaagtaaaggaccgaactatgacaagaagaataatttattaatgaattaagtcttacaagagagagaagagctactaaagccttatccgaaatctccgaaagacttcaaaaactaagagactgttctaattatactccactagcactagaacaaagtaaataaactagagagagctcttgattgcttcttcttggtgtgtgttggagtggagaaggtgagctccttttatagggttcatatgacagttgtggaattgtcagaaatgccccgcaaccgtctttgagaagctatcatggaattgtcagaaagggcctgatggcggttcggcttggttcaaccgaaccctgggccccacctcctggcctatcctttgtccaggaggctgactggtgggtccttatggcggttatgacccattttatggcggtttcacctgacctatgggcccttcaatacttgtacttgcgactgattggtcggaggtgtgtctttgatgttattttcttttattcttcctccgattatgtgaagttctcctgcaaacaatattttgccaagtataaatggaaatagattattcttaaacaaatatgcatgaagcattgctagttctcctttatttttggatatattgacggttggaattggtctataacg

SEQ ID NO: 32664 - DNA, 1349 bp, Oryza sativa
tgctctcacaaaataaactaaataggtggaatttgttttaggctgctccacagcttcacttcagatccgactcttagagttaaatttaggagttggagccctactaagcatgccctaaaccaaaaccttccattgaggcatttactattttgataaatatcaatggacgttcactacataaatatttggtcaaccctgtctaaagaatacctctaccctttttaggggtaaaccagccctagtaacttttatatttcattaactcccaataggaataagtccactttgactcccttgaatagaggtccaacattctaattcatatatcggttatctttaccaccaaactattaaaattggtgtaatttgcttctctcggctgctcttgagggcggtttcgctcatgtagcacgttgacttggtccaacctactaagttatcaatggggcccacatgcctcctttctttctcctctcctccactttccccacaccgctgagctatcagggagagccagtgatggcagtcgtcggcggcacgatggtgacgaggagtgtgacagcagtcggcaatggtgcatcgacggtttcgtcagcctcccatctcattgccactatcatcctcgttcacacctcctccttcctgatgaacgtgccacatcagcgaaaacccactctcaaaaccattaagggagtcaaactacacctgttttaataattgggaggtcaaaatatccagcattgcagatcaggggtacgaaccaaattagacctatattttgaggtagtcaaagtggacttattccctcctaatacaattgggcaggacaaaagtgcctctccatgctaaaaggaaaaggtacatcgaaggtacctcaacttgtcatcgagttacaaaatcgtcccccaaccgcaaaaccagatatagaacatccctcaacttacaaaaccattcactttaggtccttcggtggttttgaccccggttttgtctgacgtggcagctgagtcagcgtgggacccacaagggccccacatgttagggtgtccacatcagcgcccctctctttcccctctttctttctctctccctctctcacttttcacttttctcctctcttggcagccggccggcgggcggggaggaggtcgccggggcgaggcgggagaaggggagggcgccggctacgtgggagaaggggggagcacaggtgtcatgcccagaaattcacaaacaagaatttctaagctgaatgtgcattaaatccctgtccaggaccagccagggtatacaaacgataattgttgacatacagatccacgtcttacaaaaatataaaagattacaaa

SEQ ID NO: 32665 - DNA, 21208 bp, Oryza sativa
  unsure (1)..(21208): unsure at all n locations
gctatggcattgcagaagctgatgatgaagcaaaatcagaatcaaaggcagagctacttcctactattgttctatgtaaagataaaaagaagggaagattgaaaccaagaagagcaacatctcaaattctagagaagcctgaagattcaggttcagatgcactagtgcctgaagatatagatgacctgaaaataagatagttcagactctgattataggcagcctatagagcaagatagctctggagatgatgaagaagctgaacaacttaggaaatttgcaaagaaaatcaagagaaacattagggcaaggaagctaggagttcatagtagccaggctgtagagatacttgatgatgcactggtgcctgaaaatatcaacttagaagatgatggcagtgtgtattataactcaagtgatgactactcctatgaggagaatagtgaaggagaaacaattagatggaagagcactaataataggtttaacaaaaaaggcatcatttcctgtgttctctcttagcatggcatttagatcaagtaggcagttaaagaaggcactagtgaagtacgggctgacaacacacagacatattctattcccaaaggatgaaagggacaaggttagggcaacctgctattgaccaggatgtaaatggctaatatatgtgtcaaagacaagtaggtctaaatggttccaagtggccacttttaataatgagcattgttgtccacctaggagagataacaagctagtcacatccaggatcatcatgggagggctgggaattctcgaaatggaaaaattcacatctacgcttaggctacgatggttgtggctgtttgatacaagcagaccttgggagctgatggagatgccttgcaatatgcgagatgtacaactcttccaggcatgcacaaaaatcacagtaggagatggcaaaaaaaactcttttttggaaagacaattggttaccaggtttgtgcccgaaagatcttgctcccaacctcttcaaattggcaaaaataaagaataggaaggtggaaacataaatgatagacaacacctggctacattcttttagacagatcactaatatagaaaccatccatgaattagtgcaattgggatccctcctcaatcaaataactctttctgatcaacatcatgatgaaatatcttggacaagaaatgcctcatgaatcttctcggttaaaagcgcctgccgcttccaattcatgggttcggtgattgatcatattttcaacctaaattggaaggctcattcttcatcaaaaggctcttacagcagaaaacctgctaattagacactgggaatgcgactggatctgtactttatgcagagaagcttttgaagatacagaccatctgttttgccaatgcaacttcatcaagcaggtatgggcaagaattgccgctgaaaaagggattattcccaatcctaacatttccaccactaacagtggatgtgttctctagggtccactggccttaaaagccaaaccaggtcaaggatcggaatcctgttaaagacatggtggcatgtttggttgcaacaaaacggaaaaaaaaatcaattcccaagccccaagtctacaaagaacaatatcactcatcctcgacgacatacaggagcaggatatggttttcaaacctccatgaagggagaaagtcctgtactcattgctagagttggttgttttaagaatattttgtaatctcaactttgtaaacttggctttctaatctcctaaatatatctggctccttgctagagttggttgttttaagaatattttgtaatctcaactttgtaaacttggctttctaatctcctaaatatatccggcaaatcttttgccgctttcacttcaaaaaaaaacatccaggatcatagtaaataaatattttgatgttatcaaggataatccgacatggaaagtggaacatattaagaagtcagttctaaaggacatgcttgttgatgtgcccatttcaaagtgcaagcgggccaaagccttagtgctacaagaagcattggataaaactaggggagagtctcaagagtgtatgattatcaattggagttgttaaggagcaaccctgggagtattgtagttgtgacccttaatccagatatacttgacaagaaagtatttgagaggttttatgtatgctttgatgcttgcagaaaagggtttcttgctggttgtaggagagtaattgggctagatggttgtttcttcaagggtgcttgtaatggcgagctaatatgtgctattggaagagatgctaataattagatgtatcccattgcatgggcatcagtggagaaagaaatatatgattcatggtattggtttcttgggtagctaaaaaagatctcaatataaatgatggaggtgaaggatgggtgataatttctgaccagtaaaaggtatgctttttaactatttatcttttaacaaaatgtgcaatgggtcctaagttgtaataaatattttgaattacctgtcttgtagggactcataaaggcagtggctgagcttatcactagagtagaacataggatgtgtgcaaggcaaatatatgcaaactggagaaaaaaggacactgaccagaagcttcagaaaaaaatctaaaactgtgcaaagtcatcttgtagggagcttttcaactataatagagcaaagctagcacaagacacccctcaaggagccaaggacatgatgaccaccacacctgagcattggagcagggcattcttccagctagtgtcaaattgtgactccgctgataacaacatgtgtgagtctttcaacaactctattatggattcaaggttctttctagttatctctatgaatgaagccataagattcaaggttttttcaacattagctctctttgaccatgtcctgtacatattttttttctgaggctcagccctcaactctgctctatcaatatgtaaggcaaaacctcttcccttttgaaagttcaagtgctattaatttggttttggtgattaatgataaatccaattatatgagactaatttttttataagcattctttgcctagtgtcatgtggatatgaaagtgaagtttgtgataggtgattcccggacttcatatgagttgaaatagaaatgttaattgttcgtggacctaaatcacaaggatgaaatgcattgacctaaatcacatctttctctctatgcacatattgatatattcatatataatattttcatgtgattgacatatggatttgagactaatgttttgttgagccatatcttgtttagtctcttcacattgagaatatggagatgatgaaggtatgcttctaccttaatgtctacatatgataaataccttctattcttgtatagggtaagctcacgatgttttatctctagttatgcatactttttcttcacacacaaaaaaattgtatgcatacatttaggggggtaaatcctataccttagttatgcatgtattttgtcacatcctgattttcgtcttaggatttataaattatttaataaattattattagaatttatattaaatgttcattaatttacaagtgaagttaattgtggaaaataaaatttcctaaatataaagcatggatgtatttaatttttattaaattctccatggttaattatactctctggaattttctcggattttttggagctcaactcttaattttaatcatacaaagaacaattcagtaattatccacatattaaattaatcattaaatggtctgattataattttgttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattagggaaagtcctctcactctcggcctagtctcctctcagcttgcagtcctttccctctctttcccgaagtctgctttgtgtccctcctttaatcagtccttggaagtagaagcccagccgaaagtctagtttgcttccctgggcactgttcatcttcaagcttggacagaagcctgagccagccgtcctgtgcctggaatcgaattcgtttttgagtttatctctccaactaaccctcggtttttccggctcaaatcctctcggttggagtccgatctcttcaatccaagcctataaatagcatcccctagtcgccctctttcgtttgccccatctcccgagctctctcgtgcctcgtagtgccgccgccgcgccacccaaaccgccgccgtcgccggccggcgaacagccgcctcgcgccgtcgttttagccgtcgccgccgcctcctcacgccgccgtcgggtgcgcgtggaagaggggaagctccgccgcccttcgccgtcgccaccggtcgccggagagccgccgccgccgtccaccgaaccgccgccgccgcacaagctcgtcgccggtcgccatccgtggtcgttcgtcgcattggttagtaccggtgagatcgcgttgttctcctctacgcgtaggtgccctccaaaagtccggccgagtcccctagcgccggcgaggtcgtccccgatgacgagtcgacattgatgacgtcagcatgacgtcatagccttttctttttagtttttttaatagatgcaaatagtttaaaacttcggaaattcataactaattcatcgtagctccgattcgagtggttcaagttgctaagtttttctaaaatcaagatctacatgttaaaaatatccacatgtactgtttatgattgtttttgtactgttttgttgattttgttcatttgctttagtttccgtcgttccggaggagagcgttttcgttgaggaaggttctgaagtgtttgcggaagctcaaggcaagtcacccagatcccaaacaaccctttgaacatgttgaacccgtttaaagctaatgatttatttcaacttatgcattattttcgaatgtcatcgggtgatgagcctttcccaattaaataatggccgaacatgactttattttcctatgggttataatttgattagcttggaccttatatattggattggttcagctaaatgccatatgtatgtttgcttagtcatgcttaaacattagctaattaaaggggattaaatataaatcatattatattattattaattacggttatatttaatggtagctcacgatggttaatcgtgttatgttatgtaaattaattggtaattaaaactggattaaggtgggttgtgagcacatggttttgaaggtcgtgctcatgacaattaaggaccggttcgcgagctactgttgtgaaacatttaccgtgccaaccacaagccagtgtgagcaacggctttaccttttgtatagcatgattcattacggggcaccagactgtgaagcggcgagaagtccatgggggtcgctggggagtccattgcctttggttttgagggggagattatgatccaggaacggtgcactgtggtgagttgtgttgtgcgaggggtattgtcacagttcctttccgaggtaccgtggtggtgctaaggcgcatggtgacatgttgtgggattgcgtcttgtgggtacagtggtacacctctgatcaaagtaaaactattcgaatagccgtgtccgcggttatgggtgagttgagcaatgtttttcgtgattagtcccacattactcattaatgttaataatgtgataattaatttgactcctggtttggaatggataattcctggtttggaggtttgatctgtacgaccggggttggctgttcaggtttggttgggcctgtgcagcattggggtgctgttcagtgtcgattaaaattgatgattaattactctactgatttacttctaaatgtttgcttaatgctgctttcgcaaatgaacctatattatgccatcctttggtatccttgtgcatttgcatatttgctgtgtggcttgttgagtatgtcatatgctcattcttgcaataatcatcaaacctcagttgaagaaaaaggatccagaaggagaagatgtttggcttatactccagttgagctgcctgtgggagtggagctgaagccatcgctagaccgttaattccgctgctattttccttttcttttgtaagtatgtaacattattattatgatggatttgtatattaaattgtcagtttgtgtacctcggctgattcctggacgaggattttatgcacaaattagtttggaaattactagtgaatttctgggcgtgacatatttgatccaagtttttcacttgcatttaattgggatctttacatttgagtacatgacacttgtgatattggttaatactcatccacttccttttatatgcgcgattggttgatcaacatgtagaggttgacaaccagatcattgagaccaataatttcattgagttgaatgagaaacattggtcccaaggattgaaaaggtgttgatgctcaatcgatatcattacagctaaaatactaagaatgacagtggagatattgaagatgcggaatacgaagtggctattatggcaagacgatcttcaaatgattgatgctcggtcgcgatggaccatgtgacagtgaagggcaagcaaggggcttggcgccgaagagccaaatccggtggtgaatggcgagtgacagctttgtcatgatggaccgtgcgagaccatttgaagctacaagtaaccgcatcaattatttgaagaatatatggtgaaacggttttggcgttgctgttccttaagacaaaggaatgaagatgaaaagaaggcattccaattggtataattctcttcctatataaatttgagtatagtaatatcgtactatcaagagggatgcagcgtcgatgtgtttgtgtatgtttcggtgctcaaagtgaccaatcatagtgctaccttgagagacactcaagctttaacatatcctttgagtggttttaactttgtttttggttgagttaggtagtcctctaagtgagcttttcatagagttcaagatcatcaaaaacggactcccgagcgaaaacttatggtcgttttatcctgtgcttttcggaaattctgaaaatggctgcgaaactgagataggcttctgttgattttttgcacttgtccgaaaatgcattttggaaattccgaaaattacagtcttggcctccaccggctagttttgagaggcttgggtatgtaaactcttccgccctttaagtggctgctgttctggggcaatattagacacatgtaaagccaaatagctttttcccatttccctacctttgtggtgcctctttgtaagagggatttgagaaggggagagagttggattgagagagtgagaagttaagagctagcgagtttcactccatactttgagcacttgagttcatagcaaacaaatcttcagttgtgttagttactcttggggactaaggtctcctaaacggctaggtgttgccagtgagcgcccaagattgtggtgtgcctcgaaaagtttgcgaaggctttgatttcgcctctgtaagggaagaaatcaattgtgaaatcaaggagtgcatttgcacaacctcgtgaggaaagggttaaaataaacctagcctttgtggcccctcaacggagatgtaggatccgtggatctgaacttcgagaaacatatcaatgtgtctcctttcttgctttgcttattcttgtcatctctcatattgtgcttgagtttttttttatccaatcacttgtattcttaattaatatagttgatgaccttatatcttgcttcaatctcttgtttgtcaccttttgattcatatacattttatttgtttgagctacaagttcatagctagtgtgttgtttcgttatccgctgaattttcggttgaaactgaaactttcaatcccataccagaagttccgagttgaaccggaagttctcatcattctaatatattatgaagttgtgataatttttttaggaacgcctgttcacacctcccaggcgatatcaaggtccttttacctttccttaaaaaaagacgttgtattcatgcatattttgtgacagtgcattttcagaatcatgtgttccacgataactctgaatgctgaatataatgagttttatagctagacacggttattaacaaagtaggtagaattaaatagtggaagattgtgattggttgagaagtgaaggtagggaaattgaatggtggagggttgtgattggttgagaaggatatgttggtgaagatgttattatatttaggaacaaattatagaggctaaaagtttttatattttaggacggagggacgagggagtactgacttttgtaattctcttgtaggggtgaccaaaagagattcataatatgcagccacatcggacgtacacaaaatataactaaacttttttactgcagagcttataatatgcagtctctttggacagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgcatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtctttccattacgctctagtaacatctacaccttcatagctctgcactaataaaaattatttagggaaattaaatgacacaattgaaagagcatcgatctcccaagataaattatcaaattaatagtaggcccatttcaactggagatagccaagaaacgagatatccccaaaaaaaaagtaaattttgtacatgagtctagacaactataatatccagattaatatacaaaaaatattttatttagatgcaaaagggtatgtaacctagttgttgcaatgaactgagttataccccaaggtactgagttccccatagtaacgaatttcaaattagattatttgaaagaccaaattctcatttttttaaaaaaaattaaaaaaaacatttagaacggatttacggatggagtactgaggaagcacaatacaataacatatatagaaaagcatggagagcgtgtccaaggttttacaattaactactttatacttactcggcattacgggattccacacaatgtgggcacttcgtggttgtactggacgagtaagtttgcttggcccctccaaacggatttgcaaatgcaaccttcccgtgattgcaatcaacagaggatgtcgcagtttttgcgcaggtcattttatcacttgaataagggcatattttgctgttaaagtaccttgcagcctgcatgagaaaggttcagagatcagaacatgaattcggtataatattatatatatatatatatatatatatatatatatatatatatatatatatatatatatatatatatatatattatnccgaattcaaatgttcaatataaaacttgtagaagagaaaatattgttggtccctagtccaatgtaaaactctgataataaaagatatcctagtgtagaattcacaagaagaaatattattttcccataaatgtatacgaggtattgtttgacatgccactgttccatataaaacatactccctccatccgtgattgcagtggcgaaactaggatttgaatactgtcacgccctgaagttcttctccctagcaaaaatttaattaataaattgtcgcaagaaattatttgtttaaaggcaagagagaatttttcttggaatcggcatgtggaatttttcttggattctacatgtcaaaatatgctaacaggaattttagtggaattttcagagccttggaaataattttagtggaatcccaagaagttggaggatatacctatagtacaagagtatcctgaggtgttcccagaagacctcactacaatgccaccgaagagagaaatcgagttccagattgatctggcacccggaactgctccaatctacaagaggccgtacagaatggcagctaatgagctagcaaaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagcttaaaggagctaaggtgttttccaatatagacctgcgatcaggctatcatcagttgagaattcgggaagaggatattcccaagacagccttcgccactcggtcttgctctcttttcccccacacttaaagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgtttgtgtaccctggctggtcctggacaggggtttaatacacattcagcttagaaattcttagttggtatcagagccgaccttgaccgtaggacaagccaactggaaaccctaagagtcctcttaaaccttttcatttgcacatgccttttgcacttggatttgtttcggtataattttggggtttgctcttttgatttgtgggaaaaatcttgatcgctatttaatcgtatttctcggctagaggcagtctagggttctagcaaaactttatttggaatttatttggccttcagtcgggaatttgttaggtgatatgcactaagtcgtgtctagattcgatgggcatttttatgtgtatattatagctacgcatctattttgtgcattaatttatcgtttagtcagttgcattagtatctttgtctgggttcatgaaaaatgttccacgcataaaaatcatcatgctcggcgagttatttgagtcatttgttgctttatttaatttggttttgagcatgtgttggttcctatccctctgtcctctttagatgtcagacctgttctctgatcgcaagcgctgctccaagcttcagagtcgccgcctttatccttaacattttcttagttttggctgcttgctagtttctgtgtttaggtttgttgcttgtgggttagtcggcggtcgatatcatgtgttagtggtatgactgccttaattaggagttgtttgctttctttttagttttttaatcaagattaaattaattgcacttaaatctataagaaagattagtttccaagccatctgttttcttcctttctcttatttctacctatcctcgtccagatggtgaagacagggaatgatccccgtgcctccaatgacgctaggggcagcgaagagcagaccgatggagctcatatcagtggtgcatctgacagcagttcatctccaccgcccgagaacccaacggtcactcagatgatgacaatgatgatacaacagatgcagcaacattaccatcagatgttgcagcaggcgcagcagaaccagcagtctggtcctccatcatcacacctgtccaaactgttagactttcatcatatccagccacccactttctcaagcaccaccaacccaatgtaggccaacgactggctccgtgcgattgagaagaagctgaaccttctgcaatgcaatgaccaagagaaggttgcttttgctacacatcagttgcaaggtcccgcttctgcttggtgggataactacgtggtgacccgtccagattcaacggaggttacttgggcagagttttgtcaaagcttcaggaaggcacaaattcctgaggggattatggcacaaaagaaaagagagttccgcgcactgcatcaagaaaccaggatagttacagagtacttgcatgagttcaaccgccttgcgcgctacgctcctaaggatgtgcgcaccgatgccgagaagcaggagaagtttttgtttggtctcgatgataaattgaccaaccagctgatctccggagtctatgatgactttgagaagctcgtggacaaggctatccgtcaggaagagcaacgcaacaaaatggaccgaaatagaaaggtagctcagatcagctttcctcaggggaacaattagaagcctcgcttcatgacgggacagctaggtgagccttccaccctgatcatccgtcagcaccatccttaccacccgagtaacttcaacaacgactacaacggtggcagtcacaacaacagtaagcagcataaccacaactcgacttcacccccattaatggcaccagctcagtcagatccgccagctatgtcagctcagtcagacagctcaagaaggagtctgcaggaaagccaagaccctgcttcaactgtggcaagcacggccactttgctggcaagtgtccgaagctaaagcgcgttggacctaggttcgtccaggcccgcgtcaatcatgcgtctgcagagaaagcacaggcatcaccagaggtcgtgctgggcacgtttccggtgaactcatatccagcaacagttctctttgattctggtgcctcgcattcttttatatccaagagatttgctggggcacatggattatcggtagtggaacttaaaatactgatgcaggttcatacccctggaaatgacatgaggacagcacactactgcccctcagtgactatagagatcaagaggtcacggtttctatccaacctcatccttctcgaatccaaagacctagatgtcattctcggaatggattggttgaccagacacaagggagtgatcgactgcgcaagtcgcactatcaccctaagcaacgacaaaggggagaagatcaccttccgttctccagtgtcacagaagtccgtagcgagtctgaatcaggctgttattgaggatcagacagaaatagcggaaaaaaatcccaagaagttggaggatatacctatagtacaagagtatcctgaggtgttcccagaaggcctcactacaatgccaccgaagagagaaatcgagttccagattgatctggcacccggaactgctccaatctacaagaggccgtacagaatggcagctaatgagctagcagaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacaccagagttgaagtccttctcagttgaagatgtcacaaagaagttggtttcgtcgctaccgtcatggatgcctatcgaatggagtcgcccactgcagaagtcaagtcttcaggcttagctcgtttttttcttcttttttccgctgcatttgtaatcttttatatttttgtaaaacgtggatctgtatgtcaacaattgtcgtttgtgtaccctggctggtcctggacaggggtttaatacacattcagcttagaaattctggttcgtgaatatctgggcgtgacaattacgagggggaactaaattgacaagtgatcataattatattttttcttaaaactaggaaggtagcccgcgcacatgcgcgtgcaccttatttaatgtgcatgaaattttgttagggatgtccatgtgtgggtgtttctctatctaaataaaaattgaacttatttaatgtgatttgaatgctggttataattttcttatgattacccttgcagcacataaattctaaactaaaattacttgagactgtacacttcataatttataagaaaatattatgtcgaaacaatagatgtagttcctatgagaaaattttggtcattttgacttctcgcatagatatcttacccccaaacatttgctcaaaaagtcatttttttgctagatagtatttgaagttttacatattttcattccatctagctttgctagaagtttgaatgtttctgtttagaatgggttttcaaaccaattttttttttaaaaaagataatttttgttaaattttgattcttttcatgtacattttttaaagaaatttggagaattccactctatgaagcatatttgaaatgatttgatttctgcaatttgggttaaaaacataagtgggttgagcctacaacctgacatggggtaaagtcatctcttctgaattatctcacttcaattgagtaagaaatattaaaatagaggtcatgtaataaatacacattattatgttgtctataaaaaattaacgctagatggggtacaaattatgacgtaaaacacgatatcatttaaagttttcctctaatttattggtgacttcatagatcatatagataatttagactctatgatcatcttaagattatttatttatcttctaaattgatcattgattgataaaaaagcaccaaggtcatattatataggtaagtagcccccatatacatgttgagagaaattaataaatttgatagaaagtgttagggtctaacaggatataagtaatgggtcaaccagctttattaaaaattaaggtgggatattctgattttcaatgacgaattttagtatcttttttaatttattgttggcctcaagatggatgtgggtctagaatataatttttatgttagcatttaaatatagacaatatgaatattaatgtattgatttcactaaaaatataatagttcgaacagatcataagttgaatatatgatttgaaaagttataaatattttatttatattgttcctataagtgctagtaagagagagaaggacagggacagtgggatacatggctagacctaatatgtggaggttaatttgtggtttttcctccataaagattaatttaattttaattatcataatataaaaataagagaaaaggaacatcacaccgcacggggacgggaagggagggaggaggatgttttttcttaaaaaaatgattgatctaatgacctaaaataatgtgttggatgtttaagtcgaaaacaatggtcggatgttttgtttttaacttaagagagaccagtagtggtttagaaatatttataggatgtttaatgtatttaacattgcaggggccgagagtgaggaaataaggtttgtgagtttttttaaataaaaatctaataacaacctaaatgatatgtccatcgatttaagtcaaaatggtgttttgttcttaattttttatgattttctctaatttataatttaggagtgtcactgtgtggtttataagatggttaatgggctttaacgccgcataggagcgcggagggaggtttgggatatatttttttagaaaaagataaatctaataacctaaaataatgtatatagatggtcgaatgtttttttaaggttttctctaatttaagagtgctatatactcatcccgtcccataaaacctgaacttaaaataggatgtggcatatgcgagaacagcgaatttggacatgtgtttagaaatatttatatgatgttgattgaactatttatttattaggtgagaatataggaagttggctagatctagtaggttgatgggctttttaggcccataaaaaggtatttaatttaaattatatggggatttaaaaaaaggagaggaacggttggttggaggaatcgcacgtacgtgcgcgcggaggctcacgtccggacggagttatttttcttgtgaagatagatctaaatatgaaaattaatgggcccaccaatttaaataaaaatcaatggtcagattttactaattttttagagtgacacatggggacttaagagcatttataggataccacatggcagccttagagcgtttgtaggaagtttaatggacttttagtatataatagatagattatatgcaaatttcaatgttttctttaggtaatgatgcatcgtattaacatgaaaaacatattacaacaaaaaacataggcaggaagttatactgcatatacttatttatttatgaaatttagcatgataagaatgttgagcaaatatatcataagcggtgaaaatatcgaccgagataaaagtctagataaataggctttcatctatatcgattttgataaaatgattaacaaactatctatcttgcaagtattaaggaatatttagaaatttgagatggtagccatctaacgacatgattatgattatgagatattaataaaatgtagtattatacaaggaaaaggaaaaaaagaatggcatggcttgtgcttcttttggttagtgactaattaatcctacacgataaacataagaagctggaaattcagcatggcacacgatgtgatgctgttagctaagctgtgcatgcatcggcagaatcctatgacttgctctgactttgagtcactgacatgggccaactggatagagggcacacatatcagtgacacaagttagagaaaagtaagttagaggatctctatttggttgggttgtagtttaaggctgcgttcggtataggaagttcccaacccctcttcctcgttttctgcgcgcgcacttttcaaactattaaatggtgtgtttttttgcaaaaagtttctacacgaaagttgcttaaaaaaatcatatagatctattttttaaaaaaattagttaatacttaattaatcgcgcattaaatgctgctccgttttatatgccaggagtgaggttcccaaccctcactcccgaacacagcctaagagccttattggttgcctatattttctaataagccaaaacggcttattaagaaaactgtttaataaaaccaaaaagatgtggtggtttaggcttcagaatctataggctgtttaaccaagcccttcttgcccgtcaagcttggcgtcttatagaattccctgatatcctctatgcaagagttctgaaggcgaagtatttcccccaaggatccctaattgatactaccttcagttgcaacattttcccgacttggcgtgctattgttcgtgggctggagttattgaaaaaagggatcatatggagagttggtaatgggaagtctatctgcgtgtggagagatccctggattccacgtgatcactcaagaagacctatttctttgagaggtaattgttggctaaaatgggtgtctgatttgatagaccaagatggctcttggaatattacagagatcaatagatgcttccttggtatagacgctgagatcatcccaactatctgtctgtctcctcatttggaagaagattttttggcttggcacccagataagacaggccggttctcagtgcggagtgcctacagccttgcttgtaagctggcaaacactgaagattcgtcaagctcatctgtagtgggtacacacaaagcctgggactcaatctgaaagtgtaagatgccacagaagataaaggtctttgcctgaaaagctgcctcaaactgtttaccaaccattgtcaacaaaaaggtacgaaatttggagtcgacagatacctgaatcatttgtaatcaggagaagggggatactgctcacgccctctgcaggtgcccacacgcgaggaacttgctgtcagccatgttcaatgcaggcaacatctctcttgatgtggaaaaatctcgtttcggtaatgagtggctatttgacatgctggagcaactccctgcccatgagcacgagatgttcttaatgacgctatggcggaattggcatgttcgcaatgaaatcacccatgataaagcagcccctccgctggaagtttcgaaaagatttgttgaaagttacatagccacgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcttgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatacgtgtccaccccctacagtagcaggctcaccatgagcttctcactaggctcccgcgccgctcccttcctgtctcccaagggtgtgacctgaggaattcccgcgctcacaccgtgatctccgccggagattcgccggcgacagggagcgccgccgcgtcgccctagaatcgtcagtccatcgcctgacatactcttcagtattcctattcctttttcatatgacttaaaaatcgatcttatgtttactacaccatctaataacaataaaaatactaattaaaaaagcgcaaggagtatcatttaagagcgggttgtttcatgtgtggttgccaccacttccacgtcgctaacagacttattaattgtaaaagtaaggtactctgttcatcgtactccgtacagagtagcatcaatgatagaaacttcaccttttttttaatgtttgataaaatgggatgcgtcacctacggatggaccaacggattgttggtcgttggtatagcaatatcaatattattatggctcttagttgactcaactgacaagtctacgcctgctcttactatttaagaagcttccaatgcgctaacgcagcccagcgatctgcgcgtcacaactcacaaagccggggtagcttgaggtagtggtgccctggattctaaggtataccttgctatacactgatccttatgtaagttcgtctgtaatatatacacgtaactggtaaaatttgtccgtgcaattgcactagctagtttctaatattatttcatttcaagcaaattagttacttgctccggcctaaatatagcggcctaatttgatatacaaaggcagcaatattttaaaacgaaaaaaagtgcgtgatacatatataatataatttcttgatattgtttgttttttcacgtgccctactgcacatttatacctgcgaatatgccccctttagcacattctcaaaagttggaagccaacaggaaatctttggtgtcgctaaaattcttaaattctaggtgtgtttagttcgcaaaaagaatttttttagttgtcacatcggatgtttgactggatgttggaaggagttttcggacacgaatgaaaaaactaatttcataactcgcctgaaaaccgcgagacaaatcttttgagcctaattaagccgacattagcacatgtgggtcactgtggtacttatggctaatcatggattaattaggctcaaaagattcgtctcgtgatttccatgcaaagtgtgtgattagattttatttttatctatatttaatgctccatacatatatccaaagattcgaggtgacgtttttgggaaaaaaaaattgaaaactaaaccatgc

SEQ ID NO: 32666 - DNA, 9695 bp, Oryza sativa
aaggttgaagtcaactttataactttgaccatcaataattttaaaaatatttagtttaaaggaactagaccaatatatataaatttgtctttcaaaacaccataataaaagtaaacatatatttatttattatatatattataatagaaaaataaaggtcaaagatatattttgtagaccgtgttcttgtccaaaacgttaattaaaatgaaaccggagggagtatataaaaaagaatagaatccattccagagttttagcactccagaaattttggaagttcgattgtgaaatgccaaaactgtcatcaatttaaagctgccagaaaaagggtaggtgatatcaatatattgtcgtgccaaaaatatataaaaatatatggttgccctgattcctgtgtgaagcaacattttcactgcactgctccaaacacgccgaaggaggaatcaattcaccatgatccactctagctaggacccgtaaaaaatggacagtttggtcagcaggctactccctccatcctagtttaatcatcccctaactaaaggcgctaagaacaataacagcaaaatattcatcattcttaaaattaatcctctcatggattaagtgttccatcgcttcgtgtcttatggattgctaatggtttaaatataatataaattaatcttgtttggttgcaagtaacacattccaatgatacacatttagtactcttaatttgcacaaataaacgaagatgatgattattttgaaaaggccttaaaaatattaggggatgattaaaatgggatgaaggcagtagtatttcagagcttgcttctccatgtgaacattttgtcaagaatgagaatcatcggtaattcaattcccgtaagggctaatacgtgaaacggattccaacatatattagagttagggctccagggtgagctaggtatggagagggccagaggggacgctagggagagaaaaaaagagagtcaggagggcttttgtgctcagatggttcgggcttctaaattactgttttatattatgataactagctgggtggtccacgcaattgcgcggctagccaaaaaaatcatttttttaagtatgattttacttaaaatttattaaatagctatctcattgttaagactttgaaagaccaaaccttatcatcctcgtgtttctaattatatagttttaaaaatcacaccaattgctaccccttatgtcatcttctttatttgcttgctcgatctatcactatttctattcattcatcttggaacatttaaaaattagattttatagtttttagagtttattgtcacgttgggtttcgtttttataatttctagatgtcccgtcaaacgttgccattatactcctatacagcctgtccactatctcttctcttttattgtcattgagattttaaaaatcgaactgtgacgccccacacttttatctttagtgataaaagtgtgagaacatagattattatttaacaaccattattttgccaaataataatccaccatcagagatcgcaacagagaaatagttagaactacctttaattcatccctaggagcattaaggtcatctctactccatctagagtacactcataacattgaatagagtttgtagcaactccccgtagactcccatccaggagatagtcgtgaatcacgatttaatttagcactgcgcaggcttgtatcactgtacccatagctactcttaacatgtttgactgtcgcacttcactagatgcggcaccatgctaagagtacagaacttttcccctacttcaacttactacactccacgtttgtgttgagcctatcagccctccacaccaccgcgctactatatgcgcctggaatgcacttcatcggcattcatggggtttatatcatctcccatcctactactacgtacccatgtggagtataataaacttgataaggtaccaggtccagcccgtcttaagacgaatctatggtcgacacggtatatacggttctttgatacgagtgagggggtgattagtccttatatttatacaccgtatgtagggagagccctgacctgccatcatcatcaatcatctcatccctgagctccccctacccaccatactagtatcctgatgatctccatcatcatcggcttgtcaatcatatcatcatcgttcatttcattatattctagaaaatactttttgatgcaatactaggagaaatatttttatgaaatagatttttaagttgaaatataattataatctaccaacatgatcaaaagagagacttgcctgatattttgtactcggtactatcaaatgacccaatttctgactctagccttttccctgcattttattgtatacattgattttcaattaactttcaaacttgaagaatataattggcttatctatctatattacagtgcacctaaaattctagcctgatgtacaatttctagcattccattaatttgtattgagtatatatattagttacttgatttaaactagacttgatttacagatttattgacagagttttgctaagcttaatgttagtgtagacaactagtgtgcactaagcaatttaacccttattcctgctctcctcacttatgtctctctctctctctctctctctctctcgcacatacaacaagctgcatctagttactcatccccttcttccattttcttggctgttgctgctgctaatggctttcttcttccccaactctgctcctcccttccatctacagcaccacccatggcgctgccaccccggcgcccacggaggtcgacgccagccaccaccactacacaccccaagctagctcactgcaaatccccttttctccccctcccgatttctcctcttcctcccatggtccaagccctaccaacagcgtctgctttctctctctgtgtgtgtccctctctctctctcatgctaccaaatggatgtgatgccactaatagtgatgtgaaagtgcaggaaaatagtgcctcgtgccatggctgctctatgaggtggcaagaatggcaagatttgaggggctcacctttgtctaagggacaagttcctccatggttgtgctcccgtgttcgtcctcgccaatgtgttggtctcttctcctccttgatagatcatctccttgtctagccaatttttcttctccccttcctagccgacatagagatggtatgagtatttggctgagaactaatttggctactaactattgggattgagggattggttcttgaaatggattgggcagaatcttgcattccgctgatttgtggattttgggactttggctattccctcctcgctccctattgctctcctcctcccctgatctgctcactcctcaccaagtgcttggggctcatatgcatgcatcagtgagcaaatgggcatggctgtagccatgctttgactgcttgactgagaggtgatgaggttgtgctactacctttgtggccttgtgtgagtcctcctatgtgcagctatgtgattggtggaaaattagtactgctggtgaattgaggtccctttggtgaggttacttctttatatgagatgtgtgacttcttagtgttaattagccggagccggatgacgaacccaacttaagggaggggtgccagacggtattagccgatctaggtatctcggtgaatggttgaatatacaccacttcgtgtatgggtctgacggcaatatttatttacatattaccttttgtgcataaaagggtcaagctatgcatgtcctgtgcaaccgtatattcaaatatatgatgtattgtattattagtgtaagtgtatgtatatgctgactgtttacagtggcgtttgtttgtactatatttccaattatcactattatattgtggttgtatattggacattgtttgtttgtttaacttcgacgaatgtgaatttcataaattttgagtggcttattcttatttccaacaattttgctagttaactaattaattagtgatatatgccacttaatttttaatttttaaaatagcttaaatttccgggtaacataattatagtttgggtttatttttactttccaaaagtcccgccaaaccatcagcggttttgccattgtactcctctacggctcgctcgctgcctcccttctttattgccttctttattgtcattgagatttaaaatagaacatgattatcattggttttttttactttttagaatttctaaatctttaaaaattggacttgtagttttattttttataatttttagaagtctcatcaaacgatgccactatgcccctctgcagcccgtccgccgcctactctttattgtcattgtgattctaaaaatcgaacataactatcattacaattcattttttattttctagaagtcccgtcaaccgtcggaggctctgcaactatactcttatacaccccgctcgttgcttctcctttttattgtcattgagattttaaaaatcgaaaatgattatcaatgtggttttctttctttatactttctagaagtcccggcaaccgctttacttgtttacttcacggcatacctgatgtccctccttttaatcgtcattaggattctatttggtgttttattaataatttttatatgccgtattaaccaccaccaactctactactttatagccatgttacttaatttatttcgtcatgtgttttagatggtcttttctttcaatagtctttatttttatcacaaattttagttatttataaattttattcctaatataaatcttttttttctaatttcagaatttattttttctaaaaaattagttaatattgtattgtgttcttttaatgtttttattttttattttgaattttatttgtttcaaaattgtattcctacttgaactctgttttaaattttctaattttggatattattatatttttattcgaaattttaattaatcttgtattgggttcttatatggatttttctttcaatattgcttctttttaattacgaatttcagctaactacttgaactcttctttattttcttttgctaatttcatatttatttttatttttattccgaattttaattaatctcgtattgggttattagatggactcttcttttaatattccttatttttaattccgaatttcagctatttttaaattgtattcctacttggactctcgtttccttttctaatttggattttattttatttttatttcaaattttgattaatctcgtattgggttcttatatggaaacttcttccaatattgcttatttttaattccgaatttcagctatttttaaattgtatttctacttagactctcctttccttttctaatttgtgattttattttacttttatttataattttgattaatctcgtattgagtttttatatggaaacttctttcaatattgcttatttttaattccgaaattcagttatttttagattgtatttctacctggactctccttttcttttttttttctccgattaatgtgggaatttctaacccccacagcgaacgtggtgcctcctttcaaagctattttaataatataatagatagatagatagattaccgtatttctaaatacaccaatatttattatctatttctttatttgacccataatttagaagcccatcaactcctcaaccaaatatatgagtgcaaagttaaaagggagacaatttgtaatttgcatagtgtatccttgaattaattttcttatattatatggttatgcgaaataaaatgtgtgattttagatatttgttattgatttttgtcgataccaatgcattttcgttcatattgttctgtttttggtttccgatattattatactgtttttattttcgaatttaccgttttcgtttccaagaaaacaattgggatgttttcggacctttttcatcccaggtaagtggtcaaggcgcgcgattgtacgtccattacacgcactcggtaattccagatgcaaaattgatttaccgctagtttccaatttccaacgatgcaggtaagatccacagcaacgccatgaacacgcaggtcgacgtcgagaatgtggacgtggtcatcaagcctagaatggtacctgcccatcagggttggcagactagcctctgcgactgcttcggagacggctgcgaatcatgtatgcaaagctacgactgactggatttttctggtttggtggtacaatgcaatgttttttccgtttcatggcttaatttctcgacctgttggcagtttgtttgagtgcttggttcccttgggtgtcgatttcctgcatcggtgaaatcgtcgatcaaggcttcacaggtaggggtcatctcctctcccatagccccatccaaagtgctttgctttggaccggttaccgataaaacaaaaaagcgtttggattcagatataaaattaaagaaaccatcaaactgaatttagatcgaattaatatccgctgatcaggtggttaattaattatcggtattcagtttcaaaattttgcattttcacgcttattattatatccggttacagatatgtatgtgaagattttttacatttgcttaccgatatgcatgttttctctcttgtcaatttccttttggtctcctcaccaattagagtggtgctgtatctgcttcatctacctcattgccgcttatttcggcgtgtggtgggcgtacgcggggtggtaccgcggaaagctcagggcgcagtatggcttgccggaatcgcccctgccggactgcctcacccatctcttctgccactggtgcgcgctggctcaggagcacagggagctcgccgcccgtggatacaacgtgctgaatggaacttactccctccgtttcaaaatatttgacaccgttaactttttagcacatgtttaaccgttcgtcttatttaaaaaagtttgtgaaatatgtaaaactatatgtgtacatgaaagtatatttaacaatgaatcaaatgatatgaaaagaataaataattacttaaattttttgaataagctaaatgatcaaacacatactaaaaagttaacggtgtcaaatatttaaaagggagtagtatactccctgctatatatgcatgtgccgctttagacgacactgccaaggcgatgcaaaccccaagatctaacggcgttttctttggcgattggcatatgcaggttgggacggccggccgcaggtggctgcagtaccgcctccgtcgcgtagtgcgcccgcagtccaggctccgatgaggcgatgaaccaggagcaaataaatagctcgctccgtccaccgaacgaagccataagataagtggcccagtgcgagctgtctatctaccaaaattataacaaaattataatagaaaaaatgatacctcgtgatatttttataaagactgtaaaattacttatctatatatctatatccaacagctgtgtaaagaagccaggcatctgaataatatttgacatcgccctagtttgataaactaggaagagaagaaaagcccgtccacataagcaggcatatgtttctcaaactttttattatatatcttaaatatgtgagatgtatatctatgtgtcttctttaagaataatattattctactttaaatttgttgtatttttttttctcactataagtttataagttttagattgctctaaacgttggttatggttttattgcaagtatccacgcagtggtggatcgaagaattttcttgaaactccgcaaagctaaaaatagataacaaatgtacacaatttcatactacttcaaaaaacatttactatgaacgtgattgtgattttttaagcatttgctttgctggtttgcttaagtacggtaattaagtacttcctactgttgtatgtggctggatggtaaataatcacataaatcaagtcctaatctactgctgtgtgcgttgaagcccgggcagctgcccatgtggctccgccattgtatccatggaacaaattctaaactaaaattgttaaaactacagaatcccaagactatggaatcttgaatttatgtaaaaatatcgtgttgcaataattctgttagttattgtgaaattatgaaactatagatgttcttttgaattttttagcatgcttctagaattcaagcttctaattccgcttcagagtgcctcgccagcatattctacgacagaaagtttgacgggtgtcaattggaaattccacattagctagggaccggattttccagccggcagcacggagaaggcactgatgatcctaggtcattggtgcaactataacctttgaggtgcacacgatgcaaaaaaaaaaaaaaaaattgaggcacacacgacgcaaaaaaaaaaaagagaagaggctcgattcggtcgaatccgatgctttgagtcactccccgttgccccagattacaaatcgaaaaaaaaaacaaacttctgtacatgctaaactttctgtacaagcttaatcacatttttttaaaaagaaaaataaactgttgcacatgctaaatcacaaattcaaccaaaaacagaacctctcgtcatcaaacggataggtgacgtgacatggaaagggaaggggagcatggcaaggtacccagatctagcggtcattgagctcgagacagcgccctcacgtcaccccaacgtaggggaagggggtgccctacatgttgtacatgctgtacatggcaaggtacccggatcttattgatggcccccgcagcagacccgtaccagtggcaatatccgcttccccttccccatccccttccccttctctacctcctccctacccctcaccgcctccggcgaacaccgcgccacggtgccagtggcctgcacggagggtaagtgcgcgtggggtggggggggggagcgtcaggagtcacgggagcatgcgcacgtgggacgcgcatgctgccgcctccactcatgagtttagggtcgagtcgggagagagagcacgcgcacaaggggaggagaagatagggagaggataaggacggagagactcggtctattggctcagcttaacggtctaggatgcttgtttatttaaaacaaactagtacagataaagtgataatattataggtgccaaattttattaataaacggtacctatatcgtcacataggtattagatcttctaaacggcccatgggcatgtgctcgagccaaaaataggtgttagttatagactttctgacacctataatactatcttcgttttcgtttatgttgtagtgatatgaccaagttatgggttgcagagagctttacatggtgggcaagtcgctcgtcactgaggcagagaaaagctctaggtcgcctcttatgctttgcataacaaatgttttattctcttggttcaaaccaaaatgttggctccattttaaaataatatttaaaataattgctggtggatgatgatgtggcatacttgcatgttgagttttaaaagttagtaggtattgactttatagtaagatagaatatcataaataacacaccgatacaaactttaatttctaatgttgcagatcttatttcgtcatacgtatttgcaaagct

SEQ ID NO: 32667 - DNA, 16664 bp, Oryza sativa
  unsure (1)..(16664): unsure at all n locations
caaaatgattaatcattagtacgtgcacacaaataattatacatagacgagaatagagtcttgtatcaacacacaaatacatataggatacatatccatgacactcatggatatgttacttaaggtaccaaatctaaccatcaatccctacataaaagcaaatgaaagaaaacatcaaacttggtgtttagtgattattactaatcattttcacaagagttggtggatatttttatgcaagtgaattatggaaacactgctactcccgtcccgagctgaaggctgaagcactgccgtgctgccccttcctcgagctcgagcaccagcaacttcagcgctaccatcatgtgcttgaactcgagcttgagaactagtatcgtagctgaccttgtgctgatctactactcctcacatcccctccctcctgatgatcggttatagcataccaagaacagagtgcggtagagcataatagcaacaaagagagggagcacgtgacatcggttatgggctgcctaaattggaaaaaaaattgggggtaaaatatttcttggcctcagtccttaaacggcagtgctaatgttattttcgtctaatcgtgttcatggcttcacttggtaaaatagtatagccatgcatggaactaaagagctagtacctgcaatggagcaagtgatgcatgcagcgcaagattcctagcatggaggcatggagatatcttatatgctaatctatgaaggtagaaacatgtacatcttccgaactttgttcgatcatgtgctttttttatcagatttttttaagatggtttatctcatcgagagaatccattatatgccactgactttgtcacatgtctacaatttaccactgactttgtcacgttctacaatatgtcatcaacttttgtttaacttctacgatttaccatcaccgtctagttagcctccgttagcactgtacaattttgtccaaatgaccaaaatacccctacgacaaaaacttctaaaatttagataaaattatcaaaatatcatattatgaacacaagattgcaaaacatccaaaatttggtaaaaaaaacttaaaatctaacatttcagaattcttatccagattttgaaggtttttatcctaggggtattttggtcattttgataaatttgtgcagtactaacggagactaaccggacaacgatggtaaatcgtagaagttaagcaaaagttgatagcatattgtagaacgtgataaagtcagtggcaaattaatcgtagacgtatgacaaagtcagtgacatataatggattctctctatctcatattgctaggcatgtaaatacaagtcctcttgagatagacgcctacgcctaaacatttcaccatgttctttctagccttagtcttacaagttatatgtttccttccagggattcactcttttctgttgtcgtatttatccatgtttgatatgatgtagctttttttttcttctcaactataaagtttaatgcttatggttctatgctcaatcatatgtaccatgacccagcatggctctttgtatgtgatatggttgccctaacgcaagtattactttgtatgagagttttcctccatagaatcaacttactacaagctttgttgcctaggcaaacattcttctaatgcaactaatttccacagcaacgtgcggagtatcttctagttaaacacatagggaagacaaattgatttgagatgattaaagggaagacaaaatgattaatcattagtacgtgcacacaaataattatacatagacgagaatagagtcttgtagcaacacacaaatacatataggatacatatccatgacactcatggatatgttacttatttttgaaggtgcagactcattgccacctatccattatacacttcatctgcaatggctttacggattgtattcatcacttcctcgctgttaggtgcgtcataccaaacacataggggtggagcctctgggatgttggggtacccattgtataacaggttttgtgtcatgaaatgcgggtctgaactgtcaagcttgaagttgtggagagcaaacgtacagtgtgtgatatttgtctgatcgttctgcccaggaaagtaaggtatttctctaagaattctccactaactcttgataactccaaagctctttccattgtgttacacaaaaaggagtgaatgtagttaaaagtctcttcctttccatgcggtagtgttgcttctgaaccctcaaaatcatccaagtggtatcgaacatgcgggtatggaggtaggaatccataccaactggcataacccgagcccacaaggagatatttgcttgcacaaataaaatattcagttaatacccctatatggcattaacttgtttcattaaaaaaataaaagtgttgcgaaccccatggaaaccttggaaatatgtagggatagcctcgtactacttctatgagcaccctttagtcgtgcatagatcctggttatcccgcatctataaatatgacacgattgtcccatccaataacaacaagaacattcctagatttgacatggtgacgattccgtgttgaatggaatcatcaaatgccacaataacaggaatgtgtcccatccactgaacctgccgcactagcaaatggctggaaggcctcatcttgcatgacacggttatccactctagcaaagttaggatctacatgcttatttatgtcaattgtaattgcatagacaacattaagcactctatggaaatactttgacacagtagatcgtgaatggaccatcctattatttgtcgaccgattagaatagccacctgccatgttgtataggaatattccaagtgcttccatagggtatatctcaattgttccgtgaaggttataccgattagtgagtagcccaaacaaagcatgaatctgatcagccctcattcgaaatatagcttggcactgagctgcattggacattgtttccatcattcattccatctcgaattgttgcgggacccgccttgcggccttaccacgcaattttgcctccaaactagcaaccaacatatcaagaatgcaatcttcctcttcactgaagtatccatcctttgaagcatttgttctttcagacgaagtgctcaagttcccatagcattatatgacaaaataaacatggttaaggtacaagtatgaatggtgctaataggttttaactttattatcgttcaactataaacttagtcacgatgaaaaaattataagacagtacagaaaatttcagaaaaagatggaatacggacaaagaacaaatgaggtacgaaatacttaaaatattagcacatgtcaagtaaaattcgtctcaacataatttattcaatcagtgcaactgatagctcaaattaatggtgccgaaattgttaaactaaacactcaaattaataaggcctagaacaatcacgtttctcgaaagaaatcgaacaagttatttaacggacatcacaaggaaaattagagatgcatgacaaagatcgcatggcaccagtacgataatcactgccttaagaaatgttaaaacattttaacattgctgcaccatctgctccaaccgtaccatcataacctctaggcccaaatccacctccaccatcaaaccagcctccaaatccattagcaccacctgagcatgttggtggtggagcaaacatagtttctacctggtagtgcgagtggatgaagtacacaccttcctttggtgtgatgcaatcatcaatgaagaactcatgcaaatacccatcacgaaacagcttcagtgccatgtggtacagaggaaccttcttggtgatgccatcagccttcagtagctccatgcaagctctagcacttttggcttgcctctgttcctcccttctttctttgctctcattggactgcacccttaggtcagccaacctattcagagcatctccagtggagtcaccgcaaatatgcttgccgctgccactagagacactgacaggggttacgatccttttttcctttaccgcgcctcctcattgaagaaggctctggagatgcataagtagtgccatctgcatgaggtcctcaacatcgaggatcttagcctcctaggacacctgtgactgtgccggcttggacctaggcacaccggagcggtttagcagcacagttcttcctctgtaaacaacatgatgctcagcgttgaatctgagcggtgcatttctgaatacacgcgctcctcttctaagctacacaaattacagcacatagttggtttaatcagaaaataaccacttgtatgcatgtacagatggcaggatatagaaatggcagcacatgtaaacatgtaagcatgttcaaaacagtagaatctggaatcaaatacacataggcacacatttgttataacaaagtatataacagtagcaagtgaaaatacatgtagtgcagttagtgtacacatggcagcaaccatgtgttgaagttaagaaaaaaaaaacggaagcatatcaccttctaccacaatacaactgagtagttaaaataagtgcacaaatatgcgttcataaattgtagatgcagcaagttggtacttaaaagataagttttatttattgttgtcattacatctaagataaattaaagttttgctgcaaatacaacacacaattcagttatgtggtttgatcacgttgttgctggaaatattgttttagatatgtaacacatgccaactttgcaaacaataacttcagctcctaaatctcttgcttaatacagaataattcaaacatgtgcaagttcaattatcagtaatcctcaacacatggcactaacaggtcagattttaattacaacatgtcatggctgatcgccttggattattttgcaacctatgcatgctgctcattgttatcatgataaatacagaaacattgcagacatgttcaaattaaatgtgctcttgtcatctacacatggcatgaaaagatcatagtagagagatcagaacatgtaaactttaattcagtaccctagacagatcagaaaacattcaacattcaatttaatttgcagaaaaaaatatcattttttgtaatccatacattgagctcatacttatcattctatgtacaaaaacattgcacacaatctgcagatgtaatatcagttgtgaactacacatggcatgaaaagttcatatttttctgtgtttttttgagtgaactacacacttacaagtttcattgtgtttttcagaaacaaatgtctaggtttgtgatgtatacattcagctcaaaattatcttggtatatacacaagcatttaaaagaacacacatatttaattatcaaatgtggtgtacacatggcatgaacagatcatattaggctgttttaaattaaggactacacttgtgacaaatatggtgtacacatggcatgaacataatatattgttaataacatggcataattaatcataaatgtagtttgacatatctaggcatagaacaagtggtctgtaatgtcatgtactttgggatcaacattccaaatatatgtatgatagttaatcatacatctatacacctatgtataaagttttgatacactggcatctagagtatatctataaacctatatatgcatgaaattctgctacaagtttcaatgtaattttcagatacaaatgtcaaattttgtaatctatactttgagctcataattatcttggtatatatagaagtattctaaagatattgaaatttaattatcaaatatggtgtacacatggcatgaacatatcatactaggttgttttaaattcagtaagactacacgcatgacaatgaacatatgaacatattgctgataacatggcataattaatcataaatatagtttgacatatcgctaggcatggaacaagtaatctgtcattcgaaatactttaggattaacattccaaatatatgtatgacagtaaatcatacatctatagacctatgtatgaatcatgcatgtagaggcctatgttttgaactatgctacatctggtctgtaatgtcattcatctggaggcctatgtttgttaaagctcctactctatatggctctattgatccactgatggtggtgtgtgaagcatctatgttttcaaatttgctacatgtaatctctagtgtcatgaactttaggaaaaattgcatggcatgcgcaaaatggaaaaattgcaaagttaaactatacataacccttccatctgctcccaccattcagagtttacttggatggagccagtgtagggatcttgccccagatcggtggccattcattccagctaggtccatgtttggaaacggtggcgacagtggtcccataagttcttcagctactgcttgttcatgacccttctcgtacatcttgttctgcagattcatgtatccttgagctttggggcagctggaggtgatgatgcagccctcaatttcttccatgcagctatccaggaatgctttcagctccgcctacgtccaatgggtgtgaccgccagccatctaacaacccaagtcaagcaagcaagtaggttgaaaataaaagctagaacttgtgctttacctttcttagggcctttacagtgcacctacgtggcgagttatcgttttccatctaggccaaactctgacgtggataaaaaaaaaggtggtggcctggtgggacccgtatctttgcaaaggtttgcatctcctaccaaggatccggtttcctcaggcccaaaaagaaactgtgagtggtcccctctcccatgtcgcgtgctactactctcaattttcccgattattcccctatacgtcatccctctgcttggctccaccgacctcgtcgtcgtcgattcgccggtgggtccaccaccgcctcggcttcctcaaccaccgccgcgtccccgtgcgagtgggcttgagcggcgtccgggagtggagaggccccgatagggataggagagaggcccgcggtggcggagtttgtcgccgaggtggggggagtggggagaggccgccagcggcagagttcgtcgccgaggtgaggagaggacggaggcagcggcatcgctggtaaactcgccaaggttggtgggtggagaaaatggagaggattgtgcagtggtggtgggtgcctgggtggggttgagatttgtattatttcctccactgtaaggtgttcattgtaaaatttgtacttctttctaaattgagaaaaatatgagggctaaaatcaaaagtggtaggagctaaaacgaaaaatcgaagtcacccatgaggccatttgcactgtggggaaccaaaatttggacacagtatctttagtctatgtggcagtttaggttcttcaatgggtagtttgcattactactgcccttggtgctacgagtcgagcaagtcccaatcgagtgaagatgcaactctggccggagtgaggcggcggaccagctgcaagatagcttcatggaactttgcagcgatgatgatgagtgctcgcgctacggcctggatgtcgtcttcactgtggcagtgtagctggcgtcggattgcagagacttggatgaaccctgagaggatttcagatctaaagccacctctcgccgttttgccgaagtaaatggcaactgtggagaggatatcaagggctcggtggtggagtgctagagatgaagcttccgtttcacgcctttggatgccatggccggatccacaagatggcttaatatagctatgagttcaagtccccctctccaccaattttggcaatggcgcctccttggatgccggatgggacgtgaatctccggccctattcggcacgagaactcaccagagcagcagacgcgcgctggagaggctgatgcactgtcggtggaatcgacgccgcgccgatgcttgctgcgactgtgcctctcgttttttctccacctccaatgcgctaatattcgatctaagtgcttctcccctactccctccgtctaaaaaaatttaacctagaaggggattgttcattattctaggaggggtcacattctgttataggttgagttttttttttttttttgatggagtgtatgtgcctggcaaccctcctgcccaatgagccatcgacgtcgagcgcatggtctaccgcttgcacgccgctcaggacaagcaggagccgatgcagatctcgattcgcctccgtgaccaacggttgctttagtgttcggaggagaaagatgagggactccgcaagaacaggtggagaaagcaatgcacgaacgagcgaccgaaagctatccacgccgtcaccctcacggttggcttgaacagtaactcaacaggccagtccatctcgcggtaccgagattattgcaccatcttaatttcagcccatccgaatcccagctttccaacgggcccaaaaaaatggtccaaaccaccgcattccagaatgtaattcaccaggtgtataccattgccaatgcgcaagctgagcagatcatgatcaaatgcatagcaatgatctaaccagtagtattatactatcatatagtactaatcattcaactgcattcaaaatgagctggccatgaaatcagtctcacaattttccatggttttaatcagagaaaccaactcggcagacaaaaaagggtatcggaactgacattaagttttgatcatccataatttagtaacagcccaaatctcctaaaaggtaaagcaactagcaacaccatctctactcagctgctgcaacctcccctgccaccgcctcgtcagtctcagcaggcctgtccagcttcataccgacatcttccttgtagtcaccgtgtacctgtaaaaccaataaagaccacattttctcagaatctatactccttttaaacaagggcaatggtgccaccaagtacagtattatttttatttcccacctactccatcatgttttgtaccaactatccaaactatccatgattttatcatatttcatctgtaacaacatctacaggaatgaaattgtcccaaaaacctcactattaattagatttaatccacagaaaagcacaggtgtttggctagtaaagttacgtacacacaggaactaggagtggaaaaaaaacatctggcactactgaggacatcaagaggcagcatactgaggccaatttgtgttggctgccttcaacgttatttgaggctgttaacaaacatgttttgtacttggacgccatatcatgtttaaatttacttgctacattctgtgacagtaaaaaaaagaactccggccaggtcatttagcccccctaatacttgagtaagtcttgcttccaaatcaacactacagtacagcactatttacagaaggcaagccctaatataagatttgagctaatattggctgcctaagagcacaaaattgcctaggaattttttatcaggaaaaattatctaaatgcataatgtcataaaccctaaaatatattgttaaaactcggtattgcaacatcttacactaaaagttagtattcaagtcaaagcaaaatcctgaactaagtattttagggcagccaggttatagcaggggagttagtaaacatagttgattccaacacatagcaaatatactagatagattttctaataagattccaaagccaataaccatgctaatacatttctcagaagaataaccaggagcactaaaggcatctagctaggcatgagaataaggttcctcacctccatcaacttcccaagatcaaacttcggtgccttcaagatcttcaccttgcggatgaacacattttggagagggaatatacttgaagttgacttctcgatctcctttccaatgacttcagggatgaattttgaaaccagttctttcaagtcacatgttgatgcctggttggccatgatctcaaccatcttccggcggatcttcaaacagtggacaaaaataaagtaaacaacaagaacatacctcatctcaaaaaacaagaacttacctagtacagaacatgcaaaaaagtatgacaaaacttttacctgccggatctggctagcctgagcgtaacaggtacgcttcacctgatttgggcggcgcttggtgaaaccaatgcaaaacaggcggagcatgtagttatctgtggtcttaacatccacatgggcttcaatcaatgttggccatttcttgaccaaggacttaagttggtcggtggtaaaactcatgccttagagaaaatatgtattggtttagactacataggacaaaagggatcacagatacaacacaaaaggattaatgaacaatcaatgctcatttttacccagaaattcgtgaggacattcttcccttgaacatcttcagcagaaagtttaaccttcctgtaagcntgatcctcgtcattctgaagatccgccaaggagacttcaaagacacgatgcttgagaccctcagatgcaatctagaaaataatttcatgaataataatcagcaccagacatagtgctgtaaaaaattcagataaccttaggaagattacacaaagaaatatcttgggtatttaaacatcagactaaaatatctaattagtgagaacacatgatagtgttactgaaatcaagcatttgatgtatgacgcattaaaggcagcaaacattaaaggcagcaaaaaggttactccaagtacatctcagcaagaatcaatcacctcaagaacttatatatatgattagtgttcatcaaatgaaatgaaacattccatgtatcagccataaaaatctaggagagtagaacaagtacagcacagaagaaatcttgccagaactcccacatttgcattaacgaaacaaacttctagccaaaacataaaaatgcatcaagacatcacaatcacaataactacatcaacgccaacattaatcccttagcctactcagatatagaatgacgcagccacgcagatccaaacagatagattccgcacatgtactcacagacagtgatacaaaatgaaagcatggatcagatcgcggattgaggttgacgggcgcgaatggggaacgaacgaacgaaccttggtcccctgggtcctggagacgagggtcttgccgatgttgcggacggagaacacggtcggcgccttgatgtcgtaccaatccttcttggaaaagggatcgacgctgcacccacacggagagagaaaaagagaagaagtcccaaatcagaatcccccaaaaaccccaagcaagaacaagcagctcagagaggacgagaggtgtggcgcccacaccgcccgcgcgcaagcagcttacgtcttcttcttgctgcccttcctgcccttggagatcctcttgttcttgcccacggccatggctgctcctccctctcctccggggttagggtttgggagtgagtggcggcggcgcaagtgggagaagaggtagaagaggcgaaacctagtggcctgggtggggttttgtaagggaggggtggctcgatcggacggctgggatgtgccaagccgcaacacgaacttagcccagcttggtcgagctcggctcggtgaagctcgcaagcgttacaagtaggaagaagagggatttcattcggctcgatttccagtcgagagcccagcagaaaacgagtttgcaacaagccgagctcaagtagctgagccttgaggcccatttggagttccttttaacgtgtgatggtttaagcccaagtatgggaatcagacttatatttagggtttaatatggatttgttaatgtgtagtctgattatagttgtataaataatttgattttttttattgatcttcctttagccctttgcttggactagagtgaaatcgaattcttaaattataattgaactatatttgttgtatttgaattatctccccttttataattcgtcaatatattgcttgtgtttgtgtataacgtatgaccttgtgattagcgaattaaattggtatttgattcccggacttttattacatcataattggattatatagaaaaaaattggtgtttgatttctctgtgctttatttgatatttgtaaattagttcatttacattcctcggtaggttttggtatttaattatttatagttccgttttaaggtgaagttccacataactcaagcaacaagatcctagaatgatgcaaaagttggaaattttactgatctttaactgaatatttagggtgttacactttctctttcgtaaaatctatttggagaggcctcttgattttgccttaactagtgacgtctaaatacggagaaacgtggagaagtccagctactacatggtactacatgcatgcattttttttaatatacatgtacgtccctttcctcttcaaataaagttttctctcaaattacttatccgatctacaatccgattacaccattgtgttcgttacaattaaatcttcacaacaaaatcttacgtgattatattacgatgaaaaaatatttatatttataaattacttttattatatatgtaagttactcttatctcatatatatatatatatatatatatatatatatatatatatatatatacatatatatataaaagttacttttagagttgactaaattacttcttagacatataaaagtaaatttaatagagtctaaaagtaatttacatatatttgtcagagttacggataaggtataccctctacccttggatgtacgctatacgacaatatggtacatctgcgcgtgtacggacgttctctgtatacactaaggaaatccatcacgaagtccaccaatggaaaggttcctacccgtataggactgggtcgtcactatatcgtgcagggtacgatgtctccgagtcctacttggagaccacatgacctgcgatataatagggacccccgggaagacctaaggcatcgaatctcatagccaacacaacgaccacagcctacgaagccggagcctacaggagccaagtcgtcgggtgatctagtcgaatcaactcgactacgatctcgtcggtatcatcgagttccattattccctttataatttgtggttctctccatataatcccatatcaactggattagggctattacctattaaggggcctgaaccagtataatcgttgtctcttgtttccttgatgtcgtactacgtagatgctcgtaccagcgtaccccaataccctctatatccggtctacgggtacccgccgtcgacagtggcgcgccaggtaggggaacttggtgctcaaggttgtactactatgacatcaagcttcgtcgacaacggcgtcaacaccggccccatccaaggagtccctacttcaacaatgctggtgtggactcaagtcggcaaaattgtcttcccggtttacaccacggtaccaatctcggctggtccatcaatgaccggaaacgagaacgccgtggctataaccccggacgatcccgtgtcgaaggatcctcccgccgtagcggagaacagaacatcgacgtcatacgagcccgagaaggttcctagtgcggccaaaccttgtccttccgacaagaactgtgagccgacaaggacaactcccgaggtaacaaagccctggtgtcctatccacaaatccaggaagcacaacttgcaagcttgctgggtttttctcaacgtacaagctgaaattcatgcttgcaaggagcgtggaatccagcgtacttctccaactcgtgatgtctattgtcctattcacaagacgaagaatcatgacttctcaagctgcaaggtctttctccgcgccatgaaaacatcgcttcctaaggtccagcagtcaggaatctctcttaaggatgcagacaaggaacaaggagcgacgttgacctcggatcgattcgttggagtaatcgacatcgatccccacgagccatcagtcctacacttgctcgaagactatggctcgtcatcttccagtaaacgacgcgacgtgtttaccatcggtgggactagcacgtctgcgcacgctaacgcagatgcggagaaccaagcggtcacgccggcccaacacctcggcaccgtcaacgcaatactgagagaagctccctatgaccccgtacttaacgatgatctcccatgatggacagaacgactacgggaatcagtagccaatctcagtaacgcgttcgaggaggtcgctaccagagcacaaccagaacatctgacggttggcggtgccgacggcgaaccaccggagcaacggacgtcgcctagacgagctacccctccacctcgcggcaccggcgatctccgcgaccatctgaatggccgccgagaagcacaacgcgcgcgagataacgagaatcgttcccaacattgtgtctcttcacgtcgtcataagaacgaagagcgaggaggccgctcgaacgaagaccaacaccaccataatcgtcacatccaccacgaccgcgacgatcgcgaacagtggacaccggacgatgctggtcgaggacgtcaacatgacggtgattataatggggatcggtgccaggacaacaatggtggacgacgatagaattctcgagaacctgaacgtcgccctcggaatcgcacaccggagccgagtgaaccatcgtcatcatcgtcatcatcttcatcctcgtcatccgatagacatccacggaggacacacgatcgccgacaacccaccgcccctagcgccgggtgtagagctttcaaccgttctctatgtgatgtccggtggcccgagaaattctgacccgaggcaatagagaagtacgatgggagtactgacccaaaagaattcctccaggtctactccacggtactatacgctgctggagcagacgacaacgcgttagcaaactatttgccaatggcgttgaaaggttttgcgcgttcgtggctgatgcacctcccgccctactcgatttcttcatgggcaaatttgtggcagcaattcgtcgctaacttccaaggaacttacaagcgccatgcgatcgaagacgatttacacgcgttaacacagaatccggggaaatctttgagggactacgttcggctctttaatgagtgcagaaatacgatccctgatattaccgacgcctttgtgattcgcgctttcaaaaccggtgtcagagatcgctacactacccaggagttggcaacaaggcgaatcacaactactcgaaggttgttcgaggtcgtcgattgatgcgctcatgtggacgacgcactgagacgcaagaacgacaagccaaaggcggggggagagaagaagccagccaaggacgcacctgagccaagcaagaagaaaagcggcaagagtaggaaaaggaaagctcaagcggaagtcctcgcgtctgaatacgagcaccctcccaaacacccagacccacaaggcagtgatacgaagagaatatgatgccccatacacaagtcagacagacattctccggaggagtgcctcatcttcaaaaagtcgctagaaaagcaactagctttggagaagggcaaacgagcacgtgtagtcgagaaggccgcagaggcaaccactcaggactcggactcggcgtacccagatttcgatcttcatgtctcgcacatcttcggaggttccacagcgtactcttcaaagcgagaatacaaaaaagtggagcgcgaggtttgttcgacatggcaaggggttacacccaagatgaagtggtctgaacagaagatcgagttctcagatgaggaccaccccaaggctgctgttatcccaggacgatatccgatcgtggtcgaacccactattcggaatatcaaggtagcgcgagtcctcatcgatggcggcagttccatcaactttctcttcgccagcaccttggacgcaatggggattcctcgaagcgagttgacaccaaccgatcaaccttttcatggaatcactccccagtcttcgtccaaaccattgggcaagatcacgcttcctgtgactttcagccaagcgagcaacttccgaacagagcagataacatttgatgttgctgagtttgacacagcatacaatgccatcatcggaagaaccgcactcgcgaagttcatggccgcatctcactacgcgtatcaggtactcaagatgcccgggccgaagggaacaatcactattcaagggaacacaaagctggcggtccaatgcgacaagcggaacctcgacatggtcgagcacacgcccagcccaccggccacagccgagccacccaagaaagtgagcaaaacaactaagacgccgaaaccagatggcgcaatcaaaattgttccactctccagtgccaaccccgacaagacagtcaagatcggggcatcactgaacgagaaataggaactcgcgctcatcaccttcctccgcgacaatgcggacgtattttcttggcaaccgtccgacatgccgggggtccccagggaggtgattgagcacaaaatcatggtgcgacccaacgccaagccagtaaaacaaaaactgcggagatttgcaccagatcggaaacaggccatacgagaagagctcgacaagcttgcatg

SEQ ID NO: 32668 - DNA, 1606 bp, Oryza sativa
tgagttggttgtactgactgttgcacttgctcagggcggagaagttgccgccgcaggcggcagggagggcggcgacacgggtgtagttgatcttgatgccgaagtccaggccgagcgcgccgcagaggcaggcgacggcggccgggctacccagcgtgctcttcacgccggcacagcagtccttggccggtctcgccttggggctccccggcgtgatgtacgtcaggcaccccgccagcgccgtgatcgtctacccgcagtctgacgacggcccgcagctccggccgccgctccctcctctcccatctcccgtctgccgccgcgcacagctcctctggcatcagcggcccggctgtcgccccctgcgcttctccccgccggctggcctccccgatcgatttttgtcgtgccccgcccttctccccgccgaccggcagccgccgcgcttctccctctcggcgcgcctagagagaggagaggggaagagaggggagatgggtagagaggaggaagaagagaacgggtgagaatgacatgtgggccccaccatttttttattaatttgtgtgtgaaacgggtcccacggggtttattgtttttaccgaatcgaattgccacgtaagcgccacgtcgatgccacgtcaaatggagaccgagtcaaattagccacttaggcgtcacgtcagccaaaaccgtcttccaaactgccgagggacttcatctgcactggttttgataattgagagacccgttgtatctggttttctagttgaaggacgaaaattggatccgttgacaagttaaggcacctcagatgaacttattccaccgttagatcttcatttcactaccaggcctatatatgaaggaaaaagtacaccaaaggtccctcaacttgtcaacaggatacaaaaacatccttaaacagcaaaaccagatatacggggtccttttaactatacaaaaccaatcaccagaggtccttcggcggttttgatcccggttttgatctacgtggcggctgagtcagcgtgggacccacgtgggccccatatgtcagtatctcttttccctcctctcccttttctgctgtttctctctcacacacactcttctctcctacggccgacgatgcagcacgggagaaggggagggcggcggcgggcgaacacggtggcgggctcgccctccccgatctcactctccggcatggggaaggggtggcgcaggcggcggaccggcgggagaccagcggcaggcggtcgtggatgcggcgctcacgcggggctggctggccgcgcggtcgtggttggcggcgggtgaggtgttggcggcgagcgcacccgggaatcgatggggcagaggcggccgcggtcgtggcccgcgagtccaggcagctgcgttcgttgtgggggattggattcggtcgtcagctgcgttcgttgctttgatggaaccaaggccacgcgattccgttctgatcgacttgttccatttcatctactgtctcaatcagttcagttgttgaggcgcatttgatttttgatttgggtcgaaaatttgatggctcaatctgatctgagttttgggatgaatggatggatgc

SEQ ID NO: 32669 - DNA, 223 bp, Oryza sativa
attgaagatgtcctctggccatctgccggcaccgacgacaacattaaacgtaacgcgttcgccggtactgcaatcagcatcgtttaatccgcatttctacaaccatcatcattcataaaagccgcttgcgcggctttttttacgggaaaaatctatgtccgtttacaccactgcccaactgctggcggtcaatgagaagaaattcaaattcaatccgcttttc

SEQ ID NO: 32670 - DNA, 250 bp, Oryza sativa
accctctactcccacttcgagaccgacaagtcctactgcctcttcatggagttatgctccggcggcaacctccattccctccggcagaagcagcccaacaagtgcttctccgagcacgccgccaggtaaaaatttcttgttcgatcgatcgccggagttggagaagaagaggaggtgaaattctgaactcatggcgatcttcttaggttctacgcgtcggaggtgttgctggcgctggagtacctgcaca

SEQ ID NO: 32671 - DNA, 1770 bp, Oryza sativa
atttgtgatgtggatttgggatgttactttgatttgggatggggggatatgcatcccacttgattcgggagaaaataaaaaagaaaaaagaggaccatctgtactgctgttattccctctttagtcccggttggttgttaccaaccgggactaaagataaagtatctttagtcccggttggtgttaccaaccgggactagagatcgatttttactcccggttatttcacccgggactaaagatagcgatctttagtcccggattcgtagtcccggttgaaaaaccgggactaaaggggggttacgaaccgggagtaaaaaccacttctccaccagtgtctggttgccgattcactgtgagcgacatatcttgaggctgatggtcaaattagggggtcgttcgacttgagaccgatggtttatccgttctgcggtatgtagacaatataagattatatttttatccaagaattgtcccacgtatactatttttgtagaactttttttttctcgttctaaccatcaatatatatatatatatatatatatatatatatatatatatatatatatatatatatatatatatatatattctctcctcctcgttttctccctgaacttattttctctgcatattaatgaaagcatagcaatcttttaatctcttgattaataatgtttttatcttttaatcccttgattaatatatctttgattagctaaaacaataatcttttagtgaacatggcgaagtgtacatgtaagtaagtaagatgagtccaactatgtgaatacgagcaaccaaataatatattgtggttttatgctcaacccacgcgaggctacacgcacgtgtgcatattcagttgatcgtgtgctaggggtggtaaagagcctaaatttttaggctacaaaattgagttatttcaaaaataaagtgggctttttttttattcattttaacctaaacttatattacctccggtttaaatatatgacgccgttgtatttttataaatgtttgcccattcatcctttttaaaaatatttgtacaaataaaaaatatttaaatcgtgcttaaagaactttcgatgataaatcaaatcacagtaaaataaataataatcacataattttttaaataagataaataaccaaagatatataaaaaatcaacggcatcgtatattaaaaaataagaacgcaatataaggctaaaataggattacgaaaaaagctatccacacctatcgtggcgtgggctgctctcactgggcgacgagatgagagacgaccgagatgtaaaagtacgggccatggacggtttcggagtcggaacgacgaggggtcgagcccgaatcgggatgaaaagtccaacctctcccgatataacggttatttcttctccatgattttttttctaaagaaaaagaaaaaaaaaacaaacctagctagctaggcgggagcgatttgtaactgcgtcaatggcgacggcggcggagtcgcaggggctctccccggggttcaagttcaatccgtccgtcgagcagcttctctgcttcttcctcctgccctacttgcagcaccgacgcctcctcgtcgacggcgtcgtcttcctcgacgacccggcgagcgcgccgccgtgggcgctgctccaccgccacagccggggcggcgaggactaggcctacttcatcgggccggtgcccgcacgtgacggccatggtggccggcggcagcaacacgtgagccgcaccgtcaccggcg

SEQ ID NO: 32672 - DNA, 4861 bp, Oryza sativa
acgttccggtgggaggagttcagcctcaacttccacgccgacgagcggtgccggagcggcagcaccgggtgggtgatgcacgagttcgccgtcgtgccccccgccggctcccgcgtcgccgccacccacaccgcctgccgcatcgccttcaccggccacggccagaagcgcaagcgcgtgcccgacggctacgtcttcgtcgacgtccatgtccagaccgccgccgccgccgccgccgtcgctcctccgttgccgatgttgtcctcgtacggtgaaccaccgcacgaacacttctctgacgatcatccgccgccgcattcttacacttattacacccaagaataccagcagttcttgccgccgtcggagcagagcgatcaagaacaggaatactgtgcaccggagcagcagaatttccaagattatcacgtcgcggcggcggagcagaccgaccaagattacttctatacggaaatgatcaaccaagaacaggattacgcataccagcagcagcaacagcatctcttccatggagatttcctcgcgacttcgcagcagtttcttggtcaggatcacgaggtgatgttcactgggcctcgtggtggtctcgtcgtctccgacaacggcgagcacgccttcgtcgccgcgccggctacagagccgccggtgcacgacgtgttcttggaaactttggtgcctgagccacctgaaaatgcatatgttgacggagcaggggagtccgccatggcatcggctagctccgctggtggcgcgccattattggaacaaccctttgcgacgccgccgcagcagtttcttgatcaggagccggcgccggctggcctcaacgacggcggcgcgatgatctataacaacaacggtgacggcgagcacgacgccgcgccggatgcgcagccgccggcccggtactacagcgggccagttccggcagtggacagcgtgttcttggacaagatgcgggaatatttgatggctgatgcgaagggattatgccgaattgatgcgcccatcaacaatggcgaacacgccgccgccccagcgccggctgcggatgatccgttggctgctcagcacggccacggcgacgcgccgccgctgccggtgccgcccgacgcggcggagctagagcgggtggtcggacatttgttgagagaagtggaggatataatcaaggttgcggcggccggtggctatggaggctcgtcggacaagccgctctccgaatttgacaaagcacaaaaccaaattctggccaagttgatggcagtatttaatcaagtagccgaaagttaatctatgtttacttgttgttaatctctgatgtgacctgacatgatgagaggcgtcatacatctgaaagaacagctctcaccacgttcttttgcttgctggaggcctggagcgatgagatcagtgtgtacccgttctctgtttgtaactggtaggctagaacacgagaacaatcattgagagtgtaaaagatttctctattcttggcagcgtcgacttgtaaacaatgtatttcttttcttgtaaataatctcctgattcactccgagttggctgcaactccaccagttggatttgcacaaatttgtcgtggacacagatttgaggccgatccggcttagttgcgtccctttcctctcctagatctggctaaaggggatcaaggccgctagcagtggcagtagcagagtgagcagcggtgtcggcttccccactcccatccctctcctagatctggtcggaggggaggaggccaccagcggcggtagcaacaaagagggctaacgaccaccactagatctagcggaggatggctcggtgacaatgacggttactgcagtgaggtcgggacggcaacagctactgtggcgagagttgcgaacaagcttgggtgaggcaaatcttccttcaatgaggttgggagaggcggatccatcgctaccaagctcaggagtgtcggatccgtcattaccaatctcaggagtggtggatccaccgtcgatgggctcaggatctaggcggtgacggcggttgaggagacgcgtgcctggggcttgatagcctgccgcaaaggggcagttagcgatggtggatgaggcatgcgcctcggcctcatcctctgttgcagggttgggagaggtggatttggacctcggcaacgacgataggcgttgcgacaacgatgacttctgtgatttgggattgtggattttagggggggttttttttttaagaatgtggatttgggtttctaaggtagattttggagatgggggcatgaatttgtatattttttgtgcaattcttttccctgaaaatccttatcacaggcggtcagctcaatctctctgtgagtgaagtttcttttttactggcagccatcaagatgttgccggtaaagaatggatttcatatgcagataggcacccgccaatgaaaagtttgtatttgcactgaccttcggttactggcgatgccgccggccgccaacaaaaatccattttaggtgtcaatgtaaacccattttgtagtagtgtagtcctcgaagcccggggggaggtgccttcaaccccatcgcatgtagtgagcaacaaccaagcagagggaagggacgtcgaggaggtgttggcgatagagggatgcaaggcagggaggccggaggtatgcggatacggtggcccttagcctccaagtggccggatatggcaacccaatggggaggcaacctttagtgggctcctaggcctcaccaccaaggggaaggccgctaccgtcggtgcccgcgaggctagccattgccgtggtgcccgcaagcctggccattgatacctgtgaggtcagccgcatctgcaacacttgacaggctagccaccggagcccgcgatatcaacgtaggtgtttgtgaggttggccattgcccgtcagccgcctaaacgaagagtgagaggtcggacgaatagtagagagcgagagagcagagaatggggaatagaagagaaagagagcgaagagatcgagggataaggcttgggctgttctcgttttttaaaaaactgaaatcacgtcggcttagagtttagaagtaccggcactgatgttatcagtgttgtttagggcctatttggttctctaccataccaattaattagtagtaccaaaatctaggcaaattttggcactaccaattttttggtagggcaaagttagctagtctatgtttggtttaataccaatataaaaccaaaatttagtatgagagtgaagaagattttagaatgtagccaaattgagcgtggacactaccaattgtttggcttcaatccaaactagcatatttactattaaagttactaaaattttgataaggtcacgttttggcttcaatccaaaacggccctaattgttttaatgaatcgatattgatgtgggtctcatggatatgccatatatttcggtactaattgggagcatgcgagtcaaagagtagcaaaacttatcagggttgggttttgtccaactggtactgataaagggtatcgatatactccctccgtcctataatataatagattttgattttttccttgtactgtttaaccattcgtcttatttaaaaaaattaaaattattatttattttatttgtgacttaatttattatctaaagtacttaagcacaacttttcgttttttatatttgcacaaaattttttaataagacgagtggttaaacagtacaagaaaaagtcaaaatcccttatattatgggatggagagtagtagtgaaagcatcaatcctattcatacaaaacctccttcatcctcaaatattacaacacagttaacaaaaatggcaatatagttgcttacatgaaaataagcacatcgatcgttcgtcttaggccgtgtttagatttttttttttgccaaaaacatcgcatcgaatgttttgacacatacatgaagcattaaatgtggacgaaaaaaaccaattgcacagtttgcatgtaaattgcgagacgaatctttcgagcataattacgccatgatttgataatgtgatgctacagtaaacatttgttaatgacggattaattaggcttaataaattcatctcatagtttacaagcggaatctataatttgttttgttattagtctacgtttaatactttaaatgtgtgtctatatacttcaaaaaatattttggccaagaaactaaacacagccttagactataaatcacgagataagaatagacaaaaatatcctttatacatattcagtggtactctctctatgccataatataggcacggtcaaacttagcacgatctccaaaataacttctatataaaattataaccatataaaactaaattgaaatatcaatgatattattttcagaaaataaaataaaatttatattatactaattattgattaaatattataaaaattaaattttaaaatacgtgcacgtcctatagagcggagggagtataattccagcagtcttaggaattctctcgtcgtaagaaaacaccttcgcatatgtgccgttccccgtgtatttggcccaatccctccctgcccagtaacggccctaaacatacagcaaggccgaatcggactcggagacccaatcccgcagcccgcgagcgcgtttatatagacaccgacaccgggcccccgccttctcaaacacatccttcctgcccgcaaactaaatcccaccggccaccgcctctctcccaaaaaccctagctagggctaatcgcgagggcgagcgagcgagcgagctgcgagcgatcaagaaaggagccccatggc

SEQ ID NO: 32673 - DNA, 2670 bp, Oryza sativa
cagcacctcctccggaatccgagcagagcaatcaagaggagcaagaatacgctgcttacaccgaccaaatccagcagcagtgcttcgtcccggagcagcagatgagcaaccaggaatacttcccggaggcggcggcggagcagagcaaccaacagttcttcgtgccggcggaggagcagagcagccatcagttattcttgccggcagaggagcagagcaaccaacagttcttcatgccggcggaggagcagagcagccatcagttcttgccggcggaggagcagagcagccatcagttcttgccggcggaggagcagagcaactaccaacagttcttgccggcgttggagcagatgacgcagagcaaccaagaatttgcttacggcgagcaaagccagtgctacattgtgccggagcagcagcagctgagcaaccaagaatacgcttacagcgaacaaagccagtgctacatcttgccggagcagcagcagctgagcgaccaagaatacgcttacagcgagcaaagccagtgctacatcttgccggagcagcaggagctgagcaaccaagaagcagaatatgctttcgtctgctacgacgagcagcagcagcagcagcaacagagcaatcaagaagcagaatacgctttcgcctgctacgacgagcagcagcagcagcagcagcagcaatacttacatggagatctcacatcgtggcaagaaccctttgtgacgtcgtcgtcctcgtcatcacagcagtttcttggtcaggaacagctgctgcctgatggcctcctcctcgacggctttggcgagatctcacagcagcagggcgaccaagaatacgcgtactgcgaggaaagccagtgctacatcatgcctgaacagcagcagcagagcaaccaagaagcagaattcgctttcgcctgctacgactagcaacagcagcagcagcactacttccatggagatctcacatcgtggcaagaaccctcggagacgacgacgtcgttgtcgtctcagcagtttcttggtcaggagcagctgctgccggatggcctcctcgatggcttcgatgaggtcgagatgcagaatatcatggctggtttggtcgcaaatcaatctccatagctctggagggggaagaggctgcaatccatgaagatcaacattgtttgttgccgaagcaggggcaaggttgctgacaaggaatcaaagcagcagctgccatgaattagtttatgctttagttgttgtaattaaattactgatgaacggcggcgtctgaaaccgctggctctcgccatgttttaactgagctctgatctgttgtagctgagctcgtaagtatataggttagaactctgcaatcagaagagtagagaattctttattagtttgacaatgtcaaattgtacacaagagcattcagtaaagtaatatatgtaatccattaattggttgtaaagatcattgcaaggagtatagttgcatgaatcttgtatatatggtatctatgtggcctacaaacatgtaacacagctgatatcgctgtgaaagaatatgtatctgcagcctagaatactacccaaagcttctctgtccaatgaggaatccagataataatttggcaacttataatcattgcaaaattgagtaatcttatatctgagtctgctcttgcaaagcaaagcagctccaaaaaattgcaggatgcttgagtaacctccactgcattatcggtttttcttcgaaactttcgggttcttgcacatgcggatgcttgcaggagtaacctccactagctcatcttcttgaataaactctatgcagtcgtccagactgtagcttaacgcttcatcgagaaccactgcagcataccaaaacggatggaaattaatcgtctttctatcaaaagttgggagtttgacagttgatgtgaaacttatgtaacaaatcaatggaaagccagctaggcaggctcacagatgtggaaaggcccaggaagatataggttaacagcatggagtacagagcacagggctcctctgcttgcttcccatgttgcctcctaagctttggtcaggcagatcacaggtgcaagaggattgctagcaagaagcaatgcatagaaggatttctgtgaattcaaaggtgaacgaaggcagcttatccaatgggataagggagaagcatgtcaatatttaggctgttccgagagcccaagtcagaaggcatgaagaaaatggtgactgtgatcgcagtggtaatgtaatgcactaatactagtgtttgttggactctattcacgggaatatgattccacagaggtggaaccagatcggctcacctgggctatggcccagagcctaggccttaagttcaataggctcaaattaaatttcaccatgctaagcccagtatgggccgaaacatgctaggcttggctggcccaggccttggcccaaggctggctccacccctgcgctgccacgagcctgtgcatacatgggttacagttttgcttacatggcttcgaactcactcagggaaagtagagcctgtttatgatgttttggttgcatcaatcaggtcaataggcagtaaagcactaaagcccctccagccagacctgcccagcctcaagatgcaagggtttacttatcaggaa

SEQ ID NO: 32674 - DNA, 1686 bp, Oryza sativa
ttttctatcaatatagtgaggtgcagtgtgcctctgccactaacaagaaatgtatcagcagtttccccgtcttctactttcatagctaagttcctttcaagctcacgatataacctatcacggagattacggcttgtgacatatttcccctgtgataaatccagtgagaacggacaaatatttcagcattccagaaaaggaagaaaactagcaacattatatttacaaacatggcattggtaccattacagcaaatgtggtggaaaagtgccactatggataatcttaatttaaataacttgcaagaaggcaagacattcaatcgattttagattaaacaagttcaatttgacaaaagagatttgaatataatttgacagcattcacttttttttgagacagcattcactttgtggcactttaatttgactccaatttgacagcattcacttcatgccactttaaagcacaatagagcaaaatctgcattctgtgaactacaatcatgatttgatactttctaagcatccagcaatggcagatcatttcaattgtcaaaataaaataatatttagtctaacaacttggaatgaccacatagttgcaatttagacatcgattttttttatcatttgaattcaaagcattatatcaacatctagcttaggcatttttcaactctctttttcaagcaggccatgctagactgctagacagtagagatacaatggagtttatccatacctctttaccgacaaaaggtgaagtgttgatggaaaaagacattctgactgtcggttcctctattttgatggtgggcaagggtgttccagaaactttatctgctatggtttccccaatctgcagagttcaaagaataacagattttataattatcgtgctcttaagataaatgtaaaccagaaagcttgaataaattgttaaaaaacaccaaccatgatatcattgattccacatactgcacaaatgtcaccagcactaacattatcaactggaactcggctgaagttctgataaacgaaaagctcacttattttgctaattctacaagcatcatctggtgtacaaacctgcaaaatatcttgaaatcagtagaagctatattgctgtcataagaaaagatattttttccctttgtcttgcaaacaaaaaaaaggtgacagatgtgcctagatgtaatttgaaaaaaagatcaaatctaaagaaacttcaaaagtgaaccattaaccaagactgcaatggttgctcatgcaaagagtatgagagatttaaatctaaattttggaaaggttgcacatatctttgatgctaccctgttgttctttttaatctttgttggaatattggcatttgcactacatgcacaaaaagaacaaatttgtaccttcacttccatgcctcgctgcagttctcctgcatgcagtcgcccaatcgctatccgtcctttatgttcatcatattcagtattagacacctatacatcagtcagcattgtggaattagtacacaggactacaaataatgaaagagaagttctgataatctattatcagaaaaatagatttgtcaaagtcagaaaggcagctccgcagaaatttgctcacaagaagacaaatcaaactttctaacaaacaataaagtgatgtagagaagaacaaaatagct

SEQ ID NO: 32675 - DNA, 1856 bp, Oryza sativa
ataggtccctctacagaatcaacttacgaagcatagaggattatgttaatagaatgattttagctcgttttctcaattcacattagaacactgtttgaaaaatcagttccataggaacttgtgtagcatgcagcagaacatggaatcagtaccctatatgcagtgtgttacaatttttgatagacataaggcatgtcaagatgtgatggcatcaaaacacttattgaacaatgaagcgcaaaagaagccaatagaatatgttttaagcatcaaataagaagtaagccaatcttcttatataacatttaaccgcaacagtagctagtaccactaggagaactccttccaccatgttgagaacgcgttccacctccccaccgaaatctgaatgtccaggagtatcgatgatgttgattttagtacccttataagttatcgaagtgtttttgctaagtatagtgattcccctttccctctccagatcatttgagtccattattctttcctgtacaacttgattgtctcggaaaacctgcataatttaaacagcaacagaaatggtaaatgcactattgattttcagcacaaccttgtggttgaacagaaataattttcacaaatagtttgtcgttcgttctaaggtgttttcatgaagtacatattcttccctacagagtaaagctttccttagcattaaaattttgaaattaatctcagaatggaacaagaagcttctagaatgtaccttggcttgccttaacattgaatccaccagagttgtctttccatgatcgacatgagcaacaattgctatattcctcacatctcttctagttgcttgaccactcttcccagctgaataattcagtgaaaagatggtacatagattagcatcatataacagaaaagacaggaagctgatatgtatagatagataaatgcatgaaaaataccagtcgttctgatggcactaggtcaagccagtgcacatataatgtggaaggaagatatagtgtatttgtgaaactaaaatgtaggcaaggtagctttcacacaataaacacattcaacaaacttcaacgattaaatatgcaagagtagccagcaaatcacaaaatacattccatgaagtgtttgagaccttgaaccctccatctatttgttagcagttacaactaaggagctactcagcttgtgaagccacaattgctatactcgaaatgtcaactatgtcatcctatgcagctgcagccacccaattctaaacagcgagaatcagattgcacccaattatatataccacttacagattgctaactcattccaggaccaaaaaaaaaaaaggaggggcaacctctaccaagcaccagcatacacattctgtgctcattgcacttgatcagcgaggccgtagcaaaactcgcgtcaatgggcatagtgccccaaccaaccccactcaaagcgaaccacagcacttcacctcacctcacgatactaatcagcaacccaaccatggcggcaccaaaaatccagcgctaagcctagccctacctccgaagcgcacaaacccccctccgctgatcaagcaagcgaggtttgcagtcatgagagtgtttagcgctcaccggcgggggaggcgcgctccttgacctcctggtcgagggaggcggaggccctgagggaggagcgcgcgctcctcctccgggacctccccgccgcgacgacggagacgctcgaggggcggcaccggttggcctgcggctgcggcttcggcgcgaggcggcgcgcggcggtggtggtggtggccgcctgcatctgcatggctgcggaggcggaggcggaggtgggggtgggag

SEQ ID NO: 32676 - DNA, 13149 bp, Oryza sativa
  unsure (1)..(13149): unsure at all n locations
agcactgcttctacgctgtggagcgagtagcatcgtgctccttcctgtgctcgccctcatccaacagggccggagggggctaacacccccatcccaccccctccctattatactaactagcgcattagcatattaattagtccattatcaataaatatgatatagaaaattaattaataagaaagagacggagagacaacgcaaatcaactcctcgttttcattgcttcggcttcacacgtctctccgtactcccattgcgtctcgctatcgagcatggtgtctcaagtctcaaactgtcaaacatccaatgatagagctaaaaagctaaattcaagttttttatggcagaacacatgatgtcttgttntatcgtcggcattgcttactataacttatgacttgttcgccctgcccacaccctcctaaccataaatccaggcttcacccctgccctccaatgagccgcctagcccattgtccttgcgatgagctgcctagcccgctgtcaccatctgcatgcagccaacgagccacctagcaggcggtggggtgagcagcatcagcggagaggtaaaggaagagcggcgcaggcgggagggggagcggcggagaggagggagagctgctgcggcggtcagagaaggggagttatgctggagatagtggagaaggggagctgccccgggctggatccggccgccccctcgtcgcttcgcccaatgccatcgccgctccgcccagcgtcgtcgccactcggccacctctccacctaggcactgtcatcgagaaggacgtgccaagccgccgacattccaaatctgccccaagctcctcaccatccacgcacgtacgcagtgccgagcttgttgccgcttcgatccgtcgacatgagtggtaggagagcgacggaaggggagatgggtgccggcggtggagtagccgaaggaggagggggagtggttggtggggaaaggcaaagagagagagaggagggatgaaaagttaagagagagaacgggtgagacccattatcatgtactgtgaaggataaaatataccacatgcactgtggagggtgtttcttagtctagctggttgctttggctcctcaaatgccatagctgcactgctattgcttttatagttatatgatttcacccaagtggtatctatttttcacgtgcttagaacgagaaaaccattagcatatgattaattgagttttaattattacaaattcaacaaatcgatttactgatattttaaagcaacttaaagtttttacgagagaaacgcattagcagcgaggtttataccaggatacgcatggtatatttccagtatgatttagcaagcttatggatcatcttttttaatctgtgttatgaaaatgcattaatattacacacgcatgagggtagggaggagttgttgctctccatctatttaaggctccattagatttgaagaaatctgtaggaaagttcaattttaaaagaaaattctctgtgagagcctctggatggtgaaattggttcaaaagaatttcaaatgataggaaaaggtgcttcatattctagaggaactttaacatttttacaaattgatttgggaattttagtgcatttcctctatctcccttatctataataaatcaatatataaatcttatatattttttttgttagaccggacccgaccggacccaatcctgctaaagtgacttaccggactgcccatatttttggcaattttatccaatgggtacttttttttatttcaactcgtataacagttcaattatctgtaataaatttacatatttattatttaattttatagatagtatgtataaaatggtattaaaatacataggagtaccagactatctgttaattaacttacctgcaaaaaaaaaaacgcacatgaactccgagagccctttgaatggcaagattgaaaaaacaaatgaataggaaaaacacaggattctgataagaatacaagtgtaaaactgaggattgcaaaacacagggaaaactaagaaatggtcgtttgattggactgcaggataaacgcacaaatcagatgtgagagatagactcaaagggaattttccaagagattaaagtggatgctagattttctacgtttttatttagaatcgtaggaatagaaaagtttcctacatttttccttttcaattcatttgtttttagtataggataggatttcaattcatttgtttttcctccaattcaaatgggcctaagtgataagctcgaaagaacagggacttggattaattttgtcacagaatgatctagtgtggtgacggccagaagagatgggcccaatggcctaagcccgacgttttgccgagaaaaaagtgtgggcaaaaaaaagggcccataactttagtgggttatatagcccatcgaagcaccttaaggttccttgttgggtaagagaaatttgagcccataatttttaaattttttttattaaaagttttaaaaaataattttctatttcaaaaattaacaaaagtagtagcccgccgccgccctcccagagggcggcaaatgtgatgtggcagacggccgtcaatgaaatttgcatgcggcccccttgccgccctccgctagggcgattttacactgtgcggggggccgcctgcaaatgggcggcgaggggggcatggaaatttgcaggcggcccccttgctgccctgggggagggcgattttacactgtgcggggggccacctgcaaatgggcggcgagggggcctagaattttgcaggcggcccccttgccgccctgggggagggcgatttttgcctctctcctatataaccccgtcccccctctctaaaatttcattataatctgtaaaaatccaaaaaaaaaggaaagagagagaggggatggcagcagaaggggagcggcgaagccctactggtttgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtactttagtttgatctggaaaacgtaacctacttttagaattttggagaacaatattgtagagaatgtaacttagtgcgtagtacagaaatgcgaggttaacgcagttattgttttcatcaggcacaatgtcaaataaggtcacatttcatatagttcacggtgaaggaaatcttagatttggtccagatggtgctgatctgtcggattttgtaatgacatctaagggcatcgataggcctgcggagagaacatttcagtcaatttatagttggttgttgagaggatttagaatagaccaagaagtctacacaatgtcagtatcactattgtagtgagtcgtgcaacagaaggttatttttgggaactaatgccgatggacagcactgctgcttggagacggtatgtggaaatggcttttgaatggtcatggcccctcgttatatttgtgtcggtacaagagaaagatacaaatgtttcaatgcaaaccgaagatgtggagggttctatcaatgcaggggatgttgttggaccatcgatgcaaaatgaggaaaatcaaacaagggaggagcaggccatgggcatggcggatgagggggagatagtcggtataattgttgatgaaatggagagggaagattcagataatgagcaagcggaggacgacgcatcatccgatgaggaaggtgatgtaatggccactgattgggcaaatgaggacttctttggacttgttatatcagatggtgatcatgtaccctgggagtataaggagaacgaggtaattgagggtgctaggtatgctcataaggatgagatgaaggaggcagtgaagcattgggcagtttccttgtagagagagtttagggtggtcaagtcaacaaattatgtgtatgaagtgaggtgcatgaaggaagattgtccgtggcgtgtccatgcatataagggtaaatggaatgattattggaaagttagcattgtgaccaagcaccagtgctacttacaaggggtggagaagtatcaccgaaacatcacttcagcttttgtggcaagtgagatgtacagtagtgttgttggtaacattggctttgaaccaaaatcaattattagccacatcgagaacaaattcaagtacaccataagctatgcaaaagcctggagagccaaacaaaagattattgagatgaggtatggcacatttgaagcttcttatgataatttgcctagtctgttagccaccattgcccagaggaataatagtacttactatgacctacatacatttacatcggctgatgatcgaacaaagagtgtgctgcaaagagcctttttctcattgggtgcctgcatcaatgcttttgtgcattgtcgatctgtcctatgcatagatgggacatttttgacaggtaaataccgaggttagatattgacagcaattgggtgtgatgggaacaaccaggttctacctatggcttttgcatttgtagagagtgagaacactgaaagctggtactggttcctagagagagtgcacattgcagtggcgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctataagcaattcaagaacaagcatcttatggagctctttaagaggctctgtgcacagaaccaagagaagaaatttaatgagttgtgggacaagttggatgagttaacaacgaagcaaacagatgagcaatctcgcagaccacaagttgaaggtgacgagcctcccatacctcttggtgcattacatgatgacccaccaacaatgagaaggaggtcggggtcgtccatcagaaatttcactcagtggattgagaatgagcctaaggagaagtggtctctattgttcgacactgatggatctcggtatggcataatgacaaccaatttggcgggggtgtacaactgggtaatgcgaggagttcgggtacttccattggttgctattgttgaattcatccttcacggcacgcaagcctactttagggatcgacacaagaaaattggtccgtccatggccgataacaacatagtgtttggcaacgtagtgacaaagtacatggaagataaaatcaaaaaggcacggagacatagagttgttgctcaaggcacacaagtgcataagtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttatgctgcagcaagtgtgatctgcgcggccatacttacaagaaatgcccgaagaatgcagaagttccaagtggcgcggatgctggtccatctggacaggcaagtgatggaaggcaaccacctggtgaaggaacaacaagcaggcgcgcaaggccaaggcgtcgtcgtgcagcaggcaattccatggtgtaacattgctatcgaattaggaaataaaatgatattgtgttgtgatgagtgttcggactaagtacttctatcgtgtaatttcaatgaatgttgttgtaatgagtacttccgactattgttgtactagtagtattgtgaactcttcggtgttgtatcataatgttatcgtgatgagtgttcggactaagtactcatatcgtgtaactgcagttattgttgtaatcagaaatattctgtattgtgacccttttgtttgtttttactcttgtttaatatgtgttagtaattcacttatgaacatttgttagttatgttgaactaattatttttatgtttctgatcaatctattggatacaggtatgttgtacgacacaccggcgctgttcaaccgtgggattgacaggaaccaccgctcgttcctgtcagtagtctagggtgcacagctcggcactttccgtccacgcacgtcacgcgagtggttgcgtgtcgacccccgtcacgttccttagtacgcgtatgttcaattttacgtaagcacatttcaactcaactgtgctttgtcttgtacttatgtttaaagtttgctctatgcaggttgcgtgcggcaggccttctaccactttgtaggcttgttgaggcggcggcggacgaccgtgacccatcgaagcagtgggatgcagaccggtcactccttgccgctctggtagaccgctggagacctgagatgcacacgttccaccttccctgtggagagatggctccgacactgcaggacgtgtcgtacctgctcgggctaccactggcaagagccccagttggtcccatggacggtgtttttggctggaaggaggatatcaccgcgtgcttcgagcacgtgatgcgccttccacacctaggaccgcccaacacccttcccccgtactctaccatcgggcctagcaaggcttggttgcttcagttcactataagtaaataagttgttattatcatacatgcttatttgcgatcaacagagtgttttgtagtaacatttcattattaattgtaggcggaccttctgcaccctgatgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctcggtgaggcgtgcacgaagactgacgcgggagcgatcatcgctggctgccctatgttgcttcagctttgggcagccgagaggtttgccataggtcgaccagtggtggagagcgcaccctacggggttggacgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtacaggtgagacgaggttacccggacttcgtgttcgagtttgaccgtctccagccgagcgacgttatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggtaggtgtttccgggcatcgtgcagccgaccgtcctccctgccgaccactcgtgagttcggattgttcatttctaaatttttatgatacttacttcatcgagccatataatttacctctcttcacaggttgactcgacggggacagctagcaggtgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggatgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccataggtttcttaagttttgtttatgtttttgtacgaaaacatcaccccgtcgtaacttgatgttccatcctcgcaggacctcgtttgccttcgagcgcccctagcttcggagcagtgcgacctacagcaccggtttcacacggtacagttcagcccagagattagttcatttttgtttcagcttttgcacgaatatgtcaccatgttttaactgcacgtttcctcatcgcaggacctcgtctgccttcgagcgtgttcgcaggcacgaccggcgcttccgcgagctccgcaggggcgttcgccacctcttcgggcgcgttcgccacctcttcctctcacggagcgtcgatccctcgcccacacggtactttactttttattaatactattaaatacatgtatgaaactgatggtccttgtccagcaggatttgcagccgggatcttcggtactggggcctcttcgtctcacgccggtaggactggtcctactagccagttctacgacaacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattanggcgcanggtangagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcgtacaatggattgacacagtcagagttacttcaagtgacgggccgataacgcaacctgaaccgaccatacagttcattcatgcttggatggagtacgaacgtcgggtggaaattgcaagcttagactggaggaacaatccattagggttacataaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatgatggtgattttttgtatgcgtaagactaagggcctatttggatttctaccaaaaacatgccctaccaatattttggtaatttgaatagtacttgtgtttgattttgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaaaatttgataactattgatatttataaaaaatataaagcacagtataaaatcgccctcccccagggcggaaagggggccgcctgcaaatttccatgcccccctcgccgcccatttgcaggcggccccccgcacagtgtaaaatcgccctagcggagggcggcaagggggccgcctgcaaatttcattgacggtcgtcgcccgagagtgaacggacgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcgcagcaactgtgccttgctagcctatcgcgaactggtcaaggttggagaccgcatgggctgttttcaattttctttctccattcttatgtatgtcttcatttctttttcctcttttacgtaccttattctctcgtactctctccggacttataacttgtcgttttacataaatgtgaggtcaaactttaaaatctttgattataaatcatttctaaaatatttgtcttttaaaatggtgactatatgaatagattagtcttaaaaagtactttaataaaatcatatatttgttaacacttttatacataatataataaaaaataatggtaaaagttgttttttaaaagaccgtacccttatgtaaaacgacaagtattatcaaaccggagggagtaattcatcatggtcataagaatcgttttttctttttcttccactcaaattttttgtttcctttttttattactcttttttaacgaaaacttttttatatgaactatttccatccaaattttctacatatagacttttgtgtaccctagactttttaatataaaaagtatatataaactttttaaaatctttctagactttatatatataaactttatacagaaattatatttgcaatttataagtttagtggatattttcctaaaaattagagtccaatccaaacaaacttgaaaacaggaaaaaaaagataaagcatgaacaaggaggcaacccgggcttgtttttcagttgaagcaatgataaacacatatacagaatacccttccatttactctgcaggatgaatatcaagaagaggaactcagaagaaagatggagaatttgccaagtggtaaccactagccttttcaattccggaaaaattacaaattaccttctcgaactatcgcggtcgttcgaattaccccctaaacccgaaaaccagacgtcgttcaccctcaactttcaataccggacaaattatccccctcgatccaatccagagtggttttgtcctacgtggcgtacgcgtgacaatccagtcagcattttcttattaaaaaaatggtggggtccacatgtcatcttccctcttcctcttctcttctctctctcgtccacaagcggggactatagatggccaaaagggccgaggtctgatggcctggcccacggcacggcgttttggcccggcccaagaacggcacggcccgttaagggtcgggcccgtgccggcccggcccgaccaccgagccgtgcctgggcctctccgccgacacattgggccggcccggcatggcacgatgggccgcaggccaggcccgacacataaacaatagggagtaaaaatagacatattatatgccacggtcgaaagaatagggacgttaaatagacttattttacctacatatatgtcagcccaaagaggagggatggaaaatagacttattttcactaatatatgtcacagcccaaagtggagggaccgaaattagacttgttttcgctatatatatatatatatatatatatatatatatatatgtcacatcccaaagaggagggatagaaaatagacttatttaaaaaaggcacgatgggccacccgtgccttcggccggcccggcacggcccgacggctggtgggccatgcctgggcgggaggcacagcccatgagccggcacggcccggcacgaagtgccgatcgggctgtgctggcccgatggctggtgggccgtgcctgggccgggccgtgtcgggcgggccttttggccatctatagcggggacgacgaggatgggcggcgactggaggaagcgcggctcgcggaggaggcagtgctggcgatggccgagatggagaagaccaagtgccgcatggccatggagcggccccaggcggcgcagcatggcatggcgcacggcagtgcggggaaggcagcggacggcgcgcatggcggtgcggccgacggtgggtggggccggtcggcgcggacaggtgggtgccggcggagaggcggggatgatggggatgggcggcagactcgtcaccggagtagacgagtgtggctgacgagtccgtcggcggcggactcgtcagcacctgcagcaggatgttgcggtcgagaaggatgttggccggcttgaggtccaggtcgcagtgcacgagcggctccggcttggtctggtggaggaacagcagcgccgtggtgatctccgccgagatcctgaaccgctggctccacgggatctatgggcgacggcgtgccggaatttttgttcttttttttttttgtctctgccctcttctgaattttctgatctgatttggccgccccgttttggactttgggaatgtggtcatgtgctgcata

SEQ ID NO: 32677 - DNA, 6030 bp, Oryza sativa
  unsure (1)..(6030): unsure at all n locations
aggtagaggagttagggttagaactgcagcacgaatcttaaagcgatccgacggtccagaattcatatgatttgtgaggtgtttttctgtcaaatgccatctagacatcctttttaaaaggcgataatgaaagatttactactgtatgtgaatcaatatgtatctataacatatgagtaaatttttacttaccatttataaaagtggtaaatagttaaatactagtatgtcttacgatcagattattactgctcgatcgggtcagtcactttacatctaaagagaaaaaaaaggaaaaagataaaaacagagtcggtcactttctcggtcgggttctcgggtcaccgtctctccgcctctcccatcccgagcctctcgcaaaatccattctcccacgcccagatccaccgccccccgccttgcctcctccgcgtcgccgcgccagtgcgccccgcctcgccgccgccctcctcctcctcgtcgtcagggtaagccccccgcccgcctcctccgctccgagcttccccggtttccgctcgaggtggtttcgccggacctcttggttgccggtttctctggatggggatcccgatttagttagccatattctgcgttttgggggaaccgggacgtcgcaaatattgctcctggattggcacctgttcttcccttgtttgcgttgcgatttctttctactagtattattattctgtattactattggtctgcagaagaggcccttgctggggattttttttttatggaatatgacgatcgtaggcattgtgttcgtggctcaatttcaaattccgagtaggaattgggcgttttttgtatagtcggcaagtaaggtaatggcggtggcgaccattctgtctgaaattgaatacacagatgtgctagttagtttcatgagatgcaaacggcatggatttgtggtgctccttggcgcgctacccggatgttctagtttcatgccagtcatgccgatgctgctaaactactatgtgcaagtcaacatcgtatgtgcatctgtttttaagattatttttgttagccctaaaaggttcaatcctagggtggttgatgtaagcatattttggaagcacctgtctgttagcttatgggaatcattagtcattacactttttagaaatggaggcttgtgaagtatgtgagaaatataaagttggtacaggatagagatggtgccaaattccttatctagaaagatttggtgccaaatgcctaaagcaaggagctgtcaccatgtgtattaattttagcaacatctctcacaggattcacaaaagtgaatatttaaaaaaaccaaatttgcattttagttggagaatggcttcatcccttcacggcttcacctgatgaccagctttgaacctggtcttttacactcggtgaacaaaaaaaacttatcttttacacttcctttgatcattctcatgcccactaagcactgaaatgttggaacaccagttaccttatgccagaactgtcaattgctggactttttatttagtttcattccttttttctttgttgatgtaagtctcactgagtcactgactcaatgtcagtgctttttgcttgtacgaatacactggttaatgattataagacagattatcagatgtagtgttttcttgtgatttgtttgtcacgaatggaactcgttgcatgggagagtcctgcgttgagaaattactttcagttgccaaccaatcatatgaatgctagtgtttacctgtttcaccttgtgctgaacagaccaacatagatacttcgaactaccctaaggacttatttgcctgctctttagtttatttattgtttaactaccacactctcggtccaaagtagatggcatttgaatgtgaccacctttgtagctttttcttgaggatttcaatactttcatttgttgacaccagtatcagtttttatgtgctaattttttcttaatgtttcagtgttatgtttttcatcactataaagtccaataaagtgaagagtgactctgcatagccagatggctgtggacagagatatctttggtatctcaggtccgacatatctgaatcctgttaattggtacgtgctcctgttgtgattacagtgttacatgacatttcctggaaaattttgtgattcttgaattattatgtatgtactatgtagagatgctgcacttaatctacgtttttaatttttatgcacatgcatgcacagaactaaattctgttaaatgtcttaaggttttggttggttcttatcttttatttctatgatagataatattaggtctatttaggcatttattattacaaaagcttctcatgttaacaaacttgtcacagccatcatttgtattttttttgaagagggcattagtcataattggtatgtcaatagttaaagaaaaaaatggcatgtcttacaatatgatgcatgaaagtgtgcagacaatctttttggagtttcattcattgtggattgagcttcatatttatgtatgtagtgttgacaatgaagcatgaatttagggactagtaatcaccttgatcttcatcgatgatcagcaaaaccagctgcctgttggagctattgccacagagtgcacatatatgattattttgctaggagtacagatgtgatgaacagtttccgtagtgcattaaattggtggaagtaactttttccctcgtttatgaactctcaaaaggaactgtgagcataatcggagatctgtggctgcatgcttagttcaggctgtatatgttttggagagggaccggcaactaggtcgtcaatctgttgaagccttgggacctccttggtgggaattcttccattttgagttgatccgcaagcttgtcgatgatgctgacttgtctattttcggtgcaatatttgaattcaatcctccttcaagtaaagaatcttctgctgataatgcaccgagatttgttattgccttcagaggcactataactgagaaggaaaccatctcaagggatatcgcccttgacctccaccttgtccaaaatggtctccatcggacctcaagatttacaattgcaatgcaagctgtccaaaacgtcgcctcggttttccctggctcaaacatctggctagctgggcactcactgggcgcaggtatggccatccttactggaagaaacatggttaaaaagggtgtgcttttggaaagctatctcttcaacccaccttttgttgccgccccaatcgagaggataagtgatgagagagtgaagcatggtttccgcattgcaagaagtgtaattactgctggattagccattgcaatgaaaggaaaaggcgaggggagcagccagaggtctgttgcagaagattctttccacattttgtcatcatggacgccatatctgtttgtcaatccaggagaccatatctgttcagagtacatcggctacttccagcatcggaagaacatggaggatctcggtgctggatttatcgagaagctcgcaacccaaaattccataggagatctgttttacaaggcattaggatgggaatcggaaccactgcaccttcttccatctgcagacttaattgtcaacgtaagcccttcaccggacttcaaatatgctcatggcatcagccagtggtggcagcctgagctgaacttgcagtgcagtaaatatcggtactctgtaggtgcatgacattggaaaaaatgtcttaggagacccttcttacactttcgtttattcattgtggttcgttccactctattgtagctgtcaatatgctgtaatagatgtttcttgaacctctgattctgttgacatgaaaaaaacttgtaatttcgtggagcaacgatctgtcagtctttacacatatgttcgtgttcatgtagctcttcgttatttgatcattttctggtgttgggtgagcatacctctctcttatgctcataaattgtttttttttcctacttggtttgaaccatattaactgttttaaatatataatgtcattaatgtagaactcgcggctaagcttttctttaaaagccaaagctacttttgaattttaaagttgatttttaagaataatcctaagtagattttttacatggtctgataacaatcatgaaaaaagggtaggcaattgaagtggcgaagagaatctactatagttaattctaaattcaaaatcagtgcagcttctaacagtatattggaaatctccttataggaagcttcatgaaatattatccctatatttcctttgctttccaagagaaagaaaattaaagaagtggaaggggtcggagcttcttatatttggtattcggggaggatgggagaagtaggttcgagatggtttttttaagagtaaattttagaaaactgcaactttagtgacaaaactatcagtttgctgtaacattagcgacatgtttaagtttgttgcaataatagcgtgagaaattatcataaaactataacttttacattatatgctactacagtacatataggtgacaactgtagcagcatataacgtaaaagttgcagttttttgataattttccacgctattgttgtagtaaactaaaatataccgctaatgttacagcaaactaatagtttgtcactaaagttatagttttctaaaatttactcttttttttaatggatcttgttaaaaatgcagaagggagaaaagggaaaaaagaagggagaaaaagaataatatggaaaaaaaaagttgttaaaaatgacgaaaaatagggaaaatagaaaaaacacatgagattttttttctggggggatcggaaaagcatatggaaaatttgggaaaaacaggaataacaggggtaaaaaaaaaggaaaactacggtgaaaaaaaaaggtgggctggtctgcctgggctatgccaaacggaccttgcaggcacggtccacacgccgacgtgccgtgtttgggccaactgtggtgaagtcgtgcctgggctggcatgcctttgtgcggtccatttggtcacctatactcgacctacaaagagcaatgcttgagccaagcccccacgcgcgatgcgcgcatgctccgcgttggagaccccctccacaattctcgcatgagtttggtgtggtacccactagcatgcattaattgctataaagcaagcctcacagtgagccacgtcaccatgttatttcagtcattggatcaacattgtgccacaaagatcaaccgttagaggaataagttcacttgaggtccctcgatttttcgccgagttcgaaattcatcccttgagcgcaaaaccagatacaacgcatccctcaacttacaaaaccgtgcaaataaggtcctagacagtattgtatccggttttggctgatgtggccgcatacgtggctcctttgactaggtcattgtcccacatggcattgacgtagcgcttatgtggtaatttgatcccaaaaaataaataaaaccatgggacccacatgtcagctacacaggaaataaaaattggtggggccccacatgtcatcctcacttcttcctcttctctctatcccctctctcctttctcttctttctcatccttcctcctcccttcttccagcaacacgccgccgctgggaacctgcctccgccgcgagcgcgtcccgggcgtggtcctcctcgagctccgcgaggcgtgttgccggcgccggcggagcaaagtagtcatcagggagctctcgcttgcctccgcgaagccctcgcctcgcgccgccgccaccacggcatcgtcgtccgtgtcctccgcctcgtcgctacgggggaggaggaggaggagggtggggggtggtgtgcncggcggtgtcgttggggnagaaggagggtggcgggggtgcagccgctgatggaggcgctgccaccggtggcgagagcggcagcggcggcggcggcgtggtacgaggtcaggctgcgacggtgctcggggacaaatttcagttagtgggat

SEQ ID NO: 32678 - DNA, 14234 bp, Oryza sativa
aaggagaggagagggtggagaggtgggaggacgagatccgggagctgcgcgcccatgacgccggcaaggagcaggcacgctccctccgccgccaccgctctcgtctgccgacgtcgcaccgttccagcccgtcgacgccgcaccgctctcgcccgccgacgccgcctctccgcaaccgtgctcgcccgccaccgtcgccgcttcgcctgctctggccaccattctggtgcggcgacggctccttccccagcggcgacggtgcccggttgaagaggtgccccttgggccgccctgcgccgtcgcctccggccggcttgcctagtcgccagaagataacagtagagtgagagagagaggagatagggagagggtgatgacgtggccagctgatatgtggggcccatgtggtcccacgctgactcagccgccacgtagatcaaaaccgggatcaaaaccgtcgaagagcccctgttaaccggttttatatagttaagggacccagcatatctggttttgtggttcaaggatgatttttatcccgttgccaagttgagggaccttcggtgtactttttccatatatgaaaacaaggcccaattggatgtttcagtccagtcgaaccccatcatcttcccgtcggccttctgccatgaattgggaaagacaccatagttaattcaatttactcttttgataagtcttttgcaattcctcatgcaaaccatgctaatcgtctccatcatggtttgtttcctcttcaacaattgtaaaccagaaactgccattatctggtgtcatgataaatctcattgattctctttataactctcaattcctcctatataagtgtgcaacactgcccgttttcctgcaccgtctacactgagtcactgagccaatttgattccctcacttgcataagcctctcacaagtcgaagccgctttcctatgcgacaacagccggctgatttagccaacatttggtctccacctatgggaagagcacaagatacgaaggcttctgcgtgttcatgaacaacattaggttccctttccgtttgatttactccacattcatttttgtaatataagtgctcttttctttttgttgtttccagcaagcttagagcaagtgcatataccgatccactgattgggcgatgaatgatcaagccataacagggtcagggtagtaatccaatcaaattacacattacttcatttttgtaattgttactctctctctctctctctaggatagtcgtcttttaaattttgctcatgtgcaacatggtgatttaatacagaatgaccatttaagcttctgcaacactttatgaacgtaaggaaattttataacaatgagcgtgctaattgtaatttacatgggtccattgacaacaaatatttgagtgagatctcccaaatttcttgaaattctcatgaagttttgctattttttaaggctcaattccatattaatttcatatttctttgttcctattgagaaaatctcagaaaactcaatatgtacagtagtacaaactttggcttgggttgtagttttacatgtgagttaatcgtttttgcagaagttcatccttaattagtatatagaggtgctgatgtgtaaaaaaaatattaatccttctaggttgcctttgcttttttatttttctttccccaaagtgtcatccaacaatctagctatgattgtttcccaaactaggaaggaagcccgcacagatgcgcgggcaacttatatataaaagattgttaaaaaaagttgtatttcactatattaattataagaaccgcttatttattatttataaaaataatgctaaagaaatcccatctcgccatattgattaattataaggaccgtagatcaccttataattatatgaaaataaatatctagaccacaaattttgatatactaaatgacaatagtatctttcattttcaaacagaaataactatgtcccagatatatgtatactcgcctgtcaccactatttattatcgttgtattataagttgtgtgcctttttaatagatgggattacatccatccaagaaaacaaacttaatatgtcattaatacaacaaaaagatcatctgtacttcatacctaattgttcatgcctcacttgtgtttaaatatatgtataaatattttgaagtattgctcctaccaattcatgggataaaacatttaacattagatataaatgcccctctaatgggtgaagccgacagtagccaccaaggctttcttctcttatgccttgaaacatgtgtcctttatcaacatagccgtgctcctcaaaatcagtgtggagcataattttaacgcttaattcattatcagctaaagaattgcatcgataagtaggctagttgaactttattgcgaatagtagcctctcaccagggtcacctttactcagtcatatgcatgcccccgccatttctacagaagcagagtatactacgttatccatgcttagcgcccttcaagggatgacacatagataagatggaagtgaatttttttttagttttgagtccatttatgaaatagagtgacacttgtttatggcgttaattggtccactaaattttatcatatataattatctcttctgaaaatatgtagagttgatcttgagaagtaattgttcatgaacatatgaatatgagttttgatatttttttttcattattgatctaattcatctatgcatgttcgtggggtaatatataatggaacaatatatgttatcatgtttatttgtgctgattgttaagacaatttataataacatgaagattgatagaatgtggtttcatttaatatttttttattcaaaagatagttaacatatttatcaattttctatagaaaaaagtgggttgtaaatgaatataatatccactatcagtacgttcttaaaaagaatggagtaattgttaagattatttagataagaaagacataaaaagggttagaatattgttccatgtgataactttttaatcagaattgctatatatatgtcatgaatttcactttgggccatattttattacgaaagtcttattttagactacccttaaaccaatatttttattttggacagggtacgtattaatgatctcggttatgttggcttctaatgatcaattaactgtcacagttatatgtaataccatatttttgatgtatgatgtagatggatagaagcgttgaggttggtccaaagaatcacagtggtaaaaatatgttatgcaaagtaaaagtattggttaaaggttggtacaaagcaaaatatcagtaatagaaaggtgccttaaagtgaaatttaattttaatgttgagattcgtgctatagcatttagcgatgtggtagaatgtggagagatgtaaaaagtgacactaactgcgttcttaagagcaagtttaatagtatagccaactactagctttaattcatctatcgccaatctaatagctcattcatacaatagttacatactacactattaatacctagtcacacctgtcatagacacactgtgtcttggagtccgtactacagctggctataaatctgtagcctgctgctcttctctctcctgatttatctccttaaaatatatttgcagctggcttatagcatgctattgtacctgctctaactgagctattgctactactccaacctctactactaccagtacatgaccagtagaaacgttagatgctaggcatccacgcgactgtcaaagtgcagaaagagaggggtaataattagcaaaatctcaatgtgcatttacatttataatttataattatagagtactacacagtaattagggtgtattttatattatactggagtgtaattttaatcattcgtttttttcaaaatttaaatattgttttgtatttttaaccaagttaattttgtttaagtttacatcatcatattaataaattatgttgcattttgtttggtcgtaaccatagtgatctccttttaattgtactatgaaatctgactgttttagcgttcgttttatgtcagaagaaatatacggtctcttttttattaaaatatagttaacatagaataccctagcaaataaactggagagaaaggagccacaacagagggtagactgacctctaatttaaggattaggaaaacatggtcaatagtttttcttatgtacgtatatatgcatgttttttttccctctcctgtacgtgcatatatacatacatatattttctccagatgaatagcatatatttatttttctctcttacaaatacacattagattaggagagagggattaattattttaatatgatttgatctaatctaatctaatggttcaaaataataattcacttgtacatgcgaaaatcaattgttatatatttatttttccctcttgcaaataaggatgagattaggagatggattaattactttaatctgatatgatctaatctaatataatggttaaaaataataattcacccgtacatgcgtaaatcaatggttcgatgtttagcttttatttttttagaatattttggattttattgatcttaagttataagtttaattctaaattaaattatgaccatttaacttaccatgtttgtgttaaatttctagctataaaatagggtgtagagagaaggaggagatatatatgggctgcacgtacatttataacctttttttgcacggtacgtcactacgtacaaagggaaagagttacgtgtgggaggagagggaggtggatgtggaaagatattttagataaatctgccggtttgaaataatgggtccaccgatttaaatgaaaacagatggccaatggccagatgttttgttttttttcttagaatttctaagaatttctattattatttattagaatgccatgtgacagcttaggagcgtttgtaggatgccacgtggcggtttgagagcgtttgtaggaagtttggctttggagcgtttgtatgatgccacgtggcggtttgagagcgtttgtaggaagtttaatggacttttagtatataatagatagatagtcaattatcactcctgatgaaccatccagagactaaaaataattaagatgatgtgtgatgaaccatctggagactaaaaataattaatgtgatgtgataccataagagaatagagaacaaacattattaactatacttaacgaggatgtgctttataaatacatttaggatttatgggattacacgcgaaagtgattaattactaacggtaattaatgagcgataattaattaatcaccgcgagcgtgatttcaagccaaatcgtaagcaaccggcttgatgaccgctggcgcgaggcccgggttaacgccaactttgagcacgagcttgaggtcgtcgtgttggtcctccagcgcgtccctgaggaaggccaccatgaggccaccgatggtcctcctggccacctccttggtgtccccgaggttcctcatgcacatgcagttgttgatggcgtacggcacgccgtcgtccagcatgtccaggtggccgttgtcccgcagcacaaagtggtatcgcggcggcgcgcactcgtcgtagaactcgcaatggttcacgcccgccggcgcgcatggcgggccgccgacgtgcctcgggcctaggccggtgccgatttttttgtgtttttagaccgtagagatggaaaaggggtatagatgtcggtggtaatactttcaacacatatgtgccgatacctatttaatattttatagtaatgcgatgaccatcaccgtcaggggcggagctagagaaatatgagggggttcctaagagcaagttcaataagctagtttagccgacgataaaactgccacatcggatttgtcaatgagctggacacgagagagcatgagtcggggattaaattatcaccggctacacacacatcccaacgcaagtgcagcaacactaggctagctttgactggggcatgcaattgtggggtccacgcgagctggtgtgatgtaggaatggcgagacgaaacgacagcaacaagattaaaaaattggatgaggaagctagctaaagattaaaaaattggataatagtccatgtaaacctgcttattgtatacattagctcttagcaatgtctatgctgatgtggtcatttttgcagccattagcgggcgacactattgaccttgctctaactttctttatgtaaaatactgacatgcatagttctagaacgatattatactaaatagttacgtacccagtacatataagcatcatctgtctaattgaaggcaatatacaacaagaaagtgcatggaaaaaatttaaaaaatgcgtaccataaaaccatgccggattgaattttccatctttgttggaaataactgatatgggaagtacaagatcacgaggttggcaagacccattctctaagtactttctttttaccttgtctctttggttgggatgataatcatcaatttcttttcttaagcctggatgatattcgatcgtctcttggcatcatctagtcgaagggatgaactcttcacattgttggtacaatccattacttttcttttaagaaatttctccatagaaaccttttagagatcaaataaaaattttcaagctttatattgatacaacaaattaaatatgaaagttgagagaaagcgctcacgtactctaaggctgcgttcgttaggggtagttcccaacacctcctcctcatctttcgcgcgcatgcttttcaaactgctaaacggtgtgtttttttcaaaaaagtttatatatgaaagttcatttaaaaaatcatattaatccatttttaaaaaaaattagctaaaacttaattaatcacgtgctaaacgctgcttcgttttgtgttccagagagtgagggttcaaccctcactcccgaacagagcttaagtgttggttaacggctgtgatttttcatagaagcacaatcacttgcaaccgttctactccggtaatcccctccgttgactgcaaacaacaaacaataacctaatcattggtagacttgcaaaattaaaagaagggagcggcagggtgcaaccacgcaagacttaccggccggccggcgttggagacttggagttgggctgcttctgcttcactcactgcttgggctggtcggcaacagcaaggcgccaaggctgtaagggcaggctggcagggcagggcagccaccaaccgggcagggctcaggctaggcagctggccgccggtgtctggctcgggcacgccggcacggccggattggcgcagtgctgtgccgcagtgggctgggcagaacgggaagacggcgtcacatccatagaacgagaggtgagaaacaatagcgatttttgatttttggaagaggaaacgtcgaactcgaaacggtgccgccctggcgccttgattcccgtcgccgcccagccctacctctgccgcgcgctatcgatctatgggaaacacgagcgaattctcgtatcctcctctcagttgggcctggtagagttatagttttgggccagagttttggatctttggggggaggggggttccctggtttggactggggactgtctatatggtggagaatataggggtaataagctatttagaattttgggccgggttcttgagcacccccctggcccattgggctccgccccaccgtcaccggcatccccgggtggagggaccatggcttgaaggtcaagcgacgagggccagcctggagaggtcgggcttgacgccggggaggttgaggacgctgccgaggacgtaggcgaggccctgccgctcgtcggcggcccagcatgcaaccttcctggtggcatcgttcaagtcgagcgcgatgccgtagagctacggcatgacggcgatgaagccgtgggaggcgacatgcgacaggaggccctcgtacctaggggcggatccacccattgggcagggttggacggccgacccagctacggcccgcaccgccccaccccccaccctccttggctctatcaacattgggcccaaaatgagcagccgaagcgctagtgaccagtctaaccgccgatcgcataagccgcacgcgagcgacgcctcatttctttcgacctggatcggcgccacaccatcaattcgccttcgcggcttcccccttcagccttcaccgagacaccgagtcgaccaagcgccgacgcagcgacgccagcatgccggtaggtgctagccctatagggagtaggcgcgctcccgcgcactagccgaaacggtcccgtcgcggcgccgcaacgccgctcactccattcctcctggctcggtggctcatgcaggatgtagtcctactgttctggctgcctggttgacagccctaatcactaatcaattgattacttccatcaagtctgaacggtgaaccacttggctttatgagttgtctaatatttgcaaattaaggccctgtttggaagattagcccagagctaatgttgggagctcatgtttagtcatgaattggtaggctcaacattagcctagggtggtatgtttggatcgataggctaattcaaggctaaaaggtggagagagagtagaaagagaggagagagaaggagagagagagctgctttttgatggtccccacacaaaattagccccattagcaccccttggaggggctaatgttttgaggggggctaattcacattagctcaaaattagcccacctgtttggatccttgagggctaaacattagcccatggaaccaaacagggcttaacacgtcaactattatcttttgttgtataatgaatcatatatgacacagattattaatttattttaaaatgtttttgtttcccttaatttattggttacactatatttctatgtgattatagtataaatatgatatttagtgtgtttagctattcttatgaaacgaccatctccgctagagatacaagtgggtagtcccgttacccgtataaaaacctgtttactagttcatttcttacatggtagtgcaaaatttagaataaaaaatgaactagaagtgagataaacgggctaaaaaaatctgcttgtccgtccgcttgtatccatagattctccgtcctatctttattttaatcctgcttccgccactgctcgtaccagctgttcaccatgttgcagccgtggaggaagatggcgaccgggtaggtcccggcgttggcgggggccaccaccatgagcggcttggggcaccaagccttgggcacgctcgggagcacgctgtggtcgacgtgtttggcctccacgcggtgcggcgccgcatggaacaccgccaccatgccgagcgcacagccgatgtgccatgtatgatatattgatatgaggtatgtatcttcttcttctttttctgttagtgtggtgattggtgaacagggtttgcaatctcgaaattaggtttttggcgccggggggaggggtggttgtggggggtgttggtcttgaaagaaccaaaattttagaaatttcttggccgaaattatttgaaaatttgaaatttttttaatgaatttaaataaactttgactaaattcaaaaaagaaaaagaaccaaaaatttcggatgagatttgtgcttgccggtggggggcaagaaacaaaattttaataactggtggtgaatgttgagacgaggaacaggaggcgtagctgcatgctaacctctatttaaatatactgcagcgacgcgcgacagtaccatttgcggtgtgaccgcactatttctttatgagaaattttattacgttaacgaggtatgttatagaattgagatgtggaacaatacgaaccattgattagagaggaataaaattatcataaacaatataatggcttccgtatcaatcgtccagcaggttaaatgcacaagagatttgtaggagtgattgccatgcactgatgcatgcacttcctgaaacaccgcggcactgcatattggctactcagtgaggcggttgacgacagcggtctccggcgatcgaggagaggacaattgtatattgcgatcttggccgatttagatggatagcaacagcatttggcgatctgcataattagatcgatgctagtactatactctaccatctattcgcgctcgtcatctgaaacttggccatctgaaatatcaattaattaacgtcagaataagaaagggcaaaagatcgacaagaatcaattaggagcaagcttagcaagcatcacatgtacctccgtcaatgctaatgcttggatgattcgggtggatcttggtggcacgcctcagcgcagccttcaattcgttcacctcctcctcgctggcgccttcacaatccaacgagacattgacctcctggagcgatggcaagctccccagtcccaagtcgagaccatcgtcgccggcaccggcgacggcgatcgcctcccgcacggagaaccgggagcgaagcgttctgagcctcggcattgctcctcgccggaacaccgccggcccaacgaatccccacaacccacagcacaccaggcacgcgaacgagccagctgatccaatcaccaacaccaccccgcggattccgagctcctcgtggtccacctgcagctgcagatcgcggagagcaggcagcctcccgagggtctcaacgtcggcctgccggatctccctcacggcgatggatagcgagcggaggtttgggacatgcgacggattcgtcatccacgccggcagcgacgagaaccagcagatcttctctgtatccagtgcgacgagatgccgaggggcgacccaggcgtccaaaccacccatgttctttcgaacattgttcatgcagacgtcgatggagagacgctggatcttctgcaacttgtgtaggagacccaccagtttgtcgttccatccgtcccagaagatgatgcacagcaccctcagctccgttaggttgcccagctcttctagaatgcccacagtagcacaatcgatcaacacatatgctagatgttcaagccttgttaggcttccaatcccatctggcaccctcgcaaacccgtcgaagcatagggacgtcaaatgtctgagcttcacaatattcagtggcaagtcacaaatagggtttgccctcaggtccaaagtttgtagaaactgtatgtttcctatttcttctggggcctcccgaatatctgtgtcacgtagtcctagatacctcaagtgaaataaattcccaacatacttaaggctgtaaccttgtgaaagatcacaaccttgtaaatccagtacacgtaaaactcagaagctcctaaggacaggtactagatcagtggcagatggaaagacaagagctgtccttgcttgctgcaagctccgagttgctgaagtcatagcatgatcttcattgccattttggagggacaacctccgaatcgtgtatgacagagatccttgatccctaccatttaatatagtaacaaagttttcctcacttgacaatgagcagataagatcgaggaccatatcgtgtacgcgacactcagataccatgtcagtatacatatcatatatgggttggatcatatttctatttacaaggtcattgaagtaactctctccgagttcaaataggctcctcccttgtttcccacactggataaagccttcagctacccacatccatatcaaacgatctttttcgattttgtaatcttccggaaacacacttaaatataataagtaagttctcaaatggggtggcagatcataatagctaaatgacaagatctttctcatattcttaacatccagactattctcgagaccagtaccaaccgagttgtacaccttgtaccactccatcttatttcttgctttacaagccagcagactagccattgtaatgatagctaatggaacacctgcacatttctttagtattctctcggatacttcagccaactcctcatcaggatatttttccgtgtcttcacagttaccaaatattcttccatatagtaatcgtcgagagttatttaaagaaagatgtttcaacttgtaaacaccaccagctttttcagcaacctcagaaatacgtgttgttgtaatgattttgtatccaacatcattatcaggcaaagcacatttaatcattttccatattgagatatcccatatgtcatccataacaatgaaatacctgcatatagattaagtccttaattaggaaaaaaactaatgaaattagaacgggaagttcaaatactggggccaggtagattagcaagttcgtaggcaaaactagtctagctattgtgaatctttgccaaaacagagataaattattcactcaagaaaagaagatttggacatagctatttaattccgactcaataacgatgtaaaaaggcttataagcagttgtagtttttttttatttaacccggacatgatgaacattctcaacaattaacagtatgtagactgctaattagtacttcctccgtttcacaatgtaagtcattctaacattttccacattcatattggtgttaatgaatctagataaatatatatgtctagattcattaatatcaatatgaatatgagaaatgctagaatgacttacattgtgaaacggaggaagtattacgaaatggatggcatactagcaaattattagttgctgagaaaaaacatcatatatatgtacagattggtggaaggaatgtgcttccatatataccttttctgttgaaggaattctctgagttcattgatgagctgcacctcatccaaatccaatggtttttcattgagatctttatatttctccttgtcaagttgataaatgatgtccatgaacaatttcttcaagtcaggagtttgagacactgatacgaaagcacaacaatcgaacagtgatctaatcttttcatatactacattagcgagagttgtttttcccaatccccccgaatccaacaatggaaaccaccttgcctgctcgctgcatggacactccattctcttccgtcagaatattgatcagctcatctctcgtctcaccgatgccaacaagctctttctcatccgtgtaccgcgtgaataaacgagggtcaattgtagcagtcttatcaccaccaccagcaccaatgttgatctcatacctgcggcgacgctcgtgaacctcgacgacgcggctcttgatgtccatgatctcagaggcgatcccatggcgagccttggccttcctgaataggccgacacttctatcgattagcttgctgatgccccgtggtttggcctcaccgtccccgttgtcgttgccgatgtcgcgcacgacgaacgcgtcgatggtgtcctcgatgtcgaaagagagctctctgagatccctggcccagatcttgtcctggggatcaagctggtcggccggcgtggcggagaccttggcgagggcgccctgcatgctctcgagctcggattggaggaacctgatctccccctttaccgccttctgcagattgtactcgccgacgagcagatcacctagcttggcgatgacgcttggcagtgcacccgtcgccaactccatggatcaagatcttgtcctcctccctgggtggatactggatggtactgacaaagaagataagctcggagaggatgagactcactcgtcacccggtggatcgatcgtgggtgaatcgcctagtccagtcccctgtcgtcgctgactggatcgatagggcgacgctctcgattgattcgaagtttcccaactcgatcgatcgccctgcgctcgaacaggaggaagagctcgatgaggttagacggcagtttgaacttttgttcttagacttttcgatttagatgagataatgattagaaatgaaagatatcgttgctgttgggtcgctatagtcctacttggaagattccgagtaggtaaagttgacctgctccatacatgtgcttctgttctgacttgtgaccatgtctgcgttgaaattcgagttgcttcgccttcatcaaaagaacaattcagctgcaagtgagtttcaagtatgttttccaaatcttcttttccatatttcttgcccggctgcattgaccagggctgcag

SEQ ID NO: 32679 - DNA, 618 bp, Oryza sativa
cgtagatcgggttgatgctcttcctgaagcccgacggcttgtccggcgactgatccttcgccggtacgaccatcctcgggcttggcagcgtcatcgggtacacgccggcggcgtcgaagctccccgcctcctccatatatataccgccggccgccgctgctcgatctctccgatcagtttcgctccatgccgtcgacggggtgttcgtcgtacgtgttgctggagttttaaggccggagacaatgcagccggccggcagcaagttcgatcgggaggggatattgtatggatcgccatggctgggcgcgtcgtcgtggccgccactacaagaatgggtcgacgtggagggggcgaactggcggagttgaggcggcgcgacacgattgatcggttggttggtggtggatgtcatgtccgtcatcaaacgcgcgcggccgggtggccggcaggtcgttggtgacgacgaccagattgacaagtatgaggggctcaccaattggcctgcttggaagcccaccaattggcccagaaaaaccgggaatttttttatttttaattttttttattaaaagatttacaaaaataattttgtatttcaaaaattgacagaagtagtcg

SEQ ID NO: 32680 - DNA, 542 bp, Oryza sativa
  unsure (1)..(542): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaggtactttaacagcaaaatatgcccttattcaagtgataaaatgacctgcgcaaaaactgcgacatcctctgttgattgcaatcacgggaaggttgcatttgcaaatccgtttggaggggccaagcaaacttactcgtccagtacaaccacgaagtgcccacattgtgtggaatcccgtaatgccgagtaagtataaagtagttaattgtaaaaccttggacacgctctccatgcttttctatatatgttattgtattgtgcttcctcagtactccatccgtaaatccg

SEQ ID NO: 32681 - DNA, 411 bp, Oryza sativa
tgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaa

SEQ ID NO: 32682 - DNA, 1554 bp, Oryza sativa
gagttacctcaatccttgcagggtgtccataatgtgatccatgtgtcatagttgaaaaagtgttaaagggtacctactgaaaaagctaatcttgaacagatagaagtccaagaggatctgacatatgttgagaaaccaatctgtatcctagaaacagatgagagaagaacaaggaatcgagttatccgtttctgtaaggtccaatggagtaatcactcagaggaagaatctacttgggaacgagaagatgaattaaagtcagctcatctgcatcttttcgccagttcttccgaatctcgaggacgagattctgtttaaggggggtaggtttgtcacaccctaaaaatccaaaatatataaattgtcgtttaattggaattattagaatttattttaaaagtctagaagagaagatctaattttaattaataaattccaatataaaatggggccagataaaattttattaaatactttgcttaattctataattcctagatttttttgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgcccgaaaccctagcgccgccgtctccttccaaatccggccgcgtctttccgtttccggtgaaatcaatagaggggaaatgatcttcgggatctcctctaccttttctcttttggaatccccggctaaaatcgtttggaaagtgttggattcgaggtcgattcggattggtctctctctctccgagccataactttccttttcgtcgccggtcgccgtgggccctcgccgccgcctccttgcccctataaaaggacccccggtgtctcctctacccgccgccacccttgctttcgtctctcgccgtcggaagcgccctaacgccgtgcaaccttgagccgccgtcgtcaccgtcgctccagccgtgcgccaccgccgttccggtcatcgtcgtcgctcggggaggtcgccattgtggtcgccaagtcgtcgccgtcctcgtccgccccttcgccgctgccgaagaccgccggagcaccgtcgccgtcgtcaagccgaaggtcgccgccgcttcttcttcgtcgccgtcgccgtccgttgctcttccgccgacgttttggtcaccggtgagttcgccgcgtcgccctctacgtcctggtgtcctccgttcatgccgaagcgccgttgttcgccggcgagtttgcgccgcccgagccgccgccggtggtgacgtcatcgccgatgtcatcggggccgtctgccgtgagccgctgtagacccgatcgatctcggccgtccgttttggatggatcgatctcagccgttcgtttccgtgaaccgtcgccatgcgcccggtccagggctgc

SEQ ID NO: 32683 - DNA, 699 bp, Oryza sativa
tgaaaatacataaaccactcccaacaattgttcttgcatttaattgatataagagggtcagaagttactccgagacacgacagcttagtacactcttgtataaaatgttgaggaaagtcatgcagttctcagagtaatgagacagactcgatgcataaacttttacactctaacttcaatatggtgtttgttggttgcttgattaattcaataggaaatttatacttttttgcgaagatagtattaaaaagttccaacataactctcctccaaaaaaaagttccaacataacttgcaagcatatgaaggaattagagtgtggtacgaacccactaggttgcatgtcaaccatttgtccacgccttttccccaaaagctcaacaactgaacccatatattcctctggaacttccacagcagctatctggaacacagtagcaagaataagttggttacatgaaaactgagggattaggagttgtaggatagtaaaatcaatagcaatactagtgccaaagacaatatttgttgagaaatctctactattctaaaggggagttttgtccgttcgacgatccctaccatccccactagtgcaacaaaaaaaaaactccatctaaaataaaccggtggatgcatcatgcacctgaaaactgctcaccaagaaaaaccgaaacagaaaaaactaaacgtgaacta

SEQ ID NO: 32684 - DNA, 4983 bp, Oryza sativa
cgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaacggttgggcctatgcaacagggtatgttctgtagcgttggattaatactgtttaattaatacttaactgttttatcaatttctgaaatatttgttaaatgctgtttatgcaaatgaaaccctactatgccatcctttggtatccttgtgcatttgcatatttgctgtgtgacttgctgagtatgtcatatactcaccttgcaatcattcatcagaggaagagttctacagagatgctgatggtgtggaggattagacgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtatacacacatgtaagcgtttggaattttggatagaaattccgggcgtgacaagttggtatcagagcctccttgaccctaggttgtgccaaatggttacccatagaagccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttagatgccgcgctacaagcctgagtacttgtttggtgttgagggatttgtccaagagttgtgtacgatgtcctttgccataggatttgggactgcccctttttatgcccagattcctcatgatcgtcatgaagagaagtgccgagtcaaagtcactttgaacagtaatagtgatgaaatcccctcagtgatgttcgaagctggaggaagaaactacatccatgcgtgtcaggaggtggcaaggatcgccataggagagctccgcgatcgctattgtgatcagttggccgacactgagtatcgctaccatcctcgccaaccacagggaagtgatcgtggcagctaccttgagactgaaggaattgagaatgatgctaccacaaggcatttggttgagatgctgtgggctatggatgaaacccgtgcggagactgtgttagcagctcaagatcgtgaagaccggaatcgtggtaagatttgcaagctagaggacaaagtggatcgtttggagaaggaactagccgcattgaagggagaagcaccaccgcagaaggccagggttcgtcttaccgcaaggaagagagctctatttgtccctcgttaccaattggcgccaaaggtccgtgtggtggagaaagaagttaccccagccctagcagatcctccggttatcattataagtgatgatgaagaagaagaatccaagcacgcccattacaagatcgagtggggagcaactcaagatgatgaagatgagccgaacgagccttcaatcaactccgatgcccggaagacttagaatgccttgtcaaaccgttgtcttagatcgttgtgttagtttgcttgttttaagtttggttgtgtgtgtctcgcatgtgatttacatcagtggtgggatgtaagtgcgtgcgtttgtttgctttcgagtgttaggtagttggtgagttcagtggtgtgagaatcttcagttttgtaataatgaaactcacttaagatcaataaaagctaaagtaattctcggtcctaagtagttttccccggtttctcttcttgtgctcctgtccatgccagatggtgctcactcgtagcaacgggaatggccccaacaacaacaacaataacaacaacaacaatggagagaatcccacacttgcccaagtcctggctcaacagacacagcttatgaacataatgatgcagcaactccagaaccagcagaaccagggaaataaccatgcacctccccagaacaagttagcagaatttcttcgtgtgaggccgcccactttctctagcaccactaatcctgttgaagctggtgactggctgcacgccatagaaaagaagttggatttgcttcagtgcactgatcaggagaaggtctcatttgcatcacaccagctgcatggccctgcctctgaatggtgggatcatttccgccttaacaggactactactgaacctatcacttggcttgagttcaccgctgctttccggaagacgcatataccatcgggagtggtgtctctcaagaagaaggaattcaggtcgctcactcaagggtctcgctctgttacggagtatctgcacgagttcaatcgtctggctcgttatgctccggaagatgtgcgcactgatgaagagcgccaggagaagttcttggaaggacttaatgatgagctttcttacccactcatgactggggattatcctgatttccagaagttagtggataaggctattcgtcaggaggacaagtacaaccgcatggaacagaagaaacgtcagattgctcaattcatggcacaacaggggaatagtcagaggccgcgtcttactttaggaccccagtccatgcctcagggaggttcttcgtctgttgttcgtccgcagcgtcagttcttcaacaacaatgctggcaacaacctccgtaatcaagctccacgccctgttgcagctccaacacagcaacagcctgccaagagggagcaaggcagcaagcccgtggtgtgtttcaactgtggagacccaggacattacgctgacaagtgtccgaagccccgacgcgtgaaggttgtccctgcccagagcaactctaccgcaccagcatcaaaggcccgtgtcaaccatgttgctgctgcagaagctcaagatgctccagatgtgattttgggtacgttccttgttaacctagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcagggagtaccatttctggccaatcttatcctgttagaatccaaagaccttgatgtcatcctagggatggactggttagccagatataagggtgtgatagactgtgctaacagaaaagtaactctcaccagcaatgatggtcgagttgtaactgttcatgcattgtcttctgagtctttaaggtcaagactgaaccaaataactttggaagaaattcttgtagtccgggagtatcctgatgtgttcccagacgatttacgtggtatgccgcctaaaagggatatagagttcagaatagatttggtaccaggaacaattccgatccataagagaccttatagaatggcagccaatgaattggcaaaagtcaagaggcaagtagacgaaagaacgacagttgccattggagttatgtaaggaatttgaaagattaaatttgggaattgtcagtagaggttttgttgcggctttagaagcgaagctcactctaattgatcaagttagagaagcccaaattaatgatcctgatattctagaaatcaaaaagaatatgagaagaggaaaagctatcggtttcttggaggatgagcaaggaactgtatggttgggcgagagaatctgtgtccccgataacaaagatttaaaagatgcaattctgaaagaagctcatgatactttatattccattcaccctggtagtaccaaaatgtaccaggatctcaaggaaagattttggtgggtaagtatgaagcgtgaaatcgcagagtacgtagcagtatgtgatgtttgtcagcgagtcaaggaagaacatcagaaacctgccggtttgttgcagtctttgaagattcctgaatggaaatgggaggaaatcggtatggatttcatcactggtctacccagaacgtcatcaggccatgactctatttgggtgatagtcgatagacttaccaacgtggctcatttcatcccagtaaagacaacatattccggaagtcggttggcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtactttagacttcggtggaagttgggataagaatttaccttatgcggaattctcgtataacaacagttatcaagctagtcttcagatggctccttacgaagcactgtatattcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataag

SEQ ID NO: 32685 - DNA, 4134 bp, Oryza sativa
atgtcgtgaacaaggggccttgcaacaagagcatcgtgggagcagtagcaatacagagcaagagcaacagcatacaggtggcttgtaaggcacagtgatgcttggtccaaaatgtgcagtgggtcagtagagcattacgggagtgagccaattgatctctttgtgcgggttctggtcttctggaagagactattttgtccaggaagtagaatggttagtatagttagtttagctgaagttagttgtggtaaacttgtctgttaggaaagtgttggtcgagagcaggaagacgtgtaaagatgcattgtatctattagctctcctgtctaaacatgcatcttggttcgcggcagtatgggaagctgatagttaattgacatctgtgttcgccaattttgcaggtatgccttctttttttgtctgcctttgttggtttcaaaatgatttagtgtgtatttgttgcaatgccatttcgttgaatcgcctgtaatatgtttcataagttttgatgtagtatgttccgtgcgctttggtcttgaatgtatgatctttgtttcttatactgtttatgggtaaatagggagatgtatattgttctgtttgtgttagcatgtaaaatttcatatcattaaattgttctcgtcttttctcaaaaaaaagtcatcttctgttttgaaaagataatgcgattcaagttttttttgccattttgtgccatgccccccgcgggcgtcatgtagactagcttaaacttgctgtaaacgattcatctttctgcatattgaagaattataggtcttactttttcagtaacaagctatccgttgatttgcttcttaattataagttgatgcaaacttggtttgttagctttcaaatcctctgcttactaccgtatttttgttgatgcaatttctaatgataaataagctttcgagtcccttcctttaatagtttgaaagtaatctcaaattttagcttccaaaaattctctttccgaatcattttcacagttttattaacccgggctgttctttgttgttgcaccaaatttgcaagtctagtttgaggaattattatttttataggtaaattggaaccatgccattataattttgcaaagcttgagatatgtcatcagtatctcaatgacatggaggacccacgtgagtcaatgacatgtaggtcaggatggcatatctcaaattttataaaattataatggcatgtaggtcaggatggcatatctcaaattttacaaaattataatggcatggttccaattttccctattttgatataagggcaaatcttttcctgcaacatcaaagcaatccacattccacgctgaatacgtatggaacaagtgactgtcattgtaaataggcgtgtgtcgaattgccaggttgacaagaaaattacttgtaaatctttgtacctttttatttgacgatatttattatgaatgaggaagaatattaacggtgaatttcagggatgatatgcttgttcacattgcatattttttccacgcaaagtatgcattttttttccctcacaagtcataatactgatggatcctcttggcgttaaatgttccctttgtcttgtttaagattaaaattggatgaagaggcgtagaccttggattcaagactcaacggcctgttttggttagaagtttttaggagggattgagagtttagaaggatgaggctattaagtgttttatttggttgagagacatgggagttttggtaggatgggaatggggaattgtggaaggaactccctccttttcaatacctgggtaggggcagataattgggagggaatttctcctttactttgtctaagcaaatctcatccatccgtttttattaatgatctaatctccaactaaactccgtatcaattttcatcgcctctaccaaacaagatattgggattaaaaatcaaattctcatcttaatctcatcatcaattccctcgtgtaaactctcaatccccttctctgaagtggagttcagaaaggaccaagaagctagatctatgaaaggaccacaacaagtggcgaaaagagttcctcttttgaactcaatatcactaaaatcaactcattcaagtacgtgatagcagtatgcaatataggatggcttcccgcctctactgataccagcgctgtcggatcccaaaactaacgattcagaaaccgacatatttaactgtatcaagccctggatcagtaggttgaacaggttcaataatctggatcttcattgcatacatttggtcaaggctccaaaggagatatctttatatataaaataataggacatttacaagtttgtggctaactattacagcagaagctatacgatgacccaactctatcgttttactatagaactaaaccggctaactatactagacttgaagactaggtttaaagggaactaacttatgtgattgaactcccagctttggcaaaaactccaaatagactctgaaaaaaggggttgaagcaagggtgagtacatgccaatcaccccggccgcctgcaggctcagtttggggagaatcggtaatcaacttcagagaatctagagaagctactaacccagcttttagctatagttcattttctagattctacaactacaaaatctcataatcaactacaaaatctcataatagagtgacaatcttacagtttaaatggatagaaactccctaaacaagccttagcttggtccacaacaaggtgagaatgatgaggcataccgacatttaggctaacctcaccttccacgcactaaaacggagtaatgcttcttttgcaaaagacgcaccgtttatcaatttaaaaaacgtgcacaacacgagcgaagtgagttgaaaaaggtagggggagaaacccattagattaaggccattgaacggtcggatgcaagggagtgagtaccaccgctgccttgcaacacgcaagttggttatttagatgattcgtctcaagaatccttgagataggaaggatacgctccgaagtttggagctcagatgaacaaagcgcattgcacaaatgatgtacgaaggatgcttcacagggctggtgtccatcatgcaaagcattcatcgagctgatagagtgatagttgagaatcggcgttctgggaaacaattctaaaagacagctctacacataccgaaacacaactagtacaacacaaagcaaaacaaaataacacaacagcatcaggcaatacataacaggaaaagaaggatcgaaatccgggcaaacagttactctcatctcatcaagataacaataccctattggcatcagttctatcagaccccgaagattttatgcgatgcaagaaaagaagaaacgcaataccacgacatgactgagtgccaatatcatagcgtgatgtggtacgtgaggagaagaaatgatcccatcagaactcatggaatcaattaaattttctaggtatatgacattctgaacaaatcgaggcatctttgttcaaaatagaacattttcaaaaaggcaagctgaacgttaggtgatataaataactttcccaaagcatcttctctagcttacacaacagaaagcaatgagcatctatgtaaaaattataatcactcataaccgcatacaagcaaaatactgaaactgtccattggaacatcacctaacatttaccaatgtattgtcaccaaaatcaaaatagaatcatcaaccatgccattatccccatgatataactcaatcagattgtacaaatttaggcgcagacttgtcacaaagcattgttagccagaacaactgtagtctaaaaaaacataaacagccaaaccacaatcccacaatacttgatgcaaaacatccagacctaccactaaactgtctaagctcaacactgaagtaggataggacaattacactttttttaatctatctaagatttctacaaggatcatagtgcagccactgattgcaacaactaaaagaatgaaataagttacttatagacgtcctatttcattactttgcattcggattcaaatccaacaatgcaaacaaataagcagctagccaattgaaccttaatacttgaagca

SEQ ID NO: 32686 - DNA, 624 bp, Oryza sativa
ctgatgagaccacaacaacgtctttgaggaaccgcggattgacaaaacggccgaaatctacgcgacaaacaaagcacacaagcgtgggtggcggctaggcacggctcggctcggcacaaagccggccggccggccatggggagcggcggcgcacggccgatgcggcggcgcagccaaaggcggcggtgcacgcgggaaggggaagaaaaggaggggggagtcctcaccggcgacacagcggccggagcgggaggcgaaggcggtgacgacgacccgacgagcagagggggcggacaggcggcgacgacacctagaggaggggaggagagaagttagggcagagaggacaaccacggtagcttacatcgccggccgaaaaggggcaaaaatggtgggctcaccggcgaggcgagggaatcagagctccggcgtcgttcggcggcaagcaagtggtggccaaggtgcgggcggactcggtgagcgcgacggcggctctagcggcggtggcgcgcggccggagatgggcggtggcggcgaagctcgggtgtggcgtggggagagcggcggagtgcacgggcgaacgtggcgagagcggaaaaaggttgagggggctcgggggagcga

SEQ ID NO: 32687 - DNA, 360 bp, Oryza sativa
ccgagttcgcggcgcaggctagccatggcggccacagcagcagcaagtacgacaagatcgcctacgacgagcagcagaggaaggggctggaggctttccttgcggcggagaaggcggcattaggcaatggcgatggcgatggcggcgaggatgatgacgatttgttccaagtgaagccgaagggtggagatggtggtaacaaggaggatgatgacgaggagaagaaggagactgagcagatactgattgatattttcggcaaagacgaggagctggacgagaacagcaagttcctgaagaaattcttcctcgagaggccgtatctcgagacgggcagcgagaagaaatactctccggatg

SEQ ID NO: 32688 - DNA, 4149 bp, Oryza sativa
  unsure (1)..(4149): unsure at all n locations
gaggggttgggactctggcgaacgggttctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtagggggtgcgcgtgtctttctaagccctcgtcctctttcgtgtgcgccaagcttctcccgctcagcccaatggccggacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgtgacttcgccgcccgcgggcgacgggggaggacggcgagacggggcgcgtcgctgcctcgtctacggcgatggcggcacgccccagggcgcgctccaggctgcgggtgcgctcctgcgtcacccgcccgtcgtccccgatccagagactccagcccgacgttggctggatgacgtggccgacttggtcatgacggcgcagcagcgcctaggcgccggcgggcggtcctccgccaccgaggcctctggcgctgccgccgccggctccatgtcgtccaggcggagggcgcggcgagcggcggccgtaacccgccgttcgtccgccattccctcgtcaacgcctccgacccaagaagatgtgcgtggggggccggatgcccgcctcgatatcgagcgccggcgcgacgttcgtcgcgccgcccacgcaacggagggcgcttcctcgtccggagcgccacttcggtccggacacgggggccggccccccgtgtccccggttggcggtgccggctgtcgagccttcggaacgtccgttggcccccaaggttccggcccaccatcaccgaaaaatacgatggaagcgtcaaccccccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagtagttcaccacgaacttccagggcatatatccgcgcccaggcgaagaagcggacttgcatgcggtacagcgaagggacgatgagtctcttcgctggtacattcagcggttctgtcaagtccgcaacaccataccgtgcatccccgcacacgcggtgatatacggttcagggggggcgtgcggcacaaccgcatgctcgagaagatcgcctccaaggagccccagaccaccgcgtagctttttgagctcgcggaccgtgtggctcgcaaggagaaggcctgggcctggaactcctccggttctggtgtggcagctccggccgcccccgggtccgccgctcggtcagggcggcgggacaggaggagnaagaaggggtcggcccgttccgacgacgagggtcatgtcctcgcgtcgagggcgcttcgcgggccccccgaaaggggaggcctgcgagcgacaaaaagaaggaggccggcgctcccagcagggagcgcccgaccggcaagtggtgtaccgtgcacaacacctgcctccacgacctcgcggactgccgcgcggtcaaaagtttggctgagcggacgaggaagtgggaggaggagaagagacaggagcgccgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggctgcggcccctacccatgaggcgacaccgcggtgcggggtcggaggttgccctcacctttgactagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggaggcccgcgttggtgaagttcatggcggcggtccactacgcctatctccagatgaagatgtcgggccccggtggccccatcaccgtccatggcgacctcaaagtcgcgcttgcttgtatggagcagcgcgcagaccacctcgccgcggcgtccaagcccgcgggtggcgacgagaggctcagcacctccgtcccggccgccccaaggcagcggatggtcacgtgcgacgaggtcccggtcaaggaggttgccctgggcgatggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagagtcgcatggctagggaggatgaggaaaaaactgcattcattacccccataggaacttattgttatacgacaatgcctttcgggttaaagaatgcaggtcctacttttcaacgtactactcgaatttctttgagtagccagataggacgcaatgttgaggcctatgttgatgacttggttgtgaagtcgcgcaaccaagataccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccaccagcaagcttagggatgtgcagtgcatcaccggctgcatggccgccctaagtcggttcatatcgaggctgggagagaaggcactacccttatttaagctcctcaaacgctccgggccgtttacctggacggaggaggctgagcgggccttcactcagttgaaggcgtacatcagttctcccccggtcctggtcgccccgaagccagatgagccgttgctactctacctggcggcaaccccgcaggtggtcagcgcggcattggtcgtggagcgcgacgaggacaaccctcactccgcgcatccccaccctgtatcggctcgacccgggagagagcagggaggagaggcccccgagccaaacggcggcccaaggcccccgacggccggagctggccctccacctgcttgtccgacggtgccaggcacccccgacccccaggatggccccagggccactgcgggaaggccgcgcctgtcgccctctgaccccgaggtcgtcggcacagaagccgagtgcgccccgcgtggcctctcagacgaagagcgccctggagatgcggcccctggcgaagaggatcg

SEQ ID NO: 32689 - DNA, 3476 bp, Oryza sativa
  unsure (1)..(3476): unsure at all n locations
cgacaagtcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaacacatgggcatcaagctctgcttcgcctcccccgcccaccccagaagcaatggccaagtggagcgcgccaacgcggaaatcctcaagggcctcaaaaccaagacgttcaacatcctcaagaagcacgccgactcgtggatcgaggaactgccagcggtgctctgggcgaaccgaaccacgccaagccgagcaaccggggaaacgcctttcttcctcgtctacggcgcggaggcaggtcctcccatctgagctcaccctgaggtcccctcgggtcaccatgtattgcgaggctgatcaagattagcttcgtcgagacgacctcgactatctggaagagcgaaggcggcgcgcggccctccgagccgcgcgctaccagcagagcctgcggcgctaccatcagcgccacgtccggacccgatcactctgcgttgacgacctcgtcctacgccgcgtccaaacgcgtgctggactagcaagctctcaccaatgtgggagggtccgtatcgagtgatcggcgtcccccggccgggctccgttcggctggccacgggcgacggcacagagctgcctaacccgtggaacatcgagcaccttcgtcgcttctacccctagtgggggtcgggtgtcatgtctcaggctcgggccaaccccgcacccccccgggcgtgcagggttggccgggggctaccacatgcatatacttaccttttttctcttccgtatttcaataaaagcatttttgatttcctgaggactgtgtttgtgccatcgtttccttttgaagaatcttggcttgaattagcacgctcgtgctcgaccctgccctcggtggcccgagccggctaaaatcgccaaccggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacacagaaggaccgcggcacaaaccatcctcgtctcatacacacaacaaacagaactgacgcagaaatttcctctttacttgattgcagattaaatcagtctatacaagaagggggcccgaaggcctcggaagaaaaaagaaaagttattaagattggcgggggcctgggggctcactccgacgcgcccgggtcgccggcctcgtcgtcgctgtcgtccgcaccgtcgtcaccgccctcctcgtcggagtcgagcgcgaatgcgagccgaggggccgtaccctcgaaacttgggacgatgtggtcagcggggttccggaccttgcgcgcgcgcgccgtnctcggtttcaggagggaactcttncagcgcttgcccatggggagaagtcaaggtcccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgccgcccagaggtccgcctgccgcccggcgcggtctagatgggagacggcgtcccgaagcatgccgggccctacctcgctcgccatgcggagggcctcgacctccccggcggacgagtccagcgcgccctgcagctcggcgatggtgtgttcagcggctgcgaggcatgcggctaggtccccgtggcccgcgcccgccccgccgctgtgcgctctcgcgtccagctcctttgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagcttgcccccgctcggtgagcgcgtctcgcggaggcagagtccggactcctcttcggcgcaggcgggctcgtgcgccgccagtgttgcctcccgggtggcaacggcggcctcgcggtccgccaggtctctctccttcacgtccagggcgtgggcgcgctcctccagtgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgtcccgcgcctcgtcaagcacggcggtggcgatgagggcagtctcccgctcctcctccacctccctggcgatctccgccaggtccctacgacgggcctcgagctgtgaggcgtgccggcggtgtgccttgcggnccgcctccaccatggncttcaccgagcgccgncccttctagacacgcgcccacgccgggtngagctccccccgctccgcctgcagggccttcatctgggcacttaacccgtccagcaccgtgctgttcgcggcggccaaggcctgcaggaggggctccgcgctcagtggggcagcggaaggcagaggggagagccgcctcggtgtgggtgccgcgcggctcggcccgccgatcgacgagctggactcgagggcgtcccccgaagctggcttgtcccaagcgtcgcccgaggggtcgggcccgagcggcgcgcccgcggcctcgtcgtgggtagcctcggaagtcgtcgtcgcctcgggcggagtcgggtcgggggcttggcaggtcgcctggcgcgcgcgggccgcctctgcctcccggacggactccccggcccggcggagtctggcctcctcccgagcggcctcctcagcctggcgaacccggacggcctcttgggcagcctcctcggcttcccggaggcggtccgcggcttctcgctggtcagcttcccgcctccgggcctccgcggtcgccgtctcctcggcctcagaccggctggacttggaatggcggggggggagggggggggggcccgacgggatctcgctgaggcagaagaaaaaccagaagacaaaaagaaacgggtgagtgaaaactcgccttgggagatgggagaatgaataccgccccgtgggtgcgggacgaacctgcggggaggtcggctaaacgaccacctcgggggcgagatgaggttcccccggcatggctcggtcccccccatcttgcggagccgttctttctttc

SEQ ID NO: 32690 - DNA, 11227 bp, Oryza sativa
  unsure (1)..(11227): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaggcttcaggcggttgtggaagtagcgcttgcattttgagtttgcaaaaaggaagacctgtacaatataccaatacgtttacaacaaccttctaagcagagaaatatcctgacattaaagcaatcattcgatgaacagcctgacctgtgaatcagcacgaataaagcgaatgcccttccctggatatatcttctggccactaaaacggcaaagctctgtcctgtaggataaaaataaaagtaatagttgaaataccttccaaatatgaaatagtactcattggtaaatcattgctattaaccttttactaccattaaccaaaaaactacatagcctagagcatgcacaggataaaagggcactaaaacaatctacaatcatattgaaacaacaaaatatacacaggaacttacttcagcaccatcttctcagcttaaatcctcacagaattctgccaaatttccaacatcaaaagaaaaaggaatcaggactagaatccagaaaacaaaattgtgcagaggtaatcatggaacattaaaaacctacatcaagatatcgacaatacacagacagggtaatcatctcaaattttaactattaaaaatgtagggattctacaggcagtagaagcataatcaacttagcttagctcctgctgcaaggatactaccctggtccatcttgcacattaatcaactaggctactatgcaatcacaaaggccatagcacctgagtgcgactgtgcgacacacacaaggttcctcaaatgctcaaagcactcaagagaaccagaaacattgcagttcatacgcgcatcggattaccatccatgactaggaatccagaaacccagaaaggggtgaactgtcgggtgactactggcagaagaaacatgagacaaaccttccctgcaaagcgggttccctggttcatatagcacacacaagaataggctactacgccatcacaatagctatatcgcctcagtaccggtgctttccctcgcatctaacaaatctagaatctatcaaagaagcgcagctagtcatgataaatcagaccaaacagaataactacatactccacaaaactggaatccttcctccaaaggagtagcaaccgatgtatatacatcgcactacactacaggtaatccagaaccccagaaaggggtgaactgtcgggcgactactggcagaagaaacatgggacaaatctcccctgcaaagcgggttccctggttcatatagcacacaaaagaataggctgctacggccatcacaatggccatagcgcctcagtaccggtgctttcacacgcatctaggcaaataatccagaatctatcaaagaagcgcagctagccatggtaaatcaaatcaaacggaatcaccacggtgtcacatactcaagaaaaccggaatcctgcctccaaaggagtagcaacagatgtatatacaccgcactacaccgtgtcaagatcaactataagagagaagaagaagaaaccatccccatttacaagctcaaggatctccggcatttcttcttcttcttctcgaatctagcctaggaccgccgcaacgaccaacccgccctaattcttctagtcgctcgagggaaatgtaaagggcagcagaggcatagacgctgcaagaactatctgcggcggtggtagaggcgagacgaagagcatttcgacgcgataccttcggagcgcagccgtcggcagcggcgatgcggcggtggcggcggcggcggcggcgcgggagggagaggggggagcagcgtgtgctccgcgagggtttcttatgagacgggggagagctcacgagtgggccgggcttaagattggggaagttaggaacaggcctatatgggcccgatccatcggcatgtgggccgtcaggttgaatcctatgcgtatggtccgtgggcccgtggcccatcctaatctgctttgcttaggcttttttttttcattttcttctgcgagatgcttaaccatcttttttccccattttgtaatagctcttcgtttttattacatcatctgagagagcatcttcctactagggtctgtttatatttgagttgaagtgcgtatatttggtactaacttttttttcgtagtcaaattgttttcactttgaccaaatttattaaaaaaaagttagcaaggtcaataacgccaaattagttttattaaaactaacatttaatatatttttataatatatttattttgtgtcaaaatttttttttatatttttctataacttttctagaaacacattaacatttaatatattttgataatatatttgtttcgtgtactatattttttgagaaacacagaataaatgcatgcgctcaaaacgtgcacacacccactcctatgagcacctccagaagactggaccagcatatctctagatcgatgaagtcaccacgggcgtcaatagaagactagaccgatatattttgaggttgatgagacgaagtcactatgggtgtcgatagaagacttggtcggcatatcctgagattaacgaagtcaccacgagtgcctatctgtcgatgggtaagtcgcctatcactgaaaatataattagccgtaaatacaagtatatatgtcaattctatgatttgagctcagatgagctgtttccatcacaagtaatctagttgagctatactcatttcatttctatagattcgatcaaacttaaaattttaattaatatttaagtaggaaaaaaataaatagtagacgtgatttagtttactactccatctgtttagtctacgactttgccagcagacaagctgaggggcaaaacggccggcgagcatccacggtgctagtagtcttcaatatgaagcgtcgccgtcgacggccggccaccgccacacctgcgcactcgtcatgccgggattttcgccggtgcctatctagtaaaaaaaaatcttgcccacgtctaaaacaaattatttattgaattatttttacaaatttagttataaaactaaattaaatatttgataactaaagttaacaaaaaagctttcaatgcagtacaacacggtattttcatgaaaacatactttttttaaagactcgtgggaaagaatttagcctagatatagttgatggtcttaaattattttttttcagacaatatgatatttttgctctttgtcttaaattaacatttgagactgattctagaaatgtaatttgactaacatgaaatttaataatataatttattaatcaaaatattattacaccgtagcattagccccgggtaaattactagttctatgaagtactagaaagaacggacatagagcctgtttggggaagcttttagtagctgaagatttttctagaagcactagttatcaaatcctccctcaaacaatctagattttcattcagattctaaaaagctgtagctgtagaacctagggatggcaattttcccgttgggggcggggacccgccgggtacccacccctacggggacggggacggggcgaaatttcaacccgcggggctgcggggacggggcaccggaactatgcgggggtgggggcggggccacaggctcacccgcgggtgacccacggggccccggaatatagggatctaaaatatggcatacagcccataatcaaatttaggcccatatagcccaatatatatatatacagatcagtaaagagaagccaaccctaagacttgtttggtaacttgagggaaggggattaggagtttacacgagggaatttatgatgagattaagatgggaatttgatttttaatcccaatgtcttgtttggtagatgtgatagaaactgatagggagtttagttggagattagctcattaataaaaacggatggctgagatttgcttagacaaagtaaaggagaaattccctcccaattacctgcccctacccaggtattgaaaaggagggagtttcttcctcaattccccatcccaatcccaccaaaattcccatgtctcccaaccaaacaaaatacttaatagcctcatccctctaatcccaattcctcttaaaaactccctccaaccaaacgggccgtaaaatcaatcccgtgagtttgtcgccgccgccaccaatctctattctcgttccagtagttttgacttttgacgctatcccacaaatcacgcaacacatcacacgccgcacgccgctttggcgcttcctcacctccacaaatcacgcctcgcgagttggtcccgcaccatcaagtagcggcggtcggcgctcttccacgctgcccgtatcgttgctctcacggacgccgtctccccatcctgccatccgccgacgccccatgtcgttctcctacctctccagctgccggcgcctgtgctgttctcctccttctccgaccgttcctctccctccggctgctgcaggttccccacatcattattcccttcctccacccggctgctgcaagtttcccagaccattctttccttccttcggctgctagcagtcgccgcttgtatctgggtgcggggacccggaaatggtgcggggccccggaggggccgggggcggggattgatttcgccccgttcctcactccggggccggggccgggtgaaccctcaaggatgcggaggcggggccgttcctatccaacccgcacccgccccgtcccgccccgttgccaaccctagtagaacctataaaataaactataaactaaaagttggcttctccatattcttacccactgtttctcgtaattttaatctcctcgagacaaaggtcatagtttgaccgtcaatgttcagttcgctctcactgggacaactttcagtttttcagcgccgtattgttatactagcctagcacatgcatacaccacacattatcagcgttttttcaacaagacggcaatttaattgacaaggatacgcattgcatttgcaaacgaattgacaatgccactaactcgccgtaacgtatggccggcctccgtgagaatgaaatgcgagtgagactgatcaaatcatttcattttatcatgtaagtgcagtgtctagctaaattcacgatgagcacgcaacacttcagtagagaacaattaagaacagggtaggacgtgccatgccacacgaggagtttctatacgtacgttctctatcttaaataggaagaatatatacgcaaacatctccatgtagtgcgatttctcccactacatccactccactaattaaggtgtgatttctcccactacatccacccactaattataaggtggcatatatagccacatgttaaggttttagaattcaaatgtcgatgtttgaacaaggatgagatgcacgagacaatactgatttttacaaacacctgcgtgcatcacggaccgtttaaccgtaggcgaagatcgatttcgatcgcttgatctgtagtagtgttcattcatagagtatatttcttaaaccgaaccttagaattgatagattaattgagtcagctcagaccgatcagtgaagtgcacaactcttttaaatcacaataagaaaatcccttaaaagtaataaggtagagctatattacgtggcgaaatcaaaaacattaattaggttgagttctttagttgatcgaggttaggaactaacatctcacgcacgtaaaatgaagtaatttattaacttatcactaattaagtattagctgaacttttatgaaaaatgaattaatatattttttaaacaacttttgtatataatttttttaaatacgtattatttagcaatttaaaaaacatacgcatgaaaaacgagagaagtaagtgaaaaacgtgaacaaataaactcaaccagagtattaagaacacgctctttgctccgtggctcgctcttaaaatgggttgtcaatagacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttctagtgagccatgccacttgtcgccgtacgttcagttggtccacggccactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttccttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccacaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaattagctattaaattgactatatcagataattttgagtcagtagttagctatactattaaacttgcttttaaatgtgtttggaaccgacgccaaatcaatcacctgcgcacatatggctcatcactttttcttgcatgcatgcattaccgccagattaaactgtatattagagcaagtttaatagtattaatagtatagccgattatgggctccaaatcatatatagttaatttaatagtcaattcataccatagttatctttaagtatgtgctacataattaatgtctgatcccacctatcatacacacatgtatcttggagtccatgctgcagctggctacaaatctgtagcccgctgctcttatctcttctcttttatcttcttaaaatatgtttatagctggcttatagtctactattgtacatgctcttatagtttctctaattactccctttgttctaaaatataagatattttggtttgatgagacatatcttataaatagctctagatttgtagtactagaacgtatcctattcaattaattttttttatattttgagacgaaaggaatacctaactttacgcatgtcaaatcttgttgaatcatcacagcgatagtaaaagttctctttttctttagaggaatcttaaaagttttctagttcttacatcacttgagaacaaacaacgaaatcaaatcttgtcattatgcaaacgcttcagaatgtctaaactgctcgttgtttgcttgcttgtgccgcccaactcacactgcactagcttgcgatgacagcattggacatttgttaatttggatgatatctccattgacaaaatatctggcagtcgacgtagtcaaatttaatgcaggaatgagttgtaaattgtaatcacatggagattattgacatgactgctgttagtgcagagaacttgtgtgtgcgtgcgcgtgtggttttgacctgaactgtagtggtgactggccaaactgcactgcagcatcaatgtgctgtttagtgatcggtgtggagggtcaactgaataaatttcagactttagcagcagcagcacactgaattaatttgagaaaaaaaacaacatagtactagaaatctcatcagtagttcttctgtccatgaacagtggcagcaactatcagtcgaccactcgtgactaagcaggtcaagatcactagaccagctcgagatcatatgaagtttcaatggaatctccaacaacatacttcctttgtcctataaaaaatcaaattaagataataagagatattttctagtataatgaatttaaacaggcttttaaccagatttattgtaatagaaaacattacatctaatcctagattggtttttataggactctttcctccttcagtcccaaaataagtgcacttttacactgttcatgtccaacgtttaaccgtttatcttatttgaaatttttttatgagtattacttttattgttattagatgataaaacatgaataatactctaagcatgactatttgtttttaatttttcataattttttaaataagatagacggtcaaacgttagacacgaatacccacgactgcacttattttaacgttgtagatgacagtccgacagtgacatggttcatatgattccctcagcagactattagaagctttgattagcctttgccaatggctgctctcgcttggatttaagctcctggcactggccactatagcccactagccacatagtactatggagtatggacctgcttgaaagctgtagattccaagggcccgttcgaacgagcattttggctcagctaactggcggcacttataataaaataatctattaatgcataattaatcggttcctataaacttaaaaatagaattatttgattttagaaaagccttttgtgtagaaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaaggttgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtatttcttttcttcagattaaagtatatctgcaaattctttaagctgcattattttgacttgggagcaaccagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacgtatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacagtgcgtgaataaatcctgtaccactcgagaaaaccaatcattgattgctttaagtatatccattcgtgccagcgttaattaggacaagaaataggttgtattacaggttgtcgtcatgaagctgaggcaacaaagaatgaagaaaataagactaaacgaagtaaaatcacatgtacatccaggttatactatataagctgggctgggatttggttatt

SEQ ID NO: 32691 - DNA, 9855 bp, Oryza sativa
ggcggcacacttaagtcactcacctaaggatttctagtgtaaaaagatgaaattccaaatcctaatatcctccaattcacaaattcatgatgcaattccaccattacaaattttaaaaagatttgacaaattcacaatgcaattccaccaaggacgtcatcatcgacatcccaacgtcggagtcgtcctcttcagcgtcttcttttgggagaagccaacgcaacacaccatcattggtgttggcgagggagggcagaggccggccacgacgaggtctgcattatttttggtcacaactatataggtcatgaggtggcggtgccatataggtatttattaaaggcatagaggagaggaagaggtgactaataaatgtggataagtaataccttgatataacagttgataattttatactaacacaatcaaatggcttaggactacccattatgtgtatctggttaaatgtgaacactactaaaaagacacatgcaggttttaaaaaaacagtattacccaaccgaggaggtggaggtgggcgacaaggcgatgctgctcctcttggaggcggaggcgagcgattccccctcccccttcccctctcggtgcaagacgacatcagtggcgtcgacagcggggtagggcagtgtcagcggctgttcccgtggcagcggacggggttgataatttgaaactaacatgatcaaatgggttaggattgttaataactgtagccaattaaaggtggagagaatgggtagagattaataacgaatgcagataagtaactccttgatctaacatttgataatttcatactaacataatcaaatggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatggttgattgtttcagactaacataatcaaatggcttaggataagagatggctagtaaatacagacatgcaactcatttatccaatggttgataatttcatactagcataatcaaattagttttgattcactcatgatgtaaatctaattaaatgtggagagaagggctagaaattactaaaaataaatgaggataagctactcctttgtccagtggttgataattttatactatcaaatgacatagtatgactcatgatgtgtatctatataaaggcatagaagaggggtagggatacctaatgaatgaggataagttactccttgatccaatggttgatgtttttgcactaagataatcaaatggctcaggttaagagacgacaaataaatgcagatactctttgatccaacagtttattttgtactaacatgatcaaatgggtaaagattactcaacctaaacataggtggagaggaggggtagagatgactaatgaatgcaaataagtaactccttaatccaacgttgatatatttgtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcagcggcctgatggatcggacgaaccctatcactgtaacatgtatgcctagctatttcttttcattctttcctcctctctttaaatattttttcttctaaattacttatccaatctacgaaccaatcacactattgtattcgttgcaattaaatatttacaacaagatatcatataattatattatgtcaaaagaaaaacatgtgtttcaaaccgttaaaactaaatgtttcatgcgtgatagtgatatgtttcaatgtgcgtcttccgtgtgtttcataaagagcaatgctacacgtactaaatttttctgactaaacttttactaacaatcatttcaaccgtttgatttaagtagatagaagttataaaaaaatctagatgcactcatagcatgacacatcagtattagtaagaatttagtaagaaaaagttagtacgtatagccttttcctttcataaattttttgaaactaactgctactactttctctccatctcatccatgcacacatgcatgtattttagcaaacttcaaaataatttttctcttaaattatttatccaatctatgatccgatcgcaccattgtattcgttttaattaaatctttacaacaagatattgcatgattatattttgttgaaagaaaaacacatgtatccgttaatacttgctgtttcatatgtgacagcgacctgtttcaacgtgcatcttcaccatgtttcataaaatatttaaatgtttcagttgctgatttttttgtttcaccatatataacttaatgtttgacttgttggccaactgcaatatttgaccatccgtttttttttcatcggacgtccgatgggtagctttctcccaacactacgagtcaactacccatcccagtgccatccatccatacatcatcgtctcctccgaccacagatcacacacacccaaaaaaaacaaatactccctctgtttcacaatggaagactttctagcattacccacattcatatagatgtgtctcgattcactaacatctatatgaatatggacaatactagaaagtcttacattgtgaaacgaagtagtagccacgagctcttttttctcgcggccattcttggctgcctcggttgctacctcctgcatgtgccgcgcaatggaaatgaggcctcgtgatctcgccgccgtcctggctatgtcctgcctattgctcctcccactactcgtctcctcggtgcccgtgtcgggtaaagcttcgtcgtcatagatctcctggaattcttgatatgtgttttgactagttgataattataatttgcgtgtcgatgcgttcttgcaggaatcgtgcacttgagcagccaacaacaacacccgtcatctcgaaacatctatgcagatgtagttaatctttctcatgtccttcaatttctgaattcccgtaagatttaaattaatttgttggcatgttactacaaaatctcgtagacagttcatagccacctttacaaaccaattctaaaatgaatatgtactttctgaaggctaaattctgaaacaattagtaatgttggtgatagtgattctgaacatggctttgtgtatgtccatgcagggatatggtggcagcggcgacggacgtggaggtgaatgactatccagcgctaagagccaatcctcgccataaccctaaacgtccactggggagagaaatgtccgtccaggacatggtggcggcaacgacatgcggaggtgaatgactacccgacgccaggagccaaccaccgccataaccctaaacgtccaccaagaagagaatgaaatcaatcaagctactactggaactagctagcatgtagttctgcattatttctgctagatgtcagtgactctcagaattaataaagtatataattacataagtcaagtgcactattacgaaacaagattttttttcgaggtggtcaaaacgcgatttgcacatggccacacaccctgcctatgattgaaggcttgagaagatctacagttttcgaaggcaagcatcctaagagacccacttgcaaaaatcaattttttataggtggcacacttaatttacccacatacaaaaagaatttctagtgtaaaaaatgaaaatctagattttaatatcctccaatttgaaaatcagaatgcaattccaccatcacaaatttaaaaaagaattgacatatcaaatgcaattccgccaagaacttcgtcggtggcatcccagtggcagagtcatcctttgcgcagtggcagagtcatcctttgcagtgtctttttcagggagaagccgatgcagcacaccatcactggcgttgacggtggaaggcgaatgccagccgcaatgaggtctgcattattttggtcaaaacaatatatgtcacggggaggtggaactataaaggtcatgagaagatgctactatcaaggtattattaaggaaaaagcccaaattagccccctaaactattgtggcagttgaaattaccccctcaattcaaaaactgcaccctcaacttttatatggacgaattacccctgacaaacttcggaacagttttggtcttacgtgtcgcacacgtggcagtccagtcagcataaaaaaattaaaaatatagggcccacatgtggtgactaagagaagaggcaaaattgacaagtgggctcctctatttttttattcttttatgctaactggactgccacatttgtgccacgtaggaccaaaaccactctggagtcgatcagggggtaattcgtccgatatgaaaagttgagggtgaagaatgtctggtttttgaattgagggggtaattcgtaccgccacaatagttcgtggggggctaattcggactttttcctattattaaaggtagagaggagaggaagaaacaactaagaaatacagacaagtaactccttgatctaacagatgattattttatactaacatgatcaaatgacttaggttactcatgatgtgtatatgttaaaggtagagaacagtagaagagatgactaatgagcacatataagtaactccttaatcaaatggttgactgttttatactaacatattcaaatggcttagataagagacgccggtaaatatagatatgcaactcctctatccaacggttcataatatcatactgacataatcaaatatgtttcgatttacttgtgatgtgtatctaattgaaggtggagagaaggggtagaaattactaaaaattaatgtggataagtaactgccttatccaatgattgatgattttatactaacatgataaaatggcatagtatgattcatgatgtgtatttggataatggtgtcgaggaggggtaaggatgactaatgaatggggataagtatctccttgatccatcggttgatatatttgtattaacataatgaaatggttcggcataagaggcaacttataattacggataagtaactccttgatctaacaactagttttatgctaacatgatcaattggataaggattactcatgatgtgtagctaaatataggtggagaggaggggctaaggagatcacagatgaatgttgataagtaaatgcttcatccaacgtttgataagtaccccaaggcagcggcagcaacactgcgagtccactactcatcccagtgccatcaatccatccatcattgtctcctcctaacacagatcacactacacaaagaacaacaagtagccacgagctcttctttcttgcagccgttcttggctgcctcggttgctacccctgatgcgccgcgtaatggaaatgaggtctcgtgatctcgtcgccgtcttggctatgtccagcctactccttctcccactactcgtctcctcggtgcccatgtcgggtaagcttcgtcgtcattgatctcctggagttcttgatatgtgtttttactatatgctaattataatttgtgccttgattcattcttgcaggaagcctgcacttgagcagccaacagcaacacctgtcgtctccaaacatctctgcagatgtagttaatctttctcaagtcctccaatctctatattcccctaatatttaaatttgccggcctgttaataaaatatcatagacagttcatagctaccttcacaaaccaattctaaaatgaatatgtacgttctggaggctaaatactgaaacaaatagtaatgttgatagtgattctgaacatggctttgtgtatgtccgtgcaggacatggtggcggcgacgacgacggacgtggaggtgaatgactacccagcgccaggagccaatccccgccataaccctaaacgtccaccaggaagagaaatgtccgtccagggcatggtggcggcggcaacgaataatgtggaggtgaatgactacccggcgccgggagccaacccccgccataaccctaaaagtccaccagggagagaaatgtccgtccagggcatggtggcagcggcgacggacgtggaggtgaatgactacccagcgccaggagccaatccccgccataaccctaaacgtccaccagggagagaaatgtccgtccagggcatggtggcggcgacgaccgatgtggaggtgaatgactacctggcgccaggagccaacccccgccataaccctaaacgtccacctgggagagaatgaaatcaatcaagctgctgctggaactagctagcttgtagtttcgcattatctctgctagttgtcagcaactctcataattaataaagtatctaattacataagttgagtgcactactacaaatcaagatttttcgaggtggccaaaatgcaattttgcacattgccagacgccccgtctgcgattgaaggcttgtgaaaatcgacggttttcaaaggtgggcaccctaagagatccgcttgtgaaaattgatttttcacaggcgacatgcttaattcacccacatgcaaaaataatttctagtgtaaaaaaaaagaaaatccagatttgaatatcctctaataagaaaattcacagttcaattccaccatcacaaatttaaaaaacatttggcatgtcaaatgcaattccaaaaagggctttgtcgtcgtatcccagcgtcggagtcatcctctgcagcgtcttcttcagggagaagccgacacagcacaccatcattggcattggcgaggcagggcgaatgccacctgacggagcgtggggctcctcaccgggagaccgcgcaggtccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacaaagagccggagagcgagagagagttcaggctctagaaccccttcgccagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcgctgaagcctggaatggatctgaccgggactgacataccaactccaggagttagcacgccggctccggctagggacgagagccagaaagctctcatcattccgacgggacggggcgaggcgtgtgacaggccgcctgttgccacctaacccgcgatctgactggtctgtgaccggtcacacaccgcgaccggtcacagaccggataagcgtgcgcggcgccccattaaatgcggcgtggcgcgctcgtccatcctgctataaatgcggttaggtgagccccgctgtgctcacctaacccacacacgtggcaccaaaaccacagggggttggggcgccccagccccacgggccgaaacgggggcgccccagccctcggggccgaaacgggagcggcccgacccctcggggagacagaaggaggggtggccacgtcaccctcgggcccgaccccccccccccccgacggggtcaggccacgtgggtgaccgcggctacccaagcctctagtcacgatacccccggccccatgtcaccgacagtagcccccggcgttacgccatggtgatcgcccccctcgagggaagcgctcgggcgtgacgccactccttaggcccggtgacaggtggggccggtccctacaggtgggcagaaacccagcggtcgcaaatcgcgcgcatcggcaagggaaaaccgaccgacaataatgagcggcctctttaagaccgctacattactcgagcagcgcgcgaatcggaacgagccggctcgtttcgcctggagacatgatgatggcgcttttcacggttggcgagcgtagttaatgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttccttcctctcgctactcttccccttgccttcgccacttgcgctctaactcttcgtttcctgtgccctacccttgccgcactcgctcgctctcaagctcctcctccgccggcgtcatggcacggggctccgcaccgctcgacggtagcgtgctgccgccttcccgcatcgtaagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctgcagatggcgcacctcacccccaacgcgataatgacgttggccatcttcgcgcacctgtgcgagatgtttatcggggtgcgcccatctctccgactgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggtgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtgatccaacgggtgctgaatctcagctccgtggaggcatccctcatcccccaaggggtcctccccctctgctgcgatccagagcgcgccaagatcctggccataatgcaggtggtcggggcgtcgggggagcgggccccccgaggccacgatggcgcgggcgggagccgcaggggggaacaatctaccccgggagggggtcgtgcttctgggccccttgacgggggcccgggggg

SEQ ID NO: 32692 - DNA, 4092 bp, Oryza sativa
cccccccccccccccccccgagggggtcaggccacgtgggtgaccgcggctacccaagcctctagtcacgatacccccggccccatgtcaccgacaccacccataaagaggtctaaattattttggtcagaactatattggtcacgagaaggtggtattatataggtcatgaggaggtgttaccatatagttattattaaaggtagagaggagaggatgagatgactaagaaatacagataagtaactccttgattattttatactaacatgatcaaatgacaggttactcatgatgtgtattagttaaaggtagataagaggggtagagatgactaatgagtacgaataaataactccttaatcaaatggttgactgttttatactaccataatcgaatggcttaggataagagacgactagtaaatatgtatatgcaactcctctatccaacggttaatcaaatatgtatctaattaaaggtggagagaaggggtagaaattactaaaatgtaatgtggataagtaactcccttatccaatggttgatgattttatactagcatgatcaaatggcttagtatgattcatgatgtgtatttggataaaggcgtcaaggagggatggggatgactaatgaatggggataagtatctccttgatccaacggttgatatatttgtactaacattatcaaatggctcaagataagagatgacttataattgcggagaagtaactccttgacccaacaactaattttatactaacattatcgaaggagcgattctctggcagcggggaagtgtagacccctccccaaaaataaagatccgaccaggagctagttgcgcacgatgctccagaaaacaagtttgtggggcccgagcaccccaccaagcatatgaacacaagatatttatacaggttcaggccactcagaggtgtaatacgctactcatgttctttttgtgggatctatatctggagaaatacaaactttgcctttttcaaaccagacacaagttagcccttttttctagcatgtcccttttctattatagtacaaggaggggctcacggtgctaccattctacatcctttttgcattgtcattcaaccgtcttgtcaatgccgtttggtttccttcaaatgtccccgagaaacctacctaaaaaataagattatagtgccccaggctccaagaataagatgaagtataaaaccatttctctgcttccaaatgtgccaagcaccatataaaaatttctccacaaaatgagatgaagtatatgaagcttttgctgcttgaagcatatctcccaaattgaaattctagtgccagactataaccacctgaagccaacattctttgctgaatgcacattcaaagaagagataaaagaaagtttgtattcctgtcacatagggcacaaattaattcacttcttcctagggcacattcaaagtccctggcctatccccttccacctagggatgaaaatggagcggatagtttccgtccattccaaagaaaaatagggatggcaacggggcggggcagagccgggttgggttgtaacggccccgctcccgctccattgcgggtccacccggcctaggccctgaagtggaggatgggtcgaaattaatccccaccgccggcccccccgaggccccgccactcgaccgggggcccgctgcacctgcaggagaggattcttggaggaggcggctggtggatgcgccgtcgtgtgacaggaggaggaggcgccgccaagcggaggcggcggcagcggtggcgcggcgacgaacaatgacagcgtggcaacgagcagaggcggaggcaagaggcagcgcgacgatgagcagaggcggagtggaaacaacggcgatgagcggaggtggaggtgacgcggtgcagccagccagcggcagctgtggaggatgggtgaggggagtgggagtaggggatgggggattgggagattaggatttaccttttatatgtctcacttactaggccaactgggcttgtattgttggaatggactacattttgagacatatctcatatcccgaggccccatcaggtcacacgcaaccgcgcaggtggtttacaatccctgccccagccccggaaatttgcggggccccgtccccgctcaaccccgggtgaaaatcatccctccccccaacccaccgtggccctatagggtccctggccccaatggggaaattgccacccccagagaaaaatgaatacagataccttccggagcggatagttggatacatatattttcttccggataagaatacggatattgttaaggttatagataaggcatatcctatgatcttgggttaagctcggcaggacctaccatataccaagggcctgtttgggggagcttaagattctgagaagcagctgctgataagctagctggtgagaatctggagaagctaggaaacccagcttctggcttctagttcattttccaaattttataactacagattttcataatctgggtaaaaactggactgtttgggggagcttctggcaactagagattctaggagaagctgcagctgctagaagctcccccaaacaggccccaagtcttatacgaaatcatgcctcgcatacggaaggtgttccagataaggaagaagaagcagggtttaatattggaaactataaggagtactcagattgtatacattcttgtttccctagttctacatggacaagggaacatttgggtataaatacaagatccctgggaggagaaagtggaggcccaatcatcaatacacgccgccagacacaaacacagagataagcctagatatacccaatctggagccgcagaggctgacaagagggatctagtgttatctctgatctcgccaagttcatgttcgaggaagaagactacctgtcatcgaccatgtgtggagatccacgccatcaagttgacgatggctagataggttagcccaaatattatacttactagaaaaaatgcatgtgtgtcccaaatattcgcatggattttttttaaagaaaatcatgagctgcaattaggagttcaactttcgtctcaagttagcatccaagtttctttataaaaagtttcttatacaatttcttttgtattttcaaaagcgaatgaacttaaaaaccgactcaaacaataataatgcactaaagtactggcaaaagcatctttgatttttataatagtagagaagagatgccacgctattgtctcccatcagtaattttcagtttttatttcttttcacgataacaggaggtgaacagatatatttgctcgttgggatctattaattatacttgactgggctgaaaaagaaacgatgcagcgatgcacaggcaggccatctccatcagtatttccttccaatctaaccaggcgcacacctctcccatcgccacggagtacaagccaagtccatctcgcttgatcgtggcaacagtaaaaccgaatcggagggggcaaatgtgctgcagacgaagcaaaagtgaaacgcatgcgagcgcaggaaaaaaaaagcaacggaagcgtttggattcatgtcggcaatctttgaatcggtgatacccgacgtatcaaagctatagaacatcttttataatactctctccattttttaatatataacgtcgttgactttttcttatatatttgaccattcgttttatttaaaaattttatgcaaatgtataaaatataaatcacacttaaaatactatgagtgataaaacaactcataacaaaataaattataattacgtaattttttaataagataaatggtcaaacatgtgagaaaaagtcaacggcgtcatctattaaaaaacggaggtagtagtagagaagagatatagatagagatagagatagagatagagaagtagaggtagagaagacatagagacaataaatataataaaaaatgaagattagaaaaccaacttaaaaactaatttaaacacggatgaaatactaaaatcccggtgaaaatatcagttgagaagagatagagatatactac

SEQ ID NO: 32693 - DNA, 3879 bp, Oryza sativa
  unsure (1)..(3879): unsure at all n locations
cagccccgnatttgatacaaatagttaattaattttcagcgatataaacggaccaaatggttaagcgactaaaaactcactcaaatacggataatgaacaaaaatctcgacaaaaacatctttaaattttataatagtaaagatgtgatacagatatataagagcatcattggcttcagccaacaggagtagagctattacctatcagttaagagatccgaacttgtataaaaattcttttatccatctctttatctcaatatcgtgtatatattggtcccaacgatcatcatactatgtaaatattgtagtcacgacctattccgccgatagatatggtatcggggtttccgacagataaggatattcgatgaccagtgctattcggatatctgctgaagtcgtgagacatacaccatttctttataactctacgaccttcaatctacctttttagattttaatagtagctcatctcttaacactaatacacactattaatattatttaaacttttaaatattttttataaattatactatattttatataaaacaagctaattatatatgatgatatttgtttttattagaagttaaggtggttttcatgttccaagaaaaaaaaaatatttccgtattcgtgtccgatcatattcaatcgttatttgtattcaagataattcatatttattttcgtatccgagctattcgtattcgttttcatatctagcaaaaaaaaatgaaaacaaatatgatatgagcattatccgtctatattcgctccattttcatccctacttccaccaccgccactgcctcttctctcccagcaagtaggacaagcgttcgcaaacggacctggccatgcgaaggtcatcctcatctgaaccttcgctattccattgccatcgccgccacctccattgatctcttcaccggtgaagaagatggccatcacctcccttgtggcagtgcatctaactaacaagcaccttggcgacgcatgtggtcaacaagctcctcggcagttgcacatgtcggggttgcacagagcaaaatagggcggcaggctccctaacggcagatcggattggggtagtggagcatctagtggcatcatccgtagtaggtgggcccttcttctccctagtcattagccatcctccttgtcctctcttccctcacccccagtggttaccattgtcttctttctagcctccaccgcctcctcccagctctaaatcaaggccccacctctcgtagcttagagccatgggctcatccaacacgatcggcgagacgtagcttcaaacacatgattgccctcgtcaaacaagacacatgtgctctctgcaagtcagaagtagctctaaagggacacaacttgactcgagctaaacttgcagctccaacgtggccggttaaagccactcgccacatagacgtgttgcgaaggctctatagccccaccagagtccacgagtcatgaccacacattgcatccgtcaccaccttcttctaattaaagccattcggctaggatggagtacacctttttttttcctcctcataagtcataactagatggagtactactgatgtgaagttgaccttttaagagagagaagaagaacaaaatggaaagagccattgcctgcctagctagcatggtccaactataaaaccccaaggcggcagcagcagccagcaataaacaccatcagtacaccatccatccatccatccatcgtctcatcctaccacagatcacacacacaccaagaacacctagcggcgagctcttcgccctcgcggccgttcttggctttgtctggctcggtttgcttctgcttttgctcctgcatgcgccgcgcaatggagaggaggcctcgtgacctcgtcgccgtcctggctctgtcctgcctcctcctcctcctcccactgctcgtctcctcggtgcccatgtcgagtaagctttcgttgatgggtagctgtttcttgattcttctccctcgagttcttgatctctgtgcttaactgtttcttgattgtgatttgtgtgttgattcgttcttgcttttgcaggaagcctgcacttgagcagccagcagcagcaacacccgccgtctctgaacctctctccagatgtaattaatctttctcatcccctgcaatctctgaattttttccccctccaatttaagtttgtcgactttgttgctgcaaaatcacaaacactattcagaatacgggcagcacagtgctcaaaccagttctgaaacgaagccaaattctgaatcaaactaatagtgttagtgacagcaactctgaccatggcttgtgaccgttcttgcaggagatggcggcggcggcggcggcgagagggctcggcaggaggccggcggcgaggatggacgtggaggtgaacgactaccccgggtcaggacccaacaaccgccatgaccctcccaaaggtcctgggagagcatgaattcagtcaagctgaagctgctgctgctgctgctgctggaacagcttgtagtagtttcatatccctgctagctattagcaaattcacataattaatccagcgtctaattacataagtcgagaggctgtatgtgtgatttggggtgtaattagtagagagcagatagctagcaagttacaactgcagatcgaattgagaaaatattcagggatgaagactgtaaagcttttgctagcttgggcctcctctttgcagcagtagtatagtaagtaaactagtaaattaattaatcagtgattttgtcgacatgcatatgcacatgagcacatcacgttgggatgtcaatataatacaggattaattaatcggttaatcagatattggaagcttcttcctcctctcactgtcgagaccgtcgtgtcgaacgattcaattcaaaatcaagtgatgagtgagtgtttaaaggaaaatatataatctcgtcgcgatcccaagctgatcactgctactgcgactacggccactccaatcagttagcacactgattaacgctgcgtcgatcattggtgtactataatcattgctccctctgactaacctcacgctgcatatgcgtctgccgttttctcgaactagtaatattgttgtttaatttctggaaataacctgttgagatattcccctcggatgccacaacacaggggcatgttttaagaggtactccctcaatcccataatatgagtaactttagagggatataacatatcctaatacaacggatttggatagagagcctatccagattcataacactagaatgtgttatgtctttccaaaatcctatgtgcttccattgtttgctctacaattaagtgaaaaaaaattaatgaagcaaaaaataaaaatttataatagacgaaaaaaatgttttctagtgttttagacaccttttgaaaccgaaaaatcaatgggtaagatagatgtgataatagagatagcaacaaggaagagggaacggagttagaagaccgagggatcatattcttttactcaatctcaaagcaattctagaggttcctttcgaatgtactccctccgtctcaaacaaagtcaaaccctgggtttccgtgttcaactttgactatccgtcttatatgaaatttttttataattcgtattttcattattgttagatgataaaacatgattaatattttatgcgtgacttgtctttttatttttttcataattttttcaaataagacggatggtcaaacattggacacgggaagcagggtttgtctttttttgggacggagggagtagtaaatttacaagagtgattcagacatatttcgaattactacctccgttttttaatagat

SEQ ID NO: 32694 - DNA, 5577 bp, Oryza sativa
tataattaatcaagtattaattgttatacggtttagaaaaaaccttttaaaaaaacacatcattttacggtttataaaaactaacgaaaaacaagaaagttatcgtctaaagttttagttttagaagcgaacgcagctgaattcaagtaagattgctttagcatttttctattctgaaacaggtcttgccgttaagaggtggctgagatttagcatttcgttgctatatagaatccatttgctgcatttggatgaggaagaatccgcacaacatttgctagcagcgggcaattgcaggagaggctcttaccggcacgcattacgcagtttcgatggagccctttgactttgtttgtacccctatatgcgccgaggaataaatgatcgctagtacgctgacaacaacaatggctgcaacgaaagtgacgtggccagtgcttcatctgacgcgtcccggtagaagaggaagccaggaaggaacacttccggccggttgcagtctcatgcatcatctcagtatgacaccgcgggtggcaactggtgccaggcaaccatggaaaattatgtacgataaatcacttatacagtgaatacctaaaattattattagattaaaaaaataatgaacttttgagatttgttcacgttatccgaagtaataattttactcatggatgtgatgtccacatatgcagtttccgcaaccacgacggtttcatggcactctgttcctcccccaactatgccacaacagctagggcaccgaggcggctcgggagttggtgttgcctagatccggcctctcctcgaccggtactgatgaggagactgatggacatcaggaggccggcgtagtagaggacgtggtggcggtgtgcgatggagtggcacacggtagagttcagacacggaggaggcaatgagggagagccggagagggccagagccactagatctgatgcctcttgggcagttccaatgccctcccgctgtctggatctaaagcctcccgggctgttgcgaacgtggaccgacgatggagatgatgtgcattgggaccagaaacgaggcaacggggtgccgccgagcaagggtcgttgtatccgcagcaggggaagggtggatgcggtgagcaagggcctgcgacggcgtggtgacacggcatgagaggagaggggccttgcggtggctcggagacatggtggatgtgaccctgtggtggcatagcaatattaatgtaggagacagtggtgctcgttgcttcgtgtctacagaaagggtggcgtagacttttggggtgagggggccgcgggaggaggggtgctgcaaaggagccgacgaagggtcatcgatgcagtggagctccttgtccgatgagaaatagcaggtggagtagcatcggtgtggcagagaagggcatatggcagaattcggtttgtggtgcaacgtcgaggttacaacaacaatgagaggtatgttataggcgccttgatgacatttcatgttcgggctgataacggtggtgctctaggcaatgcgatccctcttgagggcgtacgttgttgtgatgcctccttctctctctggcggtatgagtccaagtttgacaagcagcgggacctccttggagacgtcatctaggagatcctgcttttcttgcctgttccatcttcgatcaattcaattttcggcgacatcttggatgttaccatcggatctattcgagagagaagcagaacttctcatctctcgtcccctccctcgacaattctttctacatggtgatggccgagagcccatatgtatcttttattgggctagcggtatccagcctcgcatagcatcgacttgattggtgtccattcctttccctgtgagagtgtataggagttgttagcacacaatggtgctttttttcccctccttgattattgcctcccgcggtggattgatactgttcgttcaacaaaaatttccaaaattcgaaaccaacgtcgattcaacaatccgtgacaatggaaactaatggctaattaagaacagttaccccactattggaacccctatcattaagtgggtacagtacaatgttttgtcacgatagttacgcacgcacagtacgcgtgtcacgggccaccgctcgccggcgcgagcgcatgcagcagcaagcgtgcgcgcgtacaaaaccgccgctgtctggcttgtcgatgggcggcgatcgatcgcccgactttgacacaaagactagattcccctgcgacttccacatcgaaacgacgaaaccacacaccgctacgcactggagaagactaatatccatgtcaatttctgcacgatttcctcgttttgctcttattaattaatcctccgatttcttcatatcatatggttccgtccatagtggtgggcagaactgtggatgtatgtaaggctatcttgttatccaattccatggatatagttagttaattaatcacacgcacgtgcggcagaagccatggacggccgtgtgtgagtacgattcgcctctacccccatgcaaattaatatggattattaccttattttattaatattatgcgtgcttagccagtaaaaaaaagtgttggatgattcgatgcctggagagcaccggattccggaggagccgtgcactccgcgagcggcggcagcagcaacgccggcgcgcgcggagcgcgagtatcatcgtggctgcttcctcccatcgctttccagctcgacgtacgtacgtacgccgcgttggcgacgtggtgtataaaaaaggcatctgctctacgttagatcggatatttgatatttggacactaattaaaagtattaaatatagactaatgataaaatacaatctataatcttagactaatttacgagacaaatctattgagcctaattaatccataattaacctatgtgatgctacagtacacatgtactaattatgaattaattaggcttagaaaatttgtcttgtgaattagcttttatttatgcaattagctttattattagtttacgtttaatacttctaattagtgtcaaacatccgatgtgatatagaataaaatttagtcccagatccgaacatcaccttagctgcggggcctcggcctcctctcgctctcgttgtgttacacatcgtttctgccgttctggctaggggtcgatggggtctccgcgcgcgacgatggtgacggcgccgacgacgagtcgacgtcgatttttctgttgcccgctgcggctgcgagtgctctgtgggcggcagcggccagcgccggggggattcagatcaggtgaagttgtatattgactgcaactttagcagtcgcgtgatccaccacgtacaaaattaatgtaacggccaaacgttaaggcaaccctgcacatcgtcatctacctcagcccaacaccaacacaccaaagccaagaggccagagcatgtcgacacgacggcgctgtgctaccggaccttgcggccggcgcgcgcctgagcatgctgctagctagccgctccttgcccggcgccttaccgccgctctcgctcctcaacatgccaaccccaagcacccgcttgcccgcttccgtcatcaactatatattcatctccccatcaagcagaccttgaacatatgctgatatgcgtgcgtgaagtagaagctcaccattccttaaaaataaaattgaagcagaacacagcctcaattaattagcagcttattaaattcgccttcatcttcgtcatgcatctccatcgatcgatcgatctccaacctcacagatgcattactatctcgattgagagcggacggatccgtagtaagaacccagtgctgcccggattaaggaacatatatattacattcctctttcatttcaccatgcacgggatcctcaagagctgggcaactcattttttagttcaccagcctttccccgaccgccgttcgctggcgcgctactgccggccagatcagcccctttgtgctcaagtggagccatgacgaacctcttttcagtgaacaccgtttgattcaatttggacgctatggatgacgcgactgccaaagttacagtcgatatagagactgcacctgatcccaatccgcggcggggttggatggggatgatgtcgcggtttggtcgctaaagattgctgtcgctgctgttcgccttgtaggcccaggcctgtaaaccagtgttcggcccagtgccagtggcacttcttcttcttgcgaatgggttgggcggccatatgccatgggccaccacacggaccagagagtggagtgccggtacaaatttggtggaataagtccactttgacttcctgataagtgacccgaatctaatccataaccctaaccctaaaaccggatatcttgacccccgaactatttaaatcggtacaatttgattcccttggtgatttttagagaggttttgctgacgtggcgctgacgtagcggtgttgaccagtctatggggttgacatggcgcttaggtggcatttgaattaaagccatatatgcgggacccgttagtcattcacacacataaaaaattgtgggtcccactgacttgtgggccccacatgtcatcctctctctttctttttcctcccctcttcctcccttctctctttctttctcactgtccccttcagccggcggcgggcataggccggagtggtggtggcgggcggcggcgggagctgacgtaggagctagctggagcggcggtccccggagtggaggagtcgacaatggcgaggcagcgctcggtgagatggggtcggcgtcgtggaggaagtcgaccgacgagggttgtctttggccaacgacggccggcgcatggggtcggcgtcgtggaggaagtcgaccgacgagggttgtctttggccaacgacggccggcgcgcgccggcggaccgcagcttcggcctccacctcagtggcggccacctcacggcgccgaggatggcagccaccggggagagatggagctcgccggcgctcctctgctaccactcaaatctgactgaggcatgtgttagattcttaggattgctatgtgagatctaggggttcaactctagcttataggaataatgggtgattgccttggagagtgaacggtagagaaagagagagagagaacccatacctttgccggtcttagagcttgacacagccatggcgatggtgcggtgatgtgagggcgtcggtgaggacgacggtgtcggtgtcagtgatggtggtggcgacacccggcggcgggcttcccctcacttcagcgcttcccagatcggagggacttctagggtttgtggggagtccgtgtgtgcggcgaccaaccttggttcgcgcgcccgccagctccctctctttatatattagcgctgcgtgagaggggcccactgccaatagatcggctggcgcccccgatcagggagcgtaggcggagtggggaatcgttttcccgattccccccaggatcgcaactaatattctcccattcgatctccgcctttcttacttctcttacccaacatttacttctc

SEQ ID NO: 32695 - DNA, 12063 bp, Oryza sativa
tggcctcataactagctacaaactcggcatacatcgtcgatgatgctacgacggtttgcttggagcttttccacgaaatagccccttttgcgagagtgaatatgtagcatgatgtgaactttttatcatctacatctcctgcaaaatctgcatctgaatacccttctatctctagggaatcagatcttctgtacgttagcatgaggccttttgtgccttgcacaagctttctttaccattcttcagtgacctaatcctgaatttcctttatatctgctaagtatcccggtaacaaatgctaagtcagggcacatacatacttgagcatactgtaagcttccgacagctgaagcatatggaaccgctttcttttgatcgaactcatactggttcctgggacattgaaatttcccaaaactatcgcccttgactatgggagcagatgtaggcttacttgcatgcatagacatgccttttgcgataatcctaaccccttttcttctatctcggtgaatctctattcctagaacaaatgagactttactaagatctttcatatcgaaattcgaggacaaaactttttcgtctccaatcaacatcactactagtgagtaggatgtcattaggacttgctgaatatacacttgctggtcaatggagggtctcgtatgacgttggggttaagttctcatacacacacgtgacttttgccaaccaaagggtttgtatgtttatttctttgttgtggatggcctaagagttaacttttgtcaagcatataagagagcttcacaagttggcaatttgatatctgacacctcaacctaagcatccaactgtgatatttataagggctaaaaacaaagaagcaagagacaaagcggtatggactatgatcaaactaaatacctgtgccactgcaaaagttcaggcaactacactggattcaggcagctgttttctctcaataggataaaatgcacagagcttattgcttatttgttaaaggggaaaagcaggataattcatatagaaataagttcttctagctcgggaaataggatatggtcatacacaattgttacctactacaaatagcagtaatttcctcgtcccttgtataaggaaaacaaattgagacgataaacgtcacaggggctacttgtgttctttgaaactcctggtgatgagactaattttagtacatagtagcatccagcagttttacagcagaaatagcaaaatgaaatataggaagttgagttataacttgagcatttctttcagctcaaactagaaaacttggcgcagctttgccgcgccctcacagtgattggcctagtgttcttgcagagtggccttaaatcaggaaattatgtgcatacacagttacatggtaatgcatttcgtttccgaaaatactccaatatctgatgttcattaaaatgtttgaaaatattaaattacacagctcacatgtgtatgatgcttccattttaaaaaaaaaaaagcttataacaaaagacaataagtataactatacaagtcatcgttgaggcacatagaagaattgcaccatatcttgtcgtaccaactttgataaaaccaataaaccatagcccaatcaacctcattctcattcatcggattcatctcagcaatcttagcggccattttgggatcaaaataaatccattcctgatatagagtgcacatcataacggcatagcaattgtatgcattgatacggactttagtgtacatgatatgttcgtagtaacgttccctcaaaatattttcttgcagcacccctgatacagcctgccatgtagatgcataatctttatgtctcgatgctcacagtaaataaacgaactttttctagaaaacaaattgagtaaagcagttataacttgatatattgttatgttcacagacaaagcaaaatgagagaaaaataaagtaaaacggtaggacttgatataccattagtctcacaatgaaagagcaaatctatgaaaaaaaagggggggcaaaagtcagacgatgcttcttgattatgcatacctaatgtttttttagcaaatactacatcaagataattgtatcagttactcagatgatcagatcacatgatccatgttctttgctgatactagtgttttcttttataagaagttgttaaccaaatattgaaagaaatatttttttttcggttgatgtggtaacgctatctgtgaacctaaagttatatacatgcatatatatgtgtaacatggttgcagtgcagtgtaaagctaagttttcgctctttttaagactaagagaggaggaggaaaggtgacaaattgaggttatatttggtgtgtcaagataaagtatatggagcttggatcaaagcaagacgagttccaaacagagggaaataatttctcgtctttacttggtcttgtccatactatttttcctggttacaaacatgtatattatttcacttcacagtcaatgtgacctttgacttgaattagtacactttagctctagcttttatcatgtggataagaggaggacaatatcagattctttgcatttgagctaagaatctcaatgttctcactttgtgtatgtgcacagacacagtgactggctgcctgctagcccatctatgacaaatggattgaaagctgcttatcataaagctagttgatatctctaaccaaacatcgtatagctatgttcttgatatactgcaatataaataatctgaagctacacgactggcgtttgttatattaagagcaacaatgcaaagatatgtagggcaaccgatccacagtatcttcgcatcaggatacttcagcagatgagctgcctttgtcttggcaagctgctccacagttgtcaaagaaccaatatcaaaatgcaatttcaatatagcagcatcaatgaagacagtagaaaaggagagagaggaaatgatgggtgataagcttaggctgttcttcagagtgctactaacaggcagagataaagtgcagagctgtagaacatctctttccgctgaagattattaagaacatcaaagtaaaatgtgaaactggattaataaaatggatactgaattaatgtcgatagtattgagagatgatgatgctagtctggaggtttcaaaatgttacagaagattaattcaatcaaaggacacatttgaacttcagaaaagatagctgaagagaacatttgcttttcattcctcaaagatcaatttatattttgaactcatgaaacagtaaaagctgaagtactcctataacacatttaacctgtcatgaccaaagtagcaactgagaagaattcagaaatcatggtttgcaaagaaatagagcatcaattcaccaaatatactgaacatttcaacattggcacaataacaactaacttcaatgcctcaaggaatattcactgtaaaatgaagaacacttttcttctgtgaggaataaaatgaaccatatttttgtgaagctatgtttagaaaattgcatgatatattgtattgccaatattctatttcttaacctatccaactaggtcaaagctagttggataggtcaaagctaggtcaaagctataactatacaagtgaactgacaacaacaggaataatgcctgcgagtagctttaactgataggacctatactgaactaaattagtttgatgacataaacttggcaggtcaagatactctctgggctatcataggaagaaccaaagagtataatctttcttacaacaaagctatgaccattgacaaaagataggctgctctagttgcataaaaaactcaccaacaaggataatcatataatagactatttgtcatatttcagacaataatagacatatatacatgttttttccgatacttctatgatatcatttgtgtctttgtgtattcagcttattattttttgcatttacatcgttgacctggttctggttactaaataggacaaattttatgcttgtagatatatatgaaatacacctaattgaacttgatttgtgttgaaagtatagcacagctagaaggcagagccaaacagagatgtaattaacatgcctgggtccagattgaagaccctatcgaacaaatagaggaaaggacagaaaggggaaaaagtaaagtctaagcgacatatggcacgaaaaggaaatccaatttcggtaagacttgatctgaatcgtagttcagatccaagtcggttcagtgagggcaaccgcgaaagtcaccgaatgggttcggtccgtcttttcctgatctttgtttgtccccccaaaaaaaggcgtgagaggacgttgcagatgtccgggacggacacgacttcttctaacgctagaagaccacaggaagaaacccgggaccagagcatgtcgtgaaagacgcacacggggcgggcgtgcttcgttgttcaaagatgttccagatgattggtcttctgccaccctcagctgcaccacccttgtactgcatgtcaagaatggccaactcatcagatttcagaccaagacaaaacatgtgagtgtgacaattaattttgacaaccaatccattccttggagccaatcttatcaatattcagtagcatcgtgtatcacgcaaaaaccaccaagagcaaaagaaaatcctttttttcttaattatcggtggaaattaatcacatgtggcgtgaacacgtaggggaccatgtgagggaactcctacatcgcggcgtccaacggcggctgccatagcgtggtcctcggcactacgccctttgctgcacggcgaacggcctccgtctgaggcggccggcgaatcaaaaggcggctgggtagacgggcacggcgatggatgtgaattttctcctcccccatccccgcgcacagcaaccgagctcgttgccctatctggcgaggatctgcaccgccaccgctcgaggagcccctttgccatgccgccgccaagcttgaggggagaggcagcgtcctcaccggagctcgtcgctgacaccgagctcctcttcacatatagcgacgaggaggggatcagaggacagaggactgaacggcgcgccaacgcgtgggaggctcggcctcgggcgccggaggcggagcagcgggaggaagaggcggcgacgtcggcgtaggacggcgggtcgaataacaaggaggcggcggtgacgtcggcgcaggtcggaggggagagcggcgaggtggcggataagagggggtcgaaggtggaggaatagagtggtggcgaaggggagagaagggcctgactttttttttgcaaaaaaatgcacctaaaatcttctatattacaacgaggtccaccacagagatccgtcactgtacatctgcgatccgacggctataggagggggtctaactctggattcgtatgacgctacgtggagggtctatttgcatgagaatccgcgaagatttcgatattgagagatagatagctttgtaagcactaaattgatcattgtgggtaacttaagaacgggcggctcctgaatgggatctataatcaacgtgttggttcctactaaagaatcttaacgttcaaaccacataaaccacctgtgaattgcacaatggtgtatttgttgtccactcctgaagtgtcttcaaagacctgaaaatcaagtaacccaataataaaacttcaagtgttctgaataatgcaacaaccatagggttaatgcaaatcaaaatacaatcccaagaaaacaatattttcataagaatagagaagtgatgacctgcacaacagcctctttcaccatcaacttccagaatttggccacaccgagtggttccatctcccaatcggatgtttacaatttcctagtactttgcgccatgaacatagttacatgaagaaagaaatgttcagtataacttgctaggagtaccatattagtcagttgaaaatttgtaccataatactaacacatacctttactttatccaagataaacagaggtcctggcacaccagacacaatcgaacatttctattatcgagaaaaaaaaagatacatgaggtaactatctctacctttttattatctccttaaatcccttgttattctgtctctaaatccaagatgcaaacacaaatcaattagtaaaaaaaaatgcattcattgccagaatcatctttttttttaaatgaacccattcccagattcataatttcaaaagagaattttgaggccaacaagagcatgcacttactctttgaggcaagcgatacaattggcatcaatccacacggactacaattttctcttcagttgtgcctcggatggctgcagcaccagtcatcccctaaaaaaacagcaaacaaatcatggttagagaagaggatgacatgggagagatgaaaggagaatgattgaggggaggcaaggtacagtcgatagtctgagacgacgaggagaagatggaccggaccctcgttgatggatgtgccatggatttgtgtcctcctcgttgaaggctcaagaagacacggcgacgtagagcaggttcggcaacacaccacctcgtggagggatcaaggcaccgcctgagacctagtgttggatgaaaggggaaaagggtgtgcggtggggaggagggatgggtagatggcgaaggggatgccctcggatccagagggagaagtggcgccagccacggggctacaacgacaagaatggaaaggggaggagcgggtggttgacgtagactcgaaaggagaaagaggagccgtgtgcgagggaggcggagcggcaggagttggaggagacgcagggggagggcggcgttgtggagaggtgaggacgggaggaggagcaggcggccaggatgcgggagaagaaaggggaagggagcaccgacgccggctctgccgccaaggtagggggatatgaagggggaggaggcaccgggccatctgcccgtcccatgtcccactccccaccgcctgtcctactcgtcccgcccgtaacacctccttcttagccgccgtcaccaccggtgctgctccagatctgaagagggaggaaggctagcgccgggtcgaactacgcaacgagatgagtgagaataggggtgaaccggcgccgactccgacaccgccgcaggcacagacgccgccacaagggagagagtacaagggggagggggcgccgagctccgacgggcaggagggagagggaggggaggagggtcgtcgtcgacggcggcggcggtgggatggcgcacggaggcggcagggggagggcggaaggtggcggcggggggagagcggacgacggcatcgtggggaggacgaacggcggagacaggtccccgccgccggtgcggggcgcggtggggaggagatggggagacgcccgggtagggtttgggccttggttaattggatccatgccactgcaaaagtgcaaatatggcatatcaaaataatgccactcttattcgtcatatcggctacgtactactgaaatctaggaaaattggaaccatgccactacatcacattttccatcaaaaatccccgttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgcatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtattggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaaggtgaaagtttaaagaaatagtttggaactaaacttggcatttgtattggatttctattcaaaccgaggggttttccaaataaaacataacagggtgtcagtcggttcgaggatatatacgatattccgtgaaaagcgaggagtttttttttgcaaaaatactcaacataaaaaaactcaaaaaagggggaaaaacgcagcatacacactactatcatcgatattttgtttgagatgtgcaacagacaaagcccgaccgaagaaccctaacaatggcgtcgaagctcgtgacggcggtcgcccgtcaagcggcggccacatctcgcgccgcccgcttagctgcggtggcgcgccatgacgcggcggccgcatctcgctccgccggcttagctgcggcggccgcatctcgcgccgcccgcttagctgcggcggccgcatctcgcgccgcccgcttgaagcctcgtcccccactggacgacgctgcccgcctctccttccgctacagcagtgaacctccaggtaaatcataaccaatccctccctgatccctccctgtcctcatggtgcagctctccaatttagcatagtctagataggcaggcagggggattaggatttaggaggaatacatccatctctggtctgtattaaattcattcaattgttgcatgctattcgtacaattcactgttttcttgagcacttttactgatgtaatgtttgcaaaattgttgatttgtttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctgcatatcctaaaagttattctgatgagaggcatgttcactgacagcttgatccatgtgtcatgtatttcagtgtttaaaaaatgcata

SEQ ID NO: 32696 - DNA, 12426 bp, Oryza sativa
atgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgctattgtacctgctcttatatacttcgctttatcgaatctaactttactgaatttaactttggtgctgaaaatgaggcaataaagtaattattttattacagttggcaggaacttggaaaggcaaatcggtgtctaaacttggtcttgcgatgtttctgcttaatgcttataaattaacacattgatctatgattacgtggactgctaggtgaagccaatagttatacttgctctttacctggctataggcccctttgccacctttctcgagggttgcagggggactgcctatgaagtgtcattcttatggccgtgtttagttacatcccaaatgcccctaacttttcatcacatcacatcacatccaaaacttttctacacacgtaaacttttaacttttttttcaaacgaactagacacaccttattccgcgtgaccgttataataaaccagcatacattgagtgaggaactttgacaaaaaagaacacactgaactcccaaattttgccacggaggatctagcataacttgtcagagacgagatgtgattagcttgccgtattaagacatgcacgcaaacaattacaattacatgacagaaaattactgggtagtttattccagaaaaagcaaagaaaacaacaggaacatggtaaaaagtactcctacagaaagaatggaagaacaagtaaaagtgctgaatgaatgggttaagacaagaaaaaagaatgcatagtccagccgaaatgtcaggttggttgggcctggcagcaagcataaaaacctaacgtggtaaatgtcatgtcaggttggttgggcctgccagcaagcataaaaacctaacatggtaaaatctcatatcaggtagggttggtcctgccagccagctcaaaaacgtaacatggaggtgtatttcttatactatacaattgtatgctaatcacatctggtttattcctgatcatcgtcagtccttcaaatactcacagacgatggaacgtaaggaacaaaacatggagtacacccttcattggttaggggcccaaagttgccagtaacgaggccttcaaggtccatggcgacgacgcgctcctccaagggttcccagacaacgacctctgcggcgccttgtgagcggagcaacatagcccttttgccaaccttctccccggagaatgagccgacaactgtccagagtgcagcaaccttatcatcaaacagtcgcttgtttattttaagcacgcccaatgtgaggaaaccgtcaacatccttgaagcaggtcacagtaagatctccctccatttgcccaagctcccatacggtatcttggtttaccactcgaggggcagggatgactttaaggaggtccttccccgggtcatagcagaggatagacccaagggaagtgcgccagaaggcgcagcccagtgtaccaacaccagactccgccttcacctccacagcaggaggggcatctttagcaatagtccacctcccagtcctggaggagtatgactcagatgtccagacgctgcccttgaggtggaaggcagcgacgacatgataatgctcaacagcaccgtcgaagcaggatgtcaggggttcctcgaatgtgatgacaactgctggttctccatgatcacaactgtggcgtggtagctgaacccacttgaaggtggtcgtgttggttacatagtacaagcctgttgtctttccacagacgcagacaaggccacgcgtggatgcaaggaaagatacgggctctggtaatgcagcaaagcgtgactcagggtaaagaagcttgccgcagcgtatggtgtcaaatgcgagatacccaggctccttacataatgtgttgaaaaagaagcctgagagcggcctgcacagcggtgagagaaaaatttaaaggaagagctacaaaatgacactagatgtttaaatcatcacaaaatagtcagtaaaggatctcctatatctaaggagaattgcatcaaatgctgatgtttaaaacatcacgaaatcaaatgagatgcagtagatctaaaaataactaccttgaagcggtactttccagtggagcatcctcatcacacagtttatttatcatcaattcatttctgaggacataaatatgagcaaaagcacaattgttagtggataacacatcaacaacattgcaatctgtgaccaacgaatagtgatcatataactgcagaaaaaaatcagctaaaaagcactacaaatttgttattctgttaaatatgtatgaaacaagtttagtaaatacacttacttttcaagcaaacttctcagcacatcctgtagaggtcctcctttcgagtttggagcaatttcaatgacctttccatccctaattatgttaccaatcgcagcagcttcaattgaagctaactgatactctaaataaacaaaaaaaataatgaaatgtaaatttataattagttcagatttcatcaatataaaatgcatacctgtccaattaattctacaagataaagcagcaacttccatctcatccagaatttcatcaatataaaatgcatacctgtccaattgattctagaagctaaagcagcaacttccatctcgtctagaatatcatcccttctgttagctctactttgaattatagcacaatttctgttagctctaccttgaattatagcacaattttctggagtgttaagaccacctatataaacaaaaatatataaataagattaacaaaacatacaaaatgggactatctatcctattcataccacaaaactagttaattaagtcgtatatcattgaacattgaaattaacatttatagcgcctcaattcaatccctttatcaactaacaatgagaaattgtgtcatgcttgcatcacaaacaaggccataatgttattttaccatgtcggtcaggaggcgacggcgcgggctccgaccgttccgtcgatgcgcctgtgccggcacaccgatgagacgtcggacgccggcggtcggacctcgatctgtcggtcaggaggcgacagcgcgggctccgaccgttccgccgatgcgcctgtgccggcgatatggacgtcaggaggccggcgtcggaggcccgtcgatgcccctgcgccgacgggcggcgggagaatgcccctgcgccggcggccggcaggatcgaagcgctccggcatcgtcgggaatgagcctggcggacggtcgctggcggctggaacggtgggagagaagagtgggtttttatagctatctattagggtttcttaataagcgctaataatcagaaaaaataatttacgacgctccattatccgaagcgttaggccctaataagtaataaccaggaaaataatttatgagccccgctaatatcgaggtttatactccgtaccaagcaaggaaatgaatttaggttctgattgattcagcttagaattattataatttggattattagaagtaagttgaaacaaacatatagcttattatgatagattaatataatatactagtaaaagtgtccgtgcgttacaacgggaagcgtacagatcaaaaaatatgcaattatttaaaatacaaattcgttgaaatttttggtatttttaagtaggtatgtgtataattaaataaatttacaagtaaagcaaatgcgagaaataaaataacatggttaaatttaattttattaaattctccatgattagtcacactctttagaattttattggaattttcataacttaattgctaattttaataatacaaacatcatttaacaaattgtttaattggaaaaagaaagaaaatcctttcttttaggtttgattcgaaataaacacattcaataactataattgtaaatgcttctaaaaaaagaagcactaaaaatgaactacttctctttttcttcggctagagggacctaaaatagacttcttccagacccttgccggtcggcccacggccttttgcgcatgcgcgggtgcacttcccctccccaggccgcaaccttggcttgggccggaaaagtggcctcgctctcgatcccatttcgggccgaaatcggcccggtcgacgctgtccgtccgatctctagggttttgatcggacggccaagcctcgagatcggggaaacaaaaccccctcagccgccgaaactgatgaggacatcaacaccatcgatacatccacgtccccccatatacagcatgatggtcctattacccacgttcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcaggttttgatgatagagatagcttcttgctaccggctcgcagcgcgcgtgttggctaaaccgcccgtctgcctgtaatcggaaccccaccatattgtgtttgatagagaaactttcatctttatctagcaatctcagcgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagaatcggccacaaaaccctagcgggttcgcatcagaaaccctagcccatttccttcccacctatctcttttatggccgccctcccctcagcgcctatgagcggcggcgcgggtggtaccccacgagcagcggtgtcggcgccccttctcccgcgagcggtggcgactgcggcggcgatggcgcctctccccccgagcccaagcggcggcggcggcgccctcccctcgagcagcgacggcggtgacggcgcctctctcaccgagcccaagcggcagcggcggtgccctccccccgccagcggagacgacggctcccccatcaccggcggtgcggccgtgtcctccctcaccaccggcagcgcggcgacgtcctcccccaccaccggcggcggcgcccggggaggcgtcggcggctcgccagcatcccaacggcggtggcgcccctcccctctgtcggatccagcgggaggggagctgcggcggcctggcgtccctatgacaacggcggcggttcgacggcgacttccccttcgatttttttttggatatatttgtgtgtataatacttcctccgattttattttatttgtgtgattgattgaattccgattaggatttttttttgggtggtggtgatggaattccaactgggatttggggggaggcgagggggacgaaaaatcactgcacctatgaggtgacgaccggaaaaatacgaatatttatattagttatagataagccagattaatataatctggtaagccactataaatgtgtttttttagattattgggtggctaacaactaacaaacagataataatccagagaaacaaacagctagcaacttattctatgttggcttattataatccagcttatagtaatctagttctataatctagattacaataatcttaagctgaaacaaacagggccttaatcgccgggatcgccattagtaatttaatcgcctggatccctattagagcaagtttaatagtatagccaactacttgcttcaaatcatctatagctaagagcaggtacaatagcaggctataagctagctgtaaacatattttaagaaaataaatgaggagagagagaagcagcgggctacagatttgtagccagctgtagcacgaactgcaaagatgaagtgtgtgtatgacaggtgggaccatgtattaatagtgtagggtgtaactattgtatgaataagctattagataggatatatatgaattggagctagtagggggctatactattaaacttgctctaaggccattcccaaccccaacccaatgattaggatggtgtccatagcattaaataaactaccacctaagatgaaagatgatgtggtaaatgaataaatgaggaaagcgaaggaaatcaggtcttgcataagacatggtttctacacaacatacaagacatcatgtgagataagtagcattaaatttaagtatggaagagtggtgtttgcattgatgaaagagtagtgtctagtactagtttcttaatgatgtggagtttatagaaactatgtctagtgtcttgggttgggactggcctaatctaatagcccattcatacaatagttaactataaaaatatactacactattaatacccggtcccatacacacgtaatgtattgaagtccgtgctacagctggctacaaatctgcagcccgcttttttctctctcttattttttcttctcgatacgtggttataggtggcttatacctgctcttaggaactaagccacgtcactgtctaatcctcaaccattcgatctgatctgagcggcgcacacgagtcagcccatgtctctttctagggttttttctccttccccatctggatcgcatcactcacagccgccgccgctggtagggtaggtagaaaaagaccgaaccgaaaaaaccgacactgagaaattcaatcattaatttggtcctatgtaatgaaagaccaaattttgttcggtcaaaattcacttagtttactcggttaatcgaatagaccaaatgaccgaattaaaaaaatgtctaaatgcaatctacaatccactaagttcaataggattaaactctaattttcacttccctacttcttctaggcatgcaacataataagagtctttacttctacgtgttcacgattttttttggtgatttttgtgttgaaaatttccattatttctttgcaaatatgaaaatgttgttgaatttcggtcaggaccgagaccgagaccgaatttgtctatcctgacatttttacattgaaattcagtctttacttttcaaacaatgaaatgaccgaagacgtggtcgcggtcgcctccccctcgccatgctgcttcccccatccctcgcgcacgattctataagaaggcaaggcaagatagcattgactgttgcatcatcgggaattgtatccttgttacttccaggtggccacacgcctcattcccagaataatatctatggtttgggtaggtagtatcatcaaatcgattaaaaatacttgatctcctaatttaatcggaacatttctacaaatagatgatactaatacagttcctccaggtgaatgtattagcatagctttatctaaattatctttaggtaaagactgatttcaactggcttttgcagataaaaaggaatgagaggcaccagaatcaaataaaacagtaactggtttagagtttatggtgaacatacccatcaatatattaggatcttgttgcgcttcttctgctttaatatgatgtacttgaccacgtccaagattaggtccactcttaataattggaggatttttctttataaaacctgtagcagatggtttctgataagaagtttggccacccatattttgacgattagggcaaagtcttgcaaaatgtccaattttcccacaaacataacatggagagtcttccatttttaatccaggtcttggtagtattggtggcatgcctggtcttgcattgggtaaagatggcttaaatagataaggcctccgaacttgtagtgaacccctagttggtgattgtcgttgtaaattcattcttctcttacgaagtccttcgaccattctacgatcattttctagcctaaccactttattgactaggctttgaaaattttcatgatcttgactaatcattggtcctcgaagttcatcacgtagtccttctataaacctttcaatcttttccttttcatcttgaatatcagaggcagcatattgagcaagttgcgtaaatttattcaaatattcttgtactgtcataaagccttgcctcaatcttcgaaattcattctttttcattctaatcacagctgtaggtataaaagcatctctaaaagctgtagtaaattccatccatgtaataatatgtgtaggatcttctatagaagcttgatatgcttcccaccactcattggctggtccttctagttgatgggttgcaaaggttaccttctcttgttcgcttgttcggaccaaggttaatttcttttcaatagcccttagccagtcttcagcatccataggttcttcagatttagaaaagactggtggtttaattctcataaattctgcatgtgcgctgtaacctttacttccttgattttgtgctatggcttgtaataattgagtttgtcttgccattacttctgccaaagtggtaggatttggtgaagggatttctcctgtttctctttcacccgtactgccattgcccatactcatctagaaaatggggtaattgatatcttctcaaaggggagtcaacatccataattaaacatagcttttatttatggacaagttgtacatgatgtatgctacaaagaaacaaaccaaagaaaaccataaccacaaagaaagaggtaatcacacatagaagttagagaggagtaggataactatctattctacacttaagacctctaactatctataacttctatttatctagccatccaccactgccttctgcgggattagtaaacaatgatgcaggtgcgaagtgtgaaaattcatgaggagatgcagaagttgatgcagtaatattgggagcagagcatgagtaagggtcttcattattttcttgatcattagtatgtatagaaagatgttcttgtgtctcaagctctcgttcttccggatcttcctcttcctctggagattcagtccagattggggcagtatttaactcattgatatgaaacacccgatttggccttagtatttctggttcttgactaggctcactgatatccatagctgaatgcatttcttctgcttcatcatcagaatgaataggatacaacggtggtggtgatggtggtaaacattgtaaaactccctcaccattatcatgaggatttggcccatctggttcaccttcacgtactggtgagatatgtccttctataccatcatcatcatcatcatcatcatcgtcatcactaccatatttgggatttgatgaagacaaaaggctgctcctgcaacacaaatattgaggatagaattttgtttttctctttcctcatataattcatgaagtatacgatatttgtgtttaagaacattttctctgcattcagcttcttcaagacgtttacgttgtacgtccatatgttccagagcttcttcatacatgtcatccgcggcttccatccagatagacatagttgcttttactggttgttcatgataatccacattctggagggtgcaatagtcttcgcccggctctcgcataggatgataagaatagctgagagtgttgcaacctgtcttggtaaatatgattgagacgtagaaaagcctccctggacacatcatatagtgcagcttgcacggtatcccgcctatgacgtgttcggaagtaatacatatcacgttcacctcgtggaggattgatctttacggtcatatcatattcccaacgttctccccgttgataagcatgtgaatagaattccggcttctcatttatcttcagtttagtcatcaaattgattagttgatcagtgcactcattatcatggatagtaattgcagtttctatgagttcttgctcatgctcttctgccattatcctgaaatacacaaatgatattataatacatgctcgtggattaaatctaccccccttaaaaggtaagcttgaaataaattcaaacttagcttagttaatagtccttaaggttcatcctatagtcaaacatatgctctgataccagtcctgtcggagcccaaaactaacaacttggatccgactgagattaatgtatcaatccctggatcagtaaaaattgatacatacaatataactggttcttcattgcatacgttaaagtcttacaatactaagggttttacaataataggtactcacctaagctaattaatatacagcggaagtttctatacattctaactagtgaggtataacctttagggattttctaaattatcagggtcttcgtagtaatagttataagggtcctcctcttgacccagatctgaaaaaggggttataagagcaaggatgagtattcacaatactcagcaaattatcatggaaatatgttatgcattgacatataatagggttctttgcaaaaagcggtattggacaatctggaaaagttatagcagaatttataaaacatataaactttagatttctaaccaaggtaccatatgagtcccggtactcaactccatgagtacggctattcgaatagtttcaaagatattctactgcagcagatgtacgctttacccgcagtccatgacttgctgataatcatcggctttagtcatggctcagtattaagtcaataacaattatggcacttattccatgaacttatatcctcatatgctctgaacgtaatgttaacagcagcaagaggagttctggcgttcccgaggtatttaaggggaactgatcgtatgacaccacatcatctcgatcagggtttagaaatataccatatagtttatacccgagtatcacaaaccatttacctgtacatggtaatggttaaagttgcccttcgcggctatagttgcctcctgcgcgaggacttaaaaataagaaccactatacagaggtgccatattgctaattaacataataactaggtctgtccccattctagaaactgcggtcgtacccattcgttcgacataagtacctggtaaaacttatatcgattgagacaatactagccacccggaaatcatccaaatcttacgtattgtcccaatctaagtatagggtattttaaccagattgtaagcaaaataagcaatactaaattatttgggtttctatgattaatttatgcatagaaaatagaatattgaatagaaggctataaataaataaataatttgtaaaatataggcttaaatgatcaacaggtatatggtaacttgccttgctcgatgtcctgagattgattgatattatctagagtgtcagaggaatcctcaagacctagggttagacatataaaattcaaattcaaaaaggagtttaaataaaatgcaaaaatagcaaaaaggggcccaatagatagaggatgattttagaagaatattggtccaagttttactgaaattggatctatattttaaaagatatgggcttctaaagtttgaaaatcgaataaaagtgaaatggtactgtgtgtgggtcccatctatcagtctctctctcttctcttcttctacctccagccgttccccatttcaagccgccggcgctagggttggcgactgcggtggcgctagagggagaaagtggttgtggccgaggaggggagggagctagggatctccggcggcggcgagcggtggcagaggagttaatttgatgcgtggacggcctagcggctagggcggcggtggcacggttaggttgtgatggtgaccggagtgatgagagttagacatggttaggggaggggttctagagcatctacggggtatctagagggatttcggcagcttgccaacctttggca

SEQ ID NO: 32697 - DNA, 13123 bp, Oryza sativa
cctgcagcccatatatgtgttctaagtgttatttaaggcggaggatggagggagaggggtggagtcgatcacgcacaaagtgttcgaccgacgggcgagggtggttgatgagatggattggtgaagcagagcttcgggattatggggctatggttgttgatgatcgatgatggacagggaagggattggggtcctatttatagggctaggaggagcggatgagctcgggcaccgttatcgccatggatgagctcgggatttggatgaggcaaaggtggcagaggctgagagagggcgggaaagatcgatttgagtggcgggaggccacgtttgaatacttaccggcgaaggattggcttgaccgcgtgttgattcggctggcgacgtgttggcgccaatccgagcgcgacgcgcggcggcggcgagggtgaaaacggccggctcaggggtgaatggtttgaattgtgagaggggataccaccgtctatctccaatccaaccgtgcggcaagaattggcgcgattcaccccgggtagaagcgaaatcgcactcggtggcggcttggacgggtgcgcacggcgtcaagcggtgatttcgtgcggcggtcgtcgtcccggctttgtcatcgtcgagattggtgcggcggcggtgggctgagggcgtcggacgggcgacggtgcgccaaggcggtcgggcacgcgcgatcgatcccgagatcaacgcgcggcggctcagcgcgcggcaaggtcggctgccagagagcgcgcgtgaaggggaggagaaggccaactaaccacggtttttgagtgggttgtgatcccctaggaccaaacctagactttgcacaagattgggttgaaggtgggctgctctagttgggctgggcattttgtcgagcaccttgagtgtaatgaacagtaaaaatcagaatttttgaatatttccctagaaaagatttgaattcaaactaagagtttggaaaggtttcactagggtttagagtatagtaaatctccactaatattgggataagctaaggaaataatctatggtttgaatttgagagaaattgctcaaattcactagggtttagaataaagggaataagttagagtaaattggttgggctctaatacttgaaccaattttaaataaaaaatcaaatagatttttgaaccaaacaaatttaatcaaaagccagcatgatgcagttaattttagtttaaaatttgaggatgttacatgatgcaaaaacatctctcattgtttgggatgaatctcatgttaatcataagtattgctttgaagcattagaccgcacactcaggacatgttatctgctaccagcctgcattcgacatacaaacagtttagcggttttgggtggagattttgcccaaacacttccatccaatcatccaaaatgtaacaaagaaaaaaaatgaaatcatgccttgttttaattcatattgatggagtacttcatttaaccgaaaatatgaggcgaccaacgtgaaacccaccacgcacgcggcccgcacccccatcccaaccgaccgaccgaccgaccggctcgcggtcgcaggcggccaccgcaccaccccacaccacccaccgacccatctgatcaagataccgatcgattcctccaccccaattcccaattcgataccacccgccaggccgccacgccctcccctcctcctcctcgccatggcggattgccgcagcctcatcgagttcctccgcgccttcgagcaccgacaccggcaccacgccgccgacgcctccacggactccgccgactgcggcaccgcgcccgcccgcccccgccgcgggtcgtcgccgcggagggggaggcggaggctgttcacgtccctctgcgaccactccgcgatggcggcggtcgacgcggtggcgctgctggccgtcgtctccgcgctcgcgttcctcgtcacgccctacgtcaggatggtggcggccgaggtcgggggcctggtgtccgacctcgacgcggcgggggtggcgtcgtcgtactacgcgccgttcgccgcggcgggcgccggggcggcgatcgcagccgtggcgggtgtggtggcgtgggacgccgtggggcaccgggcgcggaggtgcgggaagccccggtgccgcgggctgcgcaaggcggtggagttcgacatccagctcgagacggaggagtgcgtccgcggccagcagcagcgcctgctcccgctccccgggggacgcgccgcgcttctcgcggccgccggggcgcgccccgtccagctcggcgacgcgcaccgcgagctcgaggcggagctcaggaagatggcgccgcccaacggccgcaccgtgctcatcttccgctcgccgtgcgggtgccccaaggggaggatggaggtctggggcgccaagaaggtgcgccggatcaagaagtaggcagccgcttactcccatggccatgaactgtttggctattgctgttactgcttcatcataagaacttgctgttacatacatagcaatactatcacagtgctctgctcttgtagctagtataattgagcataaggagagaaataaaagtggtagatacatgtcttatgaacttattatgatcggtcgccaaatcaaaagtagcctgctccttggttggcagctgttaattggattattatgcaataagtggccatttcctcttgggtatataaataagcgtggtggatagacttctatctgataactcgtatataccttgttgatgaccagacctgtcaatttatactctggctgttatttgtgctatggagtactatgtaacatggatggttttctggaggaagcaatcccattgctgttgcacttacattttgaaaaatgtttgctaacagtatttgcaatagtccaccaatatatgagttattcccttttgtccttttttcattcttttttgtttcaagcagcactaagctctaaacctgatatgttggtgctgaccactaaacctgaaatgtcagcttcatggtggcatgaataacttctacgttatgttattaaattgaggtgatggtgttatttagacggtaaggtttctggtgttttcccccccttactgcttaggttctggtgagatttgataattttccactctttagatttctgttatgatgatttgccatcttggcgcacacatcattgactcagaggaccccacatgtaattgccatggggtggcaagcttcaatctgaagagtggcacatcatcaaatctgcctcttttatgtgaatgggtatttctcagtttgttaattgtacttttctatgcttatcttgttgcatttctgttctctaatatatccgcgtgctttccgttgtattcatattgagagtgccataattaatatgctgtcttccgttagttatcctgtggtacaactcaacatttgcaatagcttgttcatacatcattgaattatttataacctatggtacaactctagatagctacaatctttcccggcctacataatgtatttacagaattaaagtagttataactttggaagaaattatttgtaagctcatttcttctccttgattgtattacatattgtcagctaatcaactccagctgaagccgttcaagtcaaaatgtctataaccttgatcgttatcatctatattgtgagtatttagatcaagattcttccctgaactttgttgatcaaaatctagtagcttgctttctctttgatagtcaactgtttgtcttttgcagcttggttcatcaagatatagcttctctacatttatttctttgcttcctgatgttgaactggttgtgctgcctccgccattcttttgaggcgtgatatactcatgtagaacctctgtatcactgtcacttccctctgatttgtgatactgtttaccgctatacagatgacccattctacgctcacttaagcttctgttaagggaatattgagattcttgatcttgggactgttttcggcaaaataatgtactatcatcatatgctttgagtaccccgtggttttgtagcctatgctccttgaatccttcagctgcagtcaaacagttattggctgaactttcaacaaactggatttgccttggctctagtctgtgtatacttgaactttctcttatttctgtaactgcgttgctgagacattcatttgaaacttgtgagaccagttctgatatttttatttttgcatcttccaggcttgcagggcccaagttctgcttcccaagggtctcttgagcttgctcaagaactgcctgcagatacttcccttgggcttctatccgcagctgtagatgccgttgtacctgataccaaattagcttcaggttagaaccattgagccaattcatattgttgatactatatgcattatattaatcttagctgttttctaaaaatagtttgctgccaaactggaggagagtatccaagttctctaatctttacataatactgtctattctattgtacaatgatttgagaatatagttagaaaatagtgttatgaaaggaatttttggggtagatctacccgatcaattacatatgtccaatcttattcataaagatactggtaccgaattctaaaggtttggctggatgtattctgaacatcgcttaacttttactagagggagaaagttatcttgggggtcattcctggtgggaatcactgttgtgaaggatacaaaaaagatgatacagcattcatagcagttttcttatgctcttagttggtatgtgggcatgctgactggatgctcgaatttttttttatcttatgtcatgtccatctactctatgggcctatcgtgggttaagatcttattatgcaaacagggtcagtacctcacctcaagttgttcatttagctgcctctgcacctcaatttgcatctgtagtgcttcaccgatttgaatagttcttgcacccaataaaagggactattacttcactattcagatggattacaattataaagtacatgggaaatttcttacttctctgcctgtggaatggcgcttgcactggccatcgctaatgcacttgttccaggaatcctatcagcaacacctgtacatccaagggctgcaaattgtcatcatccatgagttgctatgtggctattgtagtggtaacaatggaaattaaacttgtttttaccattctttgttgtcccaacattagcttgaccttggagattcttactgagcctgtatttctgaaacattcaagaaattatgaattgcactgaaattttttagtactattttaaatgggagattcctggttgtcaggtacctggagatggcttttcagatggtataaggtgagtcctggaatgcccatgagcctcatgactgtttttggagtagcttctgagtgattaaaatgaatgttagaactcagctattctagtgcattgagaagataagaatcttatacttactctctgctccacctaattgattaactgcatctacaaatcgctgatgcaactcaggtgtccatttcaacctaggtttagcgtcagttgagagaaccagcccagaatctccttgtgtatttcctccatgcagaaacagatgccgctccattggaaaggatgtcctagtagtgaagaggtcactccgaccctgatgttggtgatacatctgctgcaaaattaatacacacttttagaagaatggaaacataaagaggcaagcatttacactatcctttcttacttgtgttatccagtctgtttcttctctttgctatcacacgtcgaaactgttatgagtgcttctcttttggcagtgccaaagccagcactcttctccaagcctaggtctattgatactcttttggtcttctcaggttgataagcagtttgttgtgaggggttccttatatggggcaacatagaatctagcatcttggaaacaatgatcgaatattttttatgccaactaacataaggtgctgtccttatagttacctctgaaattaaccacccccccccccaaaacaaaaaaaaagtctttaaaaatgcactaaccttttctcttcctcttcatgctttttatgaataaaccatttttctcttcctcttcatgctttttatgaataaatcactgaaagtatgtatatactatagtgataaggactcacaattggaacaaattattgttttgaatgttgctttctggcatatcattctgctatctgatctatttggagtgtgaaagataatcactagatgaaattatttgagtactctatgatcatagctgatggattgttatttagttagtattttgaaactgttgcattttgttttgtttaacctgtttaatgtttagttgtttatagctgggtggtacttggtatgtgtatattttgtttaaatgaaaaaaaggacacttaatgttatggtagtagattccttgtgggtaaggacatcctacataaacataaattctgtcaattttattctgtcctttactactttaaagcatatggaatatgaacaagcataagttccatcagcgtcctttcctaagattggtacatattcacatttcagtccagagaactgtggaccaagaggcttatgctttttatgtgagataagctccttttgaaccagatctctttgattgtaatcatcaccagtcaaagaaacagtacttaggtactatgtttctgtatatgtttcacaactatcatcatttcagtacttttgccagtagaggcagatagtttgttccatcgtgcttcttatctaagttcgacatgaaaagctagatgtgatctgtttggaaatgtatgcaggtctagcccctccctttcccccttcgtttgtttctaaaacagtagcacaatactaattatagcgcttcttgcttggctcttaaggatgcctgtactgtagatactctgatcttagttttgttgctctcctgtaaccaagtctgtcagagttctttacatgttatcattttgccttataccttatatgcaatttattaagggtgttcacctactgtacttttgcaccattgctcttttctgtgattcggttgattgaagaggtgcctcattagaagtgtgccaatggcatatgtcgacacctgggaccactagtaagagctttcacctgtcacaatttaatggtgttctttaatcaatgaaatgaactatcaggaatatatctctctttttgtttcactgtcactggtgatgttgcacttaactcccattaagagctttctgtgatggccactggtattgcttaccattacatgctactgtgctatgtttctttttccggaagtaagaacctcatgagatttagggtagatgggcgatatgagattattttatctttgttatatgatgtttatgacactcattttaccagtcataaagctgttgcatctactgctgtgttagtgctgataagtgatgggtatggagcatgatacgacaggttatatttctctttctacttaccatagtttatttttctgacgtatctacctaacagatattacatgttgttgctgtttgtagttgtactggagggtgggctgtcgtgctttcgacatataaagaagttatcaatagagaatctaaagcattatcccatgctgatcatcttttgcaaagtggcatcacttgtgggagcgcaggcagttgtaaagactgatcctggtagcagttctagaattgtaagttgcatatgacctggaactttctgatctatctttcaacctcttcaattgagttgcctctgcatctgcaagcatgccttgcctgttcaacagtaggattgcagtgagttgtttgtatgagctaacaatgcagagtcaacaccccagggtataggtgtctcttaattgttattatgatcaggtcaatagaaaaaaagggataagagtttcttgttgttcttttttttttgtttgtttatgtaagatggatgtttttttttcttctattaattttttgtggtaaataaggaaacagttttatttttagaatctttcaattgtcaataatattggacccttttaattttctgaccctttttgctgagaagagttccttttccaatcttcttgatcatcctttgtaaattggtcattggtaccatacaaagcaaagtacaaatccggttggaaccaagccatcccagttgcatgggttacttatcttgtaaatgtaggttctttgtccaggcaccatgagcttagtgaatgaagggattcttgtgctcaagcaatctcctcagcatcaattctttcttgttgtccttggcatctgtgttcatcttcaagttgccctgcagccctgcacaatacaattttctttctcatcaatgctcttagatgcgcagttctcgtcttttttctgatgcgccttgccggcatcctaatctcaatattccttgcgcagcacagaagctttcagtagctttcacagaatatatgctgcctgagcgtgcaaataaactatcgtagcgacgactatcttgcgcttagtgatagttactgttcagggatgctttcttgatcaactagtctggtctagtggttatgtgatgctcttgtagttcatgggcactgggggtttggggaagcacctgaaggattcattcctgatatggtatctaatgccaaatttgcactctatatgttttaccttgtttatgactgcgggtgtagtaatgttctctgatgccatgtggtagtagctagatttgtttgaacgtaatctaaggttatataagattacactgaggcaatgaggggggcatctttgatatttcttccttgggagtatcgttggagcatatggaatttctactcctggtcagtgcttttgggcttcctcactttttcatattccaatgatcagattagcattagtcgttgtcatgagaaatattcctcttagaatgtgagcagttgtgccacatttcgcttcctggtttatcgcaggattggaggtgcactctctccatgttaccaaccacctgctgaaaacttcgtttgtgctatttcgccacattgcaaatgtgcaaatcacttggtacgggtggcagaaatttcatcagtcaacagtcgtaattagatcgaaccttgtgtcatatgcttagtccttctgcctcatttgtttcactgtacttgtattaacagcatagcttgtggcctatggacaactttttgcagccgttttcatcaattgaactgaagaatggactcaagccatccaggattccagtcccagatgatgctggtggagcaaagtcaagaggtctcagtaaggaatgctttctttgccttcccattccatctctgatcaagtgaccatttgatatgatccactgagaaaaccaccacattcttgtaaactaaacagtatcacacttatgcaactcaaatcttcttcgcaggatgatttttttgcgctggtgaaccggttgccggagaggggcagccgaatcttttgccgccgacctgactgacggtgcaaatccccggtgcgggatacggtggaaggcgatcggccgaacccggtctgctccacggctcaattcattcattgtcaatgcgcgcatctactgaagaagctgataagctgtctggctgggctaaccgaaagtcgtgtgcaaatgcaatggcatcgtcagctcgtcgcggtcgtggatggcgagttggcgacgcgttggtgcgtggccgtgcgtctgtcttttgcttcgcacgatcatcagttttgcagttgccttcatcgtggctttatttgaccatgagctccggccatctgaatccccaggagcccattgatacgtgcacctaattaagagccacatttgcatgaagcattggagggggcaaatcctgaagctttcgtttttgcagtggtataaagcagctaagggcctgtttggtagagttccaacttctaaatttaacttcaggagttgggtctggagtagagttgtggagctgcctaaacccagctccacttctctagttcattttgtgagagagtttcatccagctccactctcattttaggtggagctgaaactgtttggctgggttctagctccaggagatgtggagctggagctgaggctctatctcttgttttttttcttcttttggaaagctaaattccctattgtaaaaatgtgagttttctaactgccaacaattatagttaactacagtaacatatttcaaaattgaatgttcttctaacatattgacgggtaagccttcttgtgaaaacatatataggccttgtttagttacaaactttttcttcaaacttctaacttttctatcacattaaaactttcctacatatataaacttccaactttttcatcacatcgttccaatttcaattaaactttcaattttggcgtgaactaaacacacccatatatgtttgagctttctgactatcggcagagcccctcagtaccgctgttacaattagttcagttttcacaacttccctattggtttttccggtgcatatctttcttcggagaaaacattccttcccaagtttcaacttctgtatgggttggttttaaatcttaccgtagattatttgaactgagatttctcgctttctactccacgtggatcaaatttcaacacaaaaactcgctcatcgtaatacatactcagtttttgtgctgaaaactgagtaactttgatccacgtggaaaactgaactcagttataactcatcgtagctttgatgtattacgatgagttataaccaaaagtataactttcagctcaaacttatttggactaaaaatgtagactaggtttctttgggccaacagtgactacgctttcaggagtggtaatcctcctgagggcactattgaggtacccctcctctctcagcaaggagttctgggtgaaaaccttgtccagtctttggatggacgacgacggcgtcattcggcgtcgcgaccttcgtgagggcgtcgttttttagagtctccgctccgtggtagtgttgttggctcggtggcgatcggtctcgcatagcgacgaccggttcggtgctcgacttccctctctgtggcgtgtgtttgggcgggtggcacttggttcgggacgtgtgctctggtgcacatccttcctcgacagccagttatcgatgtaaaacttttcttgtaacattttctctttatcttaataatattggatgacctccttcggtcattccgaaaaaaaaaaagtcagttcggatcccataactttcaaccaaaagatgaatagagttctctgtacatgaaaacccgaaaactctcaatcatgatgatcaaagacttctctgtaccaaacgagcttaaagaaaggtaggagctcttgccaatcatccaagaatcaaaataatctacattatcttctctaaattaatacccataccaataccaattaatttatatcaaactatgcctgagcacctcgtacattcgtaacgaataataacaggatgaataatgcaaagccagcattgatcccagagacactaaactcggttcttttgatcacaaccacggaccattgccaagtccagagttcaattaaggattgctgcatggtaaaagttgaaccggatttagatgcgatctcctaagatgtcgtatcatttatatataaaccgcctaataaaccaggggctagatgatagattattaataaacttgcggctgttgttacaagtaagcagacaaacagaacatctcatgaagcagaaaaacaaattattccagtccacaaaggttcatctcaacatctcaggaaatttaatcactttcgaagaaaggataagtagtgttagccatggcagattatcacaatttacataatcttagcatgaagtagctccatatatagaagaaattccatcaaaacaacgttgtaaaactaccagagctgtagactttttacccacatgtttaaatttcggcaacacttcaactgcttcaaaaactcagtcttagctgcacttccctactcatgaatttttacaagaatctgtaacgccttgtttgtaataaataatgaagttgatttatggctgatggttggcaattagctaacaccatcacttcctgaatatgccaatcatgacacatgagtggtgtgccattctcagagccaagacgaaatcaatgtcccaacatgcagaaccgactttagctgcagtaagctgaagcaaagcaaatgagcacagatgatatgacaatgcctggcaagctttctatgctgtgatccatccaagggagatgataggtatggaaaacaacagttctaccaatctgggtcacttgtactatcattattcacaaatcgcaacagcagcagaaatcaactgtgccctgcatttgggttggttccagaagtgtgcggtgattgttgatccgtagaaacacctccagcattctgtgcctcacgagttgagaatagctcattcaaccaaggaacaatagcccagggtctgttactgctctcgctgacgtttccagggccatcagctctgacttcctcatggctgtcctccactctaccaatgttgctaggctcgttcaagtcttttgtctcctcagaaggcagctcaaaccggcaaaccgggcaggaactatgtaattcaagccatggcaggatacaagaagaatgaaacttatgttcacatggcatttgtttagcctgggaccccacctcaagatcatcaaggcagactgaacagctgacaacctcttcgattttcacagtgggcagcgcttcaaccgcctctttctttgcaggaggggtaccattccgacttgggtcgctctcagccaaatgttgaagcagcaggctcagacctgctccgaggacatactcctccagtaagccatcatcatttgttgaaccgccttggtcaccttggccctcatcaggatcaagcactgagccttgcagagcgagggcttggttgaaggcgttgatcagaatggaactgtccctttcttggtcatctgcaaggtcatcatgg

SEQ ID NO: 32698 - DNA, 1074 bp, Oryza sativa
gaaataaattagccttttttgggttcttcatcaacagggccagcaagctgtcccagagaaaagacccacttgggggggatgaggcacagcactgacagatagatctttgcgaaggggaaggcagagatcaagagccaagattccctctccaagaatcaggtgctcgattccaattctttcagagaacacgatgctatcccccccgaaagaggaataaaaacgcagcagaagtctttggtttgggggttagaagaacaagaaaccggattccggcactgctcaagattcacgccattgcaccccgtataatttcgtcgcaggactcatcttcccccaccaaaatttcctctttttttaaagagaaaaatctctagattaacatacaagcgatcaaagggggaaagatagaaatcgtctccatgatttcgaacactggaacgaaaataaaaagaatccccttttgtatcaaactaagcagaaggaaaattcaaatcaagaagtgactaacctttcgattggactgggatattggattggatagaggcggtcgtcttgttctcgtttgcttcgggcgaagtgtgagacgaagaacaagaagttcagagggcaggtggctgcaaagctggatactttactccatccctagaggttatcgtactactaccaattttttttctctcgttcttgaataagataaagttttttttatatgatcctagcgcaaatctccaaccaataaagttttgttatgactaagcatacaaatcacgcaaatccgctgatcatcttgggagattttttaatatctgtaaattggagtttggctgataagaactcgttttcatccaaaagcaaaactacctaccagactagtatgctgttggcttctcccttgtattattggcgtgttaatttctataaaccattttcaatttattagaaaaatcttgttataatcttttttttacgaaataataagatatgaaatgtcaaagatataaatgattttgtcaaaatattttgtttctgatacttttcagcgaaactgtcgacgatggtatttgtgatactttt

SEQ ID NO: 32699 - DNA, 8046 bp, Oryza sativa
  unsure (1)..(8046): unsure at all n locations
atgtcatactttacacctgattagtactcctacttactatacttattttggaactggacctatctaatttctcctagtcagaaccaaattttctcctcagaaagatcccatttttttctcatagaatattcacaagctggtacttctagaagataaagaaatgttaaatccggaccgacgatctggtggtctactcgccgatgtcaacgtgccacctgcactttttgggcctaaaatgggccatacatgggccggaacccggcccatacaggtccgtgtgaaccaggccggatactgcggcccacactacacggcctggcccatgaatgatcggagatgagagcaagggtgacgtcagccatggcggagaagccaatccaccttctccctcccctccacctagccgtcgccgccgccgccgcatctgccgaaggcgggagccgtgaggggaaggacctgtggcacgaggtggtggcggcatggagttcctgcaggggcagagcacggagaccgccgtggccgtggcggtggccgtcgtcgccgtggccgccggcgccgccttcctcctcctcctcctccgcagcagcaagaagcccaagggtatgcacccgcgagatctctcttcactcgacgacgctgcagcttccactgccactgaccactgtgatacaccgacactgatttagtggtcatttacctagcgatgtcttcggccttagccatcggttgcttgcatctgttctgcagcatttagagaatggttttgtgattgttaatgtcttcttgaagtaagctagtatcatctttggttcatagctcatcctgaatggttgtgctgtgatttgttccattaggctgcttggaccctgagaacttcaaggagtttaagcttgtggagaagaggcagatcagtcataatgtggccaagttcagatttgctctaccaacccctgcttctgtgctggggcttccaattggccaacatatcagttgcaggttgggggttatatcatatgtcttcttgcttctctcatatcttttgtttctcttttacaaagaattgtgttaaatgttatctcctgttcttgcagagggcaggatgctactggcgaggaagtaatcaagccttatactccaactacgctggattctgatcttggacggtttgagcttgttattaaggtaaaatttcacaaatatgttccattttgaatttgttagtcttgtctcgctagctttgtgcgtaatgtaaagctatagtccgtcagaaatgcaattatgtcaattcatccccctttcctggtttcccccctaatttttccttctcattttgaagatgtatccccaaggaagaatgtctcatcattttcatgagatgaaagttggtgactatttatctgtgagaggacctaaggtatggctttatttctgttgtaagtaatacagaaattttccatgctgtatttggccattcttgtgatgtataattttttctctgacttggttataaatctttgtgcctgtataaatttgtctgtgacttagggtcgcttcaaataccaacctgggcaagtaagagcatttggaatgttagctggaggatcaggcattaccccaatgttccaagtaagaccctttccaacaccaattttttttatggcatttaatatgtgagacacctgtgttcttcaattcattgtcctcccttactgtaggtcacaagagcaattcttgaaaacccaagtgacaatacgaaagtgcacttaatctatgccaatgtcacatatgatgacattcttctaaaggtatgatcttgttgaaagaattgctgtagttctccaccagtgattaaccttactggtgtttgttatatttaaagtcgcttcaattcatgggtgcctattagacttggatactatatgctctatccgttcagcttatgatattaagaataagaatctggtatgtctggtttttgaataaagggtagtttgtctagttgtagtgcaaagttagcaggttataccacagaaaccttgaaaatatcatacaggacatgtactttgttaccagataaccagaattccatatatgtcgtctcgataatcttcttccttaataatctggtaacagcccactttttaattgaaagtcaaagatgatatgcaaactatctctcagtggcctaaccatgaacacaatcaaccttgtattgtagcttgttttgctatgtagagtcctttctctttagatctgttggagaaaagtaaggttccattgttgaagtaatgcttcatatgtgcttttcgataactgaatgagactactgcatagtttctgtaagatgaacgtggttcaatatgtagtacgatgttgtgcttgaaagctgatgtttgctaattgctgctgctcatttacttgtcgctttgatttatgcaggaagaattggatagtatggttgaaacctatcccgatcgcttcaagatatactatgtattaaatcaggtttgttttctgttctgaggtctagtactttgtactgtggtgtgcaataatttcatgcctgaactgtctactttggtagtcccatcttctactacttactgctaatactactatattatggcttgcattaaattcctaccatgcaccttacaccatcagctttgttttcatgagcagcctccagaaatctggaatggtggtgttgggtttgtgtcaatggaaatgatccaaacccattgcccggcacctgctgctgacattcaggtaggtgtcacattgtgatgtcttctgtggtagcgtgccttctggaacttggaaccgacaattgctaagagaatagttgaagtgtattccatctaccaagcaggacatctgtgtgacaatgtatggttgctcctttcagatattgagatgcggacctcctcccatgaacaaagccatggctgaacacctggagaatcttggctacacgaaggaaatgcagttccaattctaagcctccacagtggaacaataccgaaataacagcgatggacaacattttcgttcaccttcagtagaaattgtctgaccctagtgccatttaatcaagatataggcgaactttaaacccgataaaagtagaatgtcgggtcagcatattttgagtgaaagcaaaaaacaacacctacttgagttggggtcagaagttcctgtagcccatcatttttgtgccaatgctgttcaattccagacagacagaatgaaactaattatttttttttcaatcagaattttggacacaaggttggaacgttcattgctccagctaactcgttgctcaggtgattaaagaatgaccaacttgtaccatttgattatgagaagaaaaacaactactgtacgtgccatttatgtctgtccatagatgcaaaaacctgtgacagcgaagctgttgtctgttcttttccagctcctgtcctgtacagccaaaacagtgcatcaattcatccgcttgtttatgcacaagattgcaaatctttgacagcaaagcaatcgccttttcttttcagcagctccaattgatttggtattacatacatacaaaaatgcattgtgtcttgtacgttactgtacgtatgtgctggcttcctaggagacatcagcgaggagattacgtccgcctgctgggcacacaagcattcggttccattttttaaagtaaatttcgggacattaaaactattttatcaaaactatcatgttgctgcaactttagttagtcatttaggcttcacctctcgtgcatgcaaaacagagcgacgtattttcttaattttaatatatttatatgatttttttaaaagtagcttttgtatagaaaacttttgtaaaaaacacaccgtttatcaatttaaaaagcgtacgtatggaacacgagagaggcgagttggaaaatgtgggaaagaacacagccttagagaactgtgtagaactatgttttatagaaaactatagttttatttgtctgataagtttagagcccttattacacacatggaatattgaagctattgtaatttaggcccacatgtcgtatgtagtgtacaaagttgtagttttctgataaaattgtttactattgttgtaattttgtgaattatcaattccataatttgcttgttagcttatcaaccacaatcaaaatttgaattttaaaacgcaattttagagtggttttgagttttttttatcgtagtgtatttgtccagtattgccttttaatatgttaaggtcatacatataaaggttttacccataaattatttttattgcttcatttatttatttttcacggctcatcagttgtacattaagggtctgttcggttcagctgggctgtggcgctgcagctcccctagcataatcttgcttgctgagtcctgtagctgcagtgctgctgctgccacagccagctcttccgaattcactctaagcaatgagagacctggttgaagttgtaacaaggtgatagttatcaccaaatagttgtagttttgtgaaatctactttttttaaaaaaaaaactacaaacacacattatattatatatatatatatatgccaaaataaattctacagatgtactactacttttgtcaaaacattttgttaactcagaacaaatgatggcagtgatcaacacagagctgtaatttggggagaagcactgagctggtgctataattagaatcttcgaggttaagttatctcaagctaaatgtggctaaagggaaaggacattgttttcagataagaccaagctttgatgtgtaccttaaaggttattatgtagtaggcctccccctacttctacttatttctttgggttgcacatatatgactttcttctcttgattgcccctccctctctagatctctcatggagggcgaaaatcgctgtcatgatcagttttaaatgcccatcatggcaccccactaattctcttgaggggtctagttttaatgatggagatgatgatcccacatcatccctcccacgagctcgtggcctcatgaccaaatcatatcttcttttttatggaccacgtcatttcttactcggatttatttgtcaaactataaatgaattaattattgttcgtctatttttttcattggttaaaacaactggatttggaatgaatttaaatgcaaacatatatgattatatttaaacttgtctaaagtttgtctagtaaaaatttcactagtactatctatgtttttaagtaattgttagtggcgattattattgctttattttgaccgcaaaataccattaaatggttaggctaggatgtgcggaagcgttatgattatgtttaggatgcaatacatccgtaagtaattgtttctctaatgaaaatgagttgtcgaggtttaaagatgaaaaagtggatttccccgtgcaaagctacataaaaagtacaattggattggatttcatatacgattatgttttttatataaaactggtaatagaattaatattcacatataggagtatctccctacgtacggttgtaatttgtatacagtaaatttaaaaaagtagaattacatctgatataccggtcttacgctcttagattttacatttttatgtgtttcatatcaaccatatcgaccaatctacactggtatagtttgaaaccatgttaaatttagtaagaactttaccaaaatcagttcaatcaacaaaaacagttaagtaaatttcacagaactacggatattccgactaatttatcgcaaaactaaaatatcgtatcacaaaactataaatttagcggtaaatttactataaaactacatattatatattgaagttatcacaaaactacataattaatattgaagttatcacaaaaccgcaaattctagagtctaaatccctagtactaacgttatattagagctatataaatgttgtagttctatgataaattagcactgtagttttgtgatatatttgctacttaaccttttttttttttgacactccattcaacatgtagttttgtgatataagattttaaatttgtagttttatgaaatttacttaaaaagatgttcccatatttatcattgcattattctgtctggctgtctgccatcaagcaaaatagtcttgactcttgagaaggatgttgccttgagaaagatggtgcttcaagccttcgactcatcatggattagttgagttgaccaccaccaccaccaccacaccacgacagacgggccaatccacccaaccgtctccacttccctccccaccgcgccaaattcccaccccctcctccgccgccgccgccgccgcacgtgcgcctccacctcctctccattgccgccgccgcggcacggtcaaccacccccacccttcggcggagtcgcggaggaatgcggggggggcaatagaaaattcgctcgctagcagttggcatggcggattagtttaatcttgaagtccttggtggtggtggtgaagaagaaggggaagagcacgggattgggctggctaatggccgggtcctcctcctcgtttggctcgcagagcagaccgcgacccgggtttgaggggggagcagctccgcgccgcgctcgcggttgctggctaaggccgccnccgccttctcgggttgggggagtggttggggacccgttgggttcttcgctgctggggttttagggatcctaggctggcttgcttgcttgctcttggaggaggagaaagatcgtgggggtggagggtttcttgcgggggttgccggattttgattcgtcgcccgagcgggtgggttcctgtttcatcctgctgctggaaatctgtagaattgaatttttgttttctgattccatatgctcgatttctctttgttcctgttcgcaacttgtagaaattatggtggaagaattctttggtttcagaagcataatgagttgtgacaaaggatatttttggcatgaaaacaactttttcttttggtatttgtgggcgttgggcgcggaaaatgtttgatttatacttggaatctcttccagtatttacaggcatgtaattcatgagagcccgcattgataatatttcatgagacttcctaggtagtggatttttgtacgtcacctgttgctcgaaatggcactgtcataattttagtataattatgatgaatagttgacgatacttaattctgttaaatttttgttcaggctggatactggaaaaaggagaagcttccatttttttttctctgacttgaaaggggatggccttcccagatgatgatgaaaagatgaaggtttgtgcttttcgctttacatcattcatataacattacaatacactcacaaaaataaaacatagcagcataattctattctcagatccactgtgctctatttgcatgttttggccctaatattttttttttcatactgaacttaaatcaaagtatttactttgtaattggttgtatactatagggttgccggccaaaactttttggaacaaaagataagaaagttgtgaagagggcagattaccaaagctgttctgcaggttagtttttctttctttttgaattgtgcatctagactgaattggtgtcttgtaggatagtgataaattgaaacgaagatgagcataatttatcaaatttcagctcatctagttgaatcaggggaattgctcaagtcagttgggcaatcagccaactacattcataaggtcaactgaacctcgtttcattgtgtataatgagaaatatatgaggagacagccagttcaaatatgtttaagaagatgctaggattcatttattctctagtttcatacttgataacttcgtgtcagaaatttcacattttgcccgaattgcttcaatacaattacgttgatttggcctaatgacaataatatagcgtaatagcaactaaatgtttccatgttttcctgtcaaatgcagttaagtccgggccaagttcctcaaagtcacaatc

SEQ ID NO: 32700 - DNA, 14266 bp, Oryza sativa
attggattattttttggttctttggactgaaaggaagtttttgcagaagttaggagcatacgcctcagccatttacttggtcactcttcaagtactactaaaactgaacctttcaggtcaaacagctaaacttgcatgttgagtcatactttatgccgtcggtttgtcatactttacattcttagatcggactaggtcgtctttaattttttaattcattatataggatatttgtatctacatggaatgtcggaggaaacacgcctactgctgaattaaacctggatgacttccttcctgctgatgacaattcagatatttatgttttagggtaagttatttcaccaatttttcaccatcttacatatttttcatatttcagttagtgagtgatatgaaaaataaaaatagctccttttaatttgtttcctagtgatttcaggatgttactaacttgcttgctttgccacgatgagctaattttccttagtgttcatttgtttcattcagtgaaccgaagacgctgtttccatctgtctcttttctaatttttttttgacacattctcttatgatattatgcagttttcaggaaattgtccctctcaatgctggtaatgtgcttgtcgtagaagacaatgaaccagctgcaaggtggcttgctcttataaaccgaacgctaaacaaaccagttgacagtaatgctgatatcttccagcacaagccatcttcttcccttgattcaacctcgtctctgtcttcatcaaaccttgatgcctcattctccagccgcacaagaacagctagtggtagttctgcaatcttccagaagtcctccttgaagtctatcaggaagccttacatgccaacccagagaaaactgctcaaactctgcaattgctcagttgagatgactaggaagtcctacaaagatgcttgctttggatgtccacaagcatatgctaatgagacggactcttcagaagatgatacagatgatagatcgaatgatccttgtggttatatagttgatggaatgaattctgctgcctctgcctccagggatcagctaaaatacaacctcgtatcgtgcaaacgaatggttgggatttttatcacggtgtgggcaaagaaagaacttgtgcatcatataggccatgtgagaacgtcttgtataggtcgtggaataatgggctatctgggaaacaaggtaagaattaaatcaaagttcagaagtattatcttcataaccttgtaatgggatgtcattgttaattaaagcattacaatggtcacaattatattaataagtacagatttagcctgacatgttttttgataatgtttaatagccggaagtcatccttctgttctttctttttttttttttggagaaagagagggggacctctcccatttcattaatgaaatgatagtagttctacaagcattccaggttccaacttacacacaaagtctcagactactcctgaccttcagaattacaccagacagactaacagagcaacacagatgctaaagcaaacatttcagctccttccattctttttagtgtgacatagtaatgagggttcttcacaattctcatgtgtagattacatatttatgccacacttgcttttggcttcagggatgtatatcagtgagcatgacggtgcaccagacaagtttctgcttcatctgtagccatttggcttcaggtgagaaagagggtgatgagctgaggcggaatttagatgttttagagatactgagactcacgcaatttcaaaggatttgtagagctgggcgaagaattcctgagaaaattcttgaccacgagtaagtcatgcactcatgctacacatgctgcgaaggatttgttcattgtcaatcatcatttactaattattgtgatttctcttattttgttagtcgagtgatatggctgggagatctaaactaccgtatttccttgagctatgaagataccaagaaacttcttactgaaaataactgggatgccctttttgaaaaggaccaggtaaacttctcaaaagatgcactgttttttgaaacttcctctcagaaggaaaggactaaagtaataaacgataaaaccaaactttcaagaacttctactgtgtatgtgtgctctatgttctaattatatctagccaggctataatctacttatatcttgtgaaattttggttaacatgcatggttgccttctctttttcagcttaacatcgagcgcaagtctggaagggtgttcaagggttggagtgaggagaagatatattttgctcccacatacaagtattctagtaactcagattcttatgctggagagactgcaacatcaaagaaaaagaggagaacccccgcctggtatgtaccgtgttcatattagttagttttactataaaaatgtattcccactgtgtcaggttacaactttattggtaagttagtaccatttaattatcattataatttgtccacatgcttgtgtgcaacttcagtaatccaacattatcatcttatattaccatagaagaggaacatcttttgggtttcttgacgtgaaacagtgcgcatttggacaaatgttggttgaagtcgtagaaatagaaaacgatgaaatcattcacatgaacaaatattgcatcatactaacaaatatatatcagacaaatggcttggtgtactggctgtgtgcattgcactactgctgcacattttgcatttcaaatgttaatagtttcaacttgttcaggtgtgacagaatactatggcatggagatggcattgtgcagttgtcctacttccgtggggagtccaaattttcggatcaccgtcctgtctgtggaacatttattgttgatgttgaaatacaagagagcagatcaaagaggcgatcatctaataccaacatcagaataggtgctgaagaactcttaccaactagtaagagtaaggctaataaaaataagggcaataaaggtatgcagcttcttgactcttgatttaaatttaccataaaaacaacataatttccagtatatgcatggacaaaactaatttgtatgggcattgcacaggttctgggacctaaaccctattggaaattaaattggtagcaacagcaacttgtactaagatactgaagaatatttccatcggcacctgtaggtatttattccaaagcagattatttttttgtgacaggggaaagtgattaccaagtcgtacagaaaatgtagtgcatatatactttccaaagggaaaggtgattatattatactcgaacaattttccacattctttttgttcttttgggtagaacaagtgtgcctatgcatagctatccagaatccattgacccccttgtattattgtgtctgtctgatcagtttgaacttttctgtaacaaaattgtactgagaacgaggcattattccaaaatgtacattatgttatctatctatctatctatctatctcataattgtctttgatttgccgattattatgtgactatctcatggataaacacaaattaagtatgattacaatgtacagtggatgtttcacctgagctacgtctgtaaattttcctttttgttcagtataattttggtcacctggccaagtgcaccatggtcttcttgtctggcttcgatcgacttctttctcacgaatgagtacaaacttttgtgattttcagctgaatttcattccttcaatcacattaagaacatttatgcaaacctattttatatctgaattctgctcaccttgaagttcaacggtagagccttagagggttctgcaactggaagccagaaatgcaaacttaacaagaaaggtcagcatttctggtttccctgacaaatgagtgcagttgttagtgcacgaagcttattctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgattaaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctgactttggggctaattcatccaaaggttagtttcaagcagtatgtcattgaaaaaccacgctcacataatttttttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatccaattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatccagcaagttttacatcaaaaggaattttatagttacttaatacgtctttaaataaaaaggaatttgattatgatcagcaaggaccatacaaacaaacagccacatcacccccagaaaatgatagctagttgagcggatcaatcaaacgattctaaacatcccggcgacgacgacggcggcggcggcaatggcgacgccgacggcgacgaggtggtccccggagcggccgcgacggtcggcgttggtggacggcgtcgccgtcgacggcggcgaggcgaacggtgaggtccctgcagatgaagttattaaggtcacatgaactcgaatttagcggccgtataaatacgtgacaggcacatgaacctaacggtacggcacgtcagtgtttactgtcgagccaattaattgccatcataaactgtatatgatgcttttgtacatgtagccgattaaatgtttattcctctatgatagcatcatcacaaattgtatgaacaacaaccataacgattccctcttcttttttcttttcttttttttgcgtgtataaggcaaagcatattagacaatgtgagttaggagacgtatttactggtgtagtatgcattagtagtgatgtgttcatcagcatcttttttatacagcgtgaaaaaagattatttgaaaaaaaaaatccggctggaaacacaaatctctggttaaaattagatgcttccctaaatctttgctggtatgtgacgtgtgtattactcagcttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaggtggagacgggaggggtggagacgcggcagatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggccccgctggccccggcgccgccgccggcgccgactgcgcctccgccgtcgtcgccgcggacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtttagttgaggaaataaaaatttttgggtgccatattggacgtttgaccggatgtcggaaggggttttcagacacgaataaaaaaactaatttcataactcgtctagaaaccgcgagacgaatattttgagcctaattaacccgtcattagcacatgtgagttactgtagcacttatagttaatcatgaactaattagacttaaaagattcgtctcgcgatttcctccctaactgtgtaattagtttttcatttatctacatctaatgcttcatgcatgtgtctaaagattcaatgtgatgtttttcggaaaaatatttggggaactaaacgggctttaatacacgctcaacgaacgtacaagtagtacgtcataaataaaatctatatatcttgcgaaattcatattcgaacaccatggtggtgtttgaaattcatatatagataaggatgaagattaagattaaggttgtgtatagattccaactttttttcatcgaacttctaattttttcgtcacatcaaatatttagacacatgtatggagcatcaaatgtggacaaaaacaaaaactaattgcacagtccggctgtaaatcacgagatgaatcttttgagcctaattacgtcatgattagcacataggctaaaaagattcgtctcacagtttatagtcggaacctataatttgttttgttattagtttacattattaatacttcaaatgtatatccgtatacgtcaaaaaaaattggccaattttttacagcatctaaacacggcctaagtgttttacgcaaaacgatatggtatcaacgtatgattaattttttaattgacttttagttatttattttgtaaaatatccaaactttagagcaacttttatataggaagttttcgcacgaaacatatcgtttagtaatttttaaaaagcatgtcacgcatatccaaactttggtccagtttttgttgaagaaataaataaatctatacatcttgcgaaattcatatttgagcactatatgtatcccgagtcatgacgtttggtgcaagagcattttatccatgtctatctacaacaacaataatatatatggagtataagttttcaagaaaacagcaataatatatcgaacgcaattcaaggatgatggcatatgcatgcatgccgcatgaaggatatgagttgtggctatctagctagctagctcacattaatgcaccttgttgtaggagtaggatgcgtagttcttaaaaaaaataaaaaaagaaagaaaaatgtgtaggatgtgtacaccctccgtccgtccgataaaaaacgaatttagaatcggatgtgacatattctagtacgataaatctgaatatatatatgtctaaattcgtagtaataaaatgtggcacatataatactagattggttttttttaatagaacggagtacatgtgaaacaagaaactgcccgtgattaaatcctgtatctatacagtcgacacgcatgcattgcggctccggttctcgcggcagggattaaatcctgccgtccatcttcagctcgattcatcactgtccatcaggtcaaatttgcgcagttcacacacgccggccgcccgggccgaccctcgcgttgcatgatcgaataatatgattacgacgagctgttctgttcttcggttcatatgcatgatccgatgatcgatcgatcatgaggtgccagtcttttgcattgattggatcaaacataattctccctctgtctcaaaaataaataaacacatgtgatatgtaacatattttaatactacaaatctacttataaaatcgaacttatattaaagagacaatc

SEQ ID NO: 32701 - DNA, 7471 bp, Oryza sativa
tggctacatggaaatggttcttggacacactgaaaaatgatctaggcatcaaaaacacatatcttgggactataatgactgataagcagaaggggttaataccagctgtccaacaggttttcccagagtctgaacatatggttctgcgttaggcatctgtactcaaactttcagcttcagtttaagggagaagtaccgaataattaattgagggcatgtgctaagtcatcttctgtccaagaatggaacaaaaatatggatgtgatgagaaatttgaacaagagtgcttatgaatggcttgaaaagtagcctccaaacacatgggtcagagctttcttctcagaattccctaagtgtgatatattactaaataataatcgtgaggttcttaacacatacattcttgacactagagaattacctattctgactatgctagacaagataagactgacactaatgactaggcatttcaatagacaataatagttcgctgatcagttccaacgcttaatctgacccaaaatatgaccaatgtgctgaaaaatgcagatgcagcttatacatgttatgcatcaccagctgtgcaaggaatatttcaagtgcatgaacggaatatcagtacatagtggatatcaatgctatgcattgtgattgcaggaggtgggactttacagggattccatgtaatcatgccatatcctgtcttaggcatgagaggataaatgctgaaagtattctccctaattgctacactacagatgcattcagtaaagcctatggtttcaacatttggccctgcaatgacaagagcaaatgggaaaatatcaatggtcctgagattaagccacctgtgtatgagaagaaggctggcaggcccaaaaagtctaggagaaaggcaccatatgaagtaattggcaaaaatggtccaaagctgacaaaacatggagtgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatacttaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggatgccccgcatccgagcttgaagaagagggcgacgaactgaagatggaggcgacgaatcgagcctccctagggtttcacggcttagctcgatggggaaaaaaaagcgaaacagtgggggatttatcgtctgagggctggcgaaaaaataaggggcttaatgcataatgcaccaccctggctgtctcctcccctccacgttggcaagccatgtcagcgagcagaccgagtcaaatgggtttggacaggcaatgtacggctaagcaagtttagggacctgtaaatgcgatttgagagtttggggatctagatgacacacccttataagtttgaggaccgctggttcactttactctattttgaaactaaacacggcgattgaatcggagtaaaaagtaggaccgtcacgtcacgtcggatgttagcgcacggacggttggggaagtgatgtactgtaggagtatctagctagctggcattcattcttgcattcatggtacaggcatgatcaccgtcccctttctctctgtgctactgttactgtggctctgctgcgtgcagctgtcacggtttcatttttcgggtgtctctgggttggttaacccaatacacaaggcaacgaacatgtttaccggcttggtttcatgtgggaaaagaaagcaacggaattgtagccatctcagctcagctctcaggtgtacaatggccactcgaccgcttgcttgcctgccggtctctttcgtttgctccgttgaacatgacgggtacaaaaactttgggatgccaccaaaatattcgttcgtccaggactccacataggcacatcgtagccgcctggatatattgctccgaccgacactagagatggtaatgggactccgatttccctgggtgtgaatatatgttgcattgcttatataatttgacacgtatatattattttaaatagggacaaagaccccataggaatttattccccgtgcggactgggatgggagcaaaatttccccttcgtatttcacgaggacgggaacggaaaagttttgttttgcggggatgggggtgggggtgggggtggggaattcaccatccgacacaaacttagattctgtttaagagtagagaaaagaaaacgtttgaaaagataggtaaacgagataagttattagtgtataattaatatttaattaattattaattaattattttaaatttaaaaatgaattaatattgtattttgaaacagtttttatatactacctccatcccatattacttgtcggtttgagttgttgtttgtactccctccgtttcaaaatataagcatttttagctatgaatctagacaactgtgtatccagattcatagctaaaagtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaagtatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagcccgcagcccgcagatctgcgagcaagggcacgcagaaagcgcggcatcggatcggattcgcggccaaccgaagcgattccccgcgcccacccagattcctcccaacaccaagcgtgggaacgaagctagatcgagcggagccggtcaaaccgggtcaaacttccccccgaatcaattcaaatccccccccccccccaaacctatcgaatctagcgagaaaacctaaccaatcaaatctccttcagatcaccc

SEQ ID NO: 32702 - DNA, 15579 bp, Oryza sativa
aggttatgtaggagggggagggggaggggctggggcaccggcaggtggggcccacgtgggtttgtggtgagggcgtggaggggcaggttggagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaagatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccggctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgttctagatttctgtgatgcgtctggtactgatggatgttagtttttgcagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtactgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttgctcattgttcctgtaatttggcttccgtgtagatcctgccattttttccatcttgccacttgtttccatctagatccagtaactttgtaacattgtctgaataacaaatcatgagtgcaatatatggggttggaggaaatatttcaaggtcctctgcactcaacaactgcctgtgttccttgagcacagggttcttgaaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttgaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaagaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgtttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattgaagaggaatgtttttttttccttcaaaacaggcactttcccctttgttttgcaggaataattaaacatgaatgcatggcaagctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtggccggagggaggagaggaggacgtcctggagggcgctgtccttgttcatgcgggccttgaactcgtcgaaggtgaccttgccgtcgctgtcggcgtccatctggtcgaacacttcgtccagcttccccggctccgttatgtcgcttggcagcacttcttcgggcaacgccttgtgaggatcaccagagttcaaatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttgttatgaattttaattgaatttgaagttatgtatgatatgatatcatgcaatgtttctgatattcctgtacataaattggaagggctgccacttcagtttgagtcgagtgcatttggaaatttttacctggaagcacaagcgaagagcatcatcgcctcgtgagttcctgaggctggagaacccacacaggatctctctcatgtcgacggttccatcacggttgttgtcgaacagatcgaatacgcggggagctaggggaatcagtgagtccattttcattgctctcagcacctgctcaaactctgacagagtggcgttttctccatctgcacatctgcataaagagcacttgcttagtgttatacttttcgattggaacatcatatgtgtcatgtttaaatcctaaaactatgagagttttacgagaaatctgaacttctgaagcttctctgcaaaggaaaaaaaggctaccgctttctgcttataaatcttttcggtgttaatttcccagttcatcatagcacatatcttcgactcataaaatcctaataaaatgggctgcacatgatatatgatatgtgcaaatatactcttgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaagaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggccaactgctattgatttgacatctcagggcaactttttctactagaactggacaaaatataggacaatgcaggtataaactgaagtgctaacaactaccaaaagacgacatttcagcaatgattggcaggcagatctccaaactatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaataggtatcgtcaaatgcgaaccagaatattccaaaccattttgaacaccattgaagcaacaatttgaccagagttagctcaggaaacttacttgcaggatcctttgctgcttttctcgattggttgcagcatgaaatggtgggcatctgaaatacacaaactaccaggcttaaaactacgaaaataatcctaatcaagggaactataacaagaaaatggccaacatacccagataaaagaatgtacagaattaccccaacagaccacatatcactagcagctgaaacctcctgcctggatagagcctccggtgaaacataatctattgacccaaacagcgcgacgattgggtcactgaaatcttcgacagaactcaaaccaaaatccatgatcttcagtgtggacttctcatctttgtcagagaacagacaattctccggcttcaggtccctgtgtacaatgcttgccttatgaagagcctccagcccgctagcaatctgacgaatgacgcaagccgcatcgaactccgagtaccggtcacgccccacaatccgatcaaaaagctcaccacccgagcacagctcaaggacgaggtgcacaccatgcacatcttcatacacatcatgcaggttgatgacattaggatgtggcgcaacgctctccactatcctcctcatgacgagtatctcgttcgtcagcagcgcgtcggagatcgatacctgtttccacatcggcaggccggagccgggcacgggctttgtcccctgcttcatacccgccatcgacgggccgagcctcctcagagtcttgatggcaacctgagtcttctcttcagacttgctcactcccctccttactattgagaacccgccccggccaagaacatccacacttcgatagtcatcggacaactttctgctcacagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtctaacggatgaaaaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaaatcaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaccaaaaaaataataattttctagatgaactatgccgaatctccaaagctcaatggctcttgtgacgcttagggtttatctttccatagggtgcttgcctttcggtggtcatcttcaactccctcctcctacgcttccgtcgttcacttctggttgattttgccttgccatctgcatccccctgttcattcggcagctccttctctggttctgatgaagcagggccttcctcagacttagacttcttctttttgaccttcttgccttctttatcctgtcctccaaggatcgaatccttgatcagtttcttatgatgcgtcaccttccattctgcctccctgtaaggagctatcttcttcatggatacatactggttcaaatccttgtcatctgatgccaatatctcatag

SEQ ID NO: 32703 - DNA, 458 bp, Oryza sativa
ctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtacggcgtatggagcgccatttcgacgggatagagctttggcacatgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccacggcccgtcggagtccaagcctcgggacccgaggggagcgctcccagctcccctagattgattgcttggatcactgagat

SEQ ID NO: 32704 - DNA, 1118 bp, Oryza sativa
catgatctccattagtctggggacaactggaggttgaaacatttgttgtttatggagcatagatcatgttatatagtgtgatgtctgaaatggttttatcgattttatatgttctcagttacctgcttacacatgacatattctttttttctgttgtacatatgtgcaaaatacggtgcatttaactcaggctgtatttgtattttgatgtgtggtccttgttattgtgtttgttgcttgttgatattagttaagaaagttaaatgcaaacttcccttgaacttaaatttctcgagttgaatgaatttgcagttataacatgtaggaaatttcagataggttgtgttgtggtttctgattgtgacatcaatcacatcttttttatgtttagggaagctgattatccttgcaaacaactgccctccactcaggaagtctgagattgagtattacgccatgttgggaaaagttagcgttcaccatttccatggaagtaagtttgtttcatccttccgaaccatttatgttttgtgtgatagcatctgtattcatctacatgtcacggtttttccgtgatatagtttggtactgtatgtcttactgtgccttcgctttcagacaatgttgatcttggaactgcctgcggcaagtactaccgggtgtgctgcctcagcatcatcgaccctggttcgtcgctaccgacatcacttacatatattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattggtgttaaggcatttctatggttttgtttgatgagatctctatttatatattgagcaagtttattctcctgctgttctgtgagcatcagcaaagagagcatcatccaagatgtttgcttccttgcttatgtggatcaaaagctagactatggttgttaactatctc

SEQ ID NO: 32705 - DNA, 614 bp, Oryza sativa
  unsure (1)..(614): unsure at all n locations
nnnnnnnnnnnnnnnnnnnnnnnnnnnnnnnnnnnnnnntcacaaaaaaattgtaaaaaacctaaaatttcgggcgagatttgagcacaccggtgggggacgaaattaccgaaatttcggaaattatgaaccgaaatttcaaaccctaccgggagatcagtaactaaaaatccgagatcaaaacgatgttgccactaaacgctcttgatttctcaacgaaacccaacaaaacgaggagtttctaaaacagcgattaaaatctctccagcaaccaaagcggaccccattttgaccagcgaagcatgtcaatcaacatggacctcgtcgacgtacgagtgctccggccgacaagtccccacagtagccaggtgcaggcaaagccgagcggagaggagaatggataacctcgccgacgagtgcgctaccactgccggaagacgtgaacggtaactcctagtggtgggagttcagtggggatttggaaaggaatgacgtctgggacccatgtgtcaacgatgtggaaagaagacatgtcacaggggtattttgggcaatacgaaatgtcatggcctgcacgtgggtacactagaggctaggtgtctaaaatggcatat

SEQ ID NO: 32706 - DNA, 590 bp, Oryza sativa
  unsure (1)..(590): unsure at all n locations
nnnnnnnnnnnnnnnnnnnnnnnnnnnnnnnnnnnnnnnnnnnnnnnnnnnnnngtcttttgggatggagtgaagcaatggattttcaaaactccaactccacccctgtagttcattttctaggggtagctctgctagatctactccaaaagacgaggatctgtaccgtttggcaattggcacagctctggctcgaagtaagttagagttgggagctcgaaacgggcaacggtggatacagtggtcccgggaccacctgaaaaaagggcgatcgactcactattaaaaaaaatagcgactattgaaaagaaaaaaaagcgatataatcccccttcccgactcccgacgccctaactatggctcacaggtcccacacgtgagtcgcgacgtgcgtgtatcgaatcgatcgacacaactctctctgtctctctcctcatcgccctaacccggagcccccggccataacccatagcgaggacgccgcgacgcgagcagccgatcaccgaagcagaggcacaccgccggcagtccgccaatccatgcgcgatccagagcccgggccccacgctggctccggcggaaacggggcc

SEQ ID NO: 32707 - DNA, 607 bp, Oryza sativa
  unsure (1)..(607): unsure at all n locations
gcgaattcgagctcggtacccaactgatgttgagagcaaaaggggtggatcattttttactagagagttgtgaagaaccttctgataaggagagccaagcatggaggacgtggaatactacaaattccactgtggtatcttggttgatgaaccggtggctccttctattggcaggatgatagaagctatccagaatgctgcagttgtatggaagacgctgagcaacatgtattcaggagagggaaatgtaatgatgatggttgaggctcagaacaaagtggagaatttgaagcaagagaggagaacagtcaaagagtacgctagcgagctgcaacagttatgggcaaatcttgaccactatgatcccttacaattgaaacatgaggatgacattgtgattggaaataaatggctgcagaggcgaagagtcattcatttcttgaaggggttgaacaaggagtttgaggataggagtgtcacgcccggaaattcactagtaatttccgaacttatttgtgcataaaatcctcgtccaggaatcagccgannnnnnnnnnnnnnnnnnnnnnnnnnnnnnnnnnnnnnnnnnnnnnnnnnnnnnnnnnnn

SEQ ID NO: 32708 - DNA, 687 bp, Oryza sativa
agaaatatgtcgcggaccggtcatttcatgctacttccagtccactggagggtcaatgcaatcagttgatctaacgtatggaactatggatgcatgcggtagtactgaaactgcccagttcctaccagacagcttttggcaaataatttcctgtctttttaatcaaagcaggccacttgcaaaatatataatcattttgtgttctccagtcagtcatgcacttttgttttcattcaacaagtagtcaaggggcatgcgctttggtgcacatcatttctcgacaaaacgtttggtgtgcttcgataaaaaaccttcttctaacctttttttccctctatctttataatatttggatgatcttcttcggtcatctcgacaaaaagtttgttcgaaataagattagtgactacaaaataatgcagtctgatgagcagcatgagtagtccttgctatttacattgccaattttctgcatattaaatcactataatcatcaacaaagctgtctcagtcgagtcgaggtagtcactggtttcaactcaatttaatatgatttctcctgaatttgcatacgacctctagatcaagttcaacaatacaacaacatgagcagtgttatcgccactcaatcccgacatcatatgtgttcccccaaaatttctacaagtctaaacttaatttctgagt

SEQ ID NO: 32709 - DNA, 633 bp, Oryza sativa
  unsure (1)..(633): unsure at all n locations
nnnnnnnnnnnnnnnnnnnnnnnnnnnnnnnnnnnnnnnnnnnnnnnnnnnnnnnnnnnnnnttcatctgcaaatggcccataatattatgagcctcactccggtgctttctacttatagtagaaaataatccgagccgttgatcgtatataatcgtagggttgagatctaattctactaccaccactcatagtggtagtagaaacgtggaggggtatatttgtccatagataataattcatgtaagggtattatcgtaaattattattcagtaactctaaaccttcgccattctcaagcggctgaccccatccatcgttgacttcgtcgcttgtccatctccctctccgcctccatcatctccagcgcgatcgacatctcctccccctccagcgaccaagggtggcccttctcctcttcgccaagccgctgaaggtccttgcccacggcggacgactagtcctgccatgtagctttgaccaagacaggagatcgccgggcaattggacggcggacgaaattcaacgggttccggcgaacggcggcgaggtaggaggaatgggcaactgggaatgaacgagtgtagtatggggatgtggtggacggctcggattggccaaaaaatgagctatg

SEQ ID NO: 32710 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnnnntcaggagaaatcatattaaattgagttgaaaccagtgactacctcgactcgactgagacagctttgttgatgattatagtgatttaatatgcagaaaattggcaatgtaaatagcaaggactactcatgctgctcatcagactgcattattttgtagtcactaatcttatttcgaacaaactttttgtcgagatgaccgaagaagatcatccaaatattataaagatagagggaaaaaaaggttagaagaaggttttttatcgaagcacaccaaacgttttgtcgagaaatgatgtgcaccaaagcgcatgccccttgactacttgttgaatgaaaacaaaagtgcatgactgactggagaacacaaaatgattatatattttgcaagtggcctgctttgattaaaaagacaggaaattatttgccaaaagctgtctggtaggaactgggcagtttcagtactaccgcatgcatccatagttccatacgttagatcaactgattgcattgaccctccagtggactggaagtagcaatgaaatgaccggtcgccgacatattcctgatgtggacacaagtagcacatatatacattctattctcgccggatttagtttctaagtttttcttcaacctccaacttttttattacattggaacttttttacacacacaaactt

SEQ ID NO: 32711 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnnnnncagcaaaacaatttggttggagtggtaccaacagatgcattcaccgcacttcctgaactccggacgatatcaatggacaataaccgatttcatggccgtctccctacctctctggttaatgtctcacatgtgagaatgcttcaacttggttttaattttttcagtggcactgtcccttctgagcttggaatgttaaaaaatctggaacagttcctgctctttgccactttgcttgaagctaaagaacctagagactgggaattcatcactgcattaacaaattgctctcggctgaaaatcttggaactgggagctagtaagtttggtggggtccttcctgattcactctccaatctttccacttcattacaaactctctcccttcaatacaacacaatatcaggacgcatacctaaagatattggtaatctcattggcttacaatctcttacactagatgataactctttcataggaaccctaccttcatccttgggtaggcttcaaaatctgaatcttctatcagttcctaaaaacaagattagtggatcagttccactggccatttggaaattttacaaaacttagtagtttagaacctccaaccaaacgcctttagcggtgaaataccaagcactggtgcaaacct

SEQ ID NO: 32712 - DNA, 1761 bp, Oryza sativa
  unsure (1)..(1761): unsure at all n locations
nnnnnnnnnnnnnnnnnnnnnnnnnnnnnnnnnnnnnnnnnnnnnnnnnnnnnnnnnnnnnnnnnnnaaggcaaaaaaaaaaaaaaaacagtttaggcttaacctggtgctgcgtaaccaattgtccctctgaatcccatcgagcttgttgactgttgcatcaatgagctttccttaactagaattcttgcaagtccaaagtctccaacatgggctaccatgtcagcatctaacaacacattacttgatttaatatcacaatgtacaacagattcaggtccaaggcagtgaagatagtccaatgcacaggcgacatcaagtagtatgttcactctttgatgcaaatttaagtgcctctgctctgcttgatcacaatttgtttcagggtgtagccaatcttctagactgccgttgggcatgaagtcatacacaattgctttgaaatcattccctttgttatcaatgcttgagcaaatagtaactatcttgacaagattccgatgacgcatatttcgtagtgcttcacattcggcagtgaaactcttgactgccttaggagtttcaagctttagtaccttgactgcaacagaacttgtactttcaccatgttggctatcaagttctcctttgtaaacagagccaaaggatccagaacccaacaaattggctggtgaaaaaccatctgttgcttttaccagctgcttgtaagtgatcattgggtggccttggatggatgtcatagcagggacttctttctttcttctcttatgacaggttagaagcatgtagagtaatgaaaagatcgcaagtgtcgaaacgagacagacagtaagagctatcagtagaatttgatgtttctttttctttgttgattttaaggaacactgcggaagacgtagttcaggtatgccaccgcaaatattggcattgccttggatataaatttcagaagcatttgcaaaaacaccattggttggcacttctccttgaaagctgttgaatgaaaggttcagcgagtggagcagaggcatgtcccctaaggacttgggtatctgacctgacaaattgttccctgagagatcaagtgtgtcaagacctgccaactgagtcagagcaattgggatgttgccatttaagaaattgttttgcagggagagatgctgtagaagttggcatccactaatggtgctggggatttcacccgataatttgttcgaatccgcatggaattcaacaatatttttaagttctcctatttcttttggtattgatccctccaatttattatgggacacatccaaagtttcagagagtgtgggaatgctaaatatttcagtgggaattgctcctataaagttattgtgggcaagatttagttcaaacaatctggtcatgtttccaagtgtgcttggtattgtgccactgaaggcattaccatagagctccaagttagttatttgtgtaagattaccgatggtcaattgcagataaccacttaatttgttgttgaatagaatgagacgatgcaaatttttaagcttgctgaaggaagatggaagagatcctgtcaaggagttgttaaagagaacaagggattctagattaatgagattaccaatatctctaggcaagcttcctgaaattttattggctccaatagagagatatactagtgatgaggaaagattggaaacagagtcaggaagaacaccaccaacttgcaggcacccatttctacgtgttggagattggagcaattcg

SEQ ID NO: 32713 - DNA, 8214 bp, Oryza sativa
aacaacaccgctaaaagaattaacaccaaaggtaagcatggagatgttggaagcattagctactgatgcagggatatgcccatgaaactggttgttatccatgtatacctcttggagatggggaagtgtactgaatgcatttgcaggaagcataccactcagcatgttgtactgacaccgaacacggtgagagaggagatgttccaaataggatccgggatcagtccacttaaattgttagagcttaagtgaagggaagacaatctagacaatcgacccagagatgaagggattgctccagacagcgtgttgtcagacagagcaagctccaagaggctgttgagattgcccaagcacgaagggattgttccagacagtgtattcttgttcagatagagagaggagaggctggtgagattgcacagagacgaagggatacctccagagagtgaattttctgacagtgaaagaaacgagaggccagtgagattgcccagagcaggtggaatctcacctgatagcccgttgctacctagtgacagttcttggatcgatggcagctctgccaacgatcgagggatctgtcccgacaggcgatttccttcgagatacaggtaggcaagatttttcatggaggcgccaatctggaggggaattttaccttcgagctggttgatggtgaggtccatctcgatgagacgaaagcagcctccaatggcggcggggatgctcccttggagggagttgccactcatgttcaaccgccggagcctgcttaggcggccgagctccggcggtatctcgccggagaggtggttgccgccgaggtgcagcttagcgaggaaggagaggttgcccagcgacggcgagatggtcccggacaggttgaacgatcgcagccgcagctcgaccaccctgtcccgccggccgccgcacgcgacacccgcccatgtgcagtgctggccgtggccggacgtagtgttccatgatgccagcgacgagcccccctgggacacaagagacgacctgaaggagagcagcgcgagctcgtcggcggcggcgccgcccgtgggaacggcggcagcagcggcgtcgtcgtcgctgctcgccggagggagcagcagcgaggaattgaacaggagcatgagcaacgcgagtgatctcgccatgcgtgcgtgtcgatctctgcaagagtagctatcgatgatcagcgcttacctcgttgtccgtggattgaaagcacttttcaccggtcaaagtcttgaacttttttttctaatatatttttttcttgtccattttagaaataattaacagtggtggagtgagcataaaccaattggtgaattttctggtggtggaacctgtctactcgggttaaagttctagacttagcatggatactgctttacgatggctaattattctttcagtggaacatatacccatcggcgacgagatatctgtggtgactttatgaatcaaaagatatatactggtccagtctttagaggtacttataaagaaagatagagtgtgcaagcgcctgcgtttgtcctttgtttttgcaaaaagagaaaaatgattaagaaagcatttgactttggacaaccaatgtactaatagtgatgaagaaaaccacgtatggtgtactggttaattttggaggagactgaaaatttttagagacacgcagagccaaacttcagtcgcagtcaggccgacgtggagaactcagctcgatattcatttgttggtcaccatgtgtttacttctgcaacttgtgcaatttgcaaagcgaaaggaaccctatcattcaaaagaatactgcagctgaatgctgattgctgagccgaataaatgtccttatccatgtggttgtctgttttctgggcgtctgccttccggacgcggatcgtctgactcacggtgtgactttcaagccatatccaccgtccgactcatccgacggaggatatttcctgcgtgtggttcctgactcattattatttacttgcggattctaattaaggattaatgaatctaattaaacactattacgagattagtccggtaaccaaaaatgacatgccactatgcgagttaagctatttttattttggtgattaaagaaaacaaataatcttctcatggcattagcattcagatggcattaatggcaggaagcagcgcgcggccgcgggagagacgtcggatgagtcggacagtggatatggcttgaaagtcacaccgtgactttacttggtaaaatcggacgatccgtgtccaactcagggcattagcagtgcgtcaccacatggtatcagacttggtgtgccacctagactctcaggaacatctagaaataatgttagccacaaatcccacaatgctatgtaatctcaagtggggtccacaacaataaaagaatctccttttctcagtttttcccctccctctctcctcaaccaccgacgccttttcccctcctctatcgtgcaatggcggcggtttagggtgacgacggcaggcggcccaagcggctacggcgatgtcagcgagctcgcccgatctgatgcctggtggcggtggcggcggggccaggcggagctgcgtcaccgacgccggggcccgggcagcagggctgccagatccagccttaggtgacgacggagacgggcggagcttcggcgccgacgccggggcggccaagcggctgcacggccagatccggctcggtggtggcggccctcgcctcctccctcggccggtgcctctcctcccctcccagtccatggagtgacctcgtcagcgacgacctcaagttggctgtggcgcttcgacctgccgggacggcgacgagccctgcgatgaccggtggtggcggcggcgacgagccccacgacggcgcctctcctctctccctgcttcccccggtttctccctcgacgtgggcgctcgttcctctcccacgctctgacgtatttctgacgaggaactcatgcccagttttggctccctgttcttcacttggtcacgggagtagcacatatggcatggaatctttgacgtggagggttgagaatgaatgacatatatgtgcattgtgaatggccttacatgttacaccaggcaagttgtgaaaagcaacagcgaacttaccaccagccccgcacacaatttgaacaaggctgctactgcctaagaacagacttgcctcagaccggacaccacccacgtcttccacttgttcgtgatcgacttcgcacctgctcccatataggtactcaacctggtaaacttacaacttctgttgcgaggaattcagaataactgaaattcagaattaaaaacaaggactattgaaagaagagtacttataagaacccaatacgagactaattaatattatattattaaaacaattttgaaagtaggcaccacgctcactgtggggctagaaactcccacattaatcggagaaaaagaaaagaagagtccaactagaaatacaattgaaaaataattgaaattcgaaattaaaaacaagcactattgacagaagggtgaacccaatacgagactaattaatattccaaataaaaaataaaataaaattcgaaattagaaaaaaataaaaagaagagttcgagtagaaatataatttaaaattaactaaaattcggaattaaaattaagcaatattgaaaaagattccatataaaaacccaatacgagattattaaaattcggaataaaaataaaaataattcgagaatagaaaaagaaaagaaaactaaaattcagaattaaatataagcaatattgaaataagaaataagagtacatataagaatccaatacgagattaattaaaatttgaaataaaaaaaataaaatctaaaattatacaaattaaaaagagagttcaaataggaatacaattttgaaacaacttaaattgaaaataaaaaataaaaatattaaaagaacataatatgatattagttaaaattcaaaacaaaaaataaaataaattctgaaattaggaaaagaaaaataagatttcatctagaaatacaatttgtaaataaccaattaaattggtgataaaaaaataaagactattgaaaaaaatactatgtaaaacacatggcgagattaattaagtaacagacctataaataagtagagtgctagcagttgatgggatatctaaaaactattaataaaacaccaaatagagtcttaatgatgattaaaagaaaggacgacgggtaggttgtgaagcaattggttaaggcggttggtgggacttgtagaaagtaaaaaaaaaataaaccccaataataatcatatttgatttttaaagtctcaatgacaataaaaattagaggcagtgggcgggtcgtacaggagtataatggcagagcctctgatagttggtgagacttctagaaagtaaaaaatgaattccaatgatagttatgttcgattttcacagtcccaatgacaataatgaataggcggtggacgggtcgtagagtagtacagtggcaacgtttgatgggaattctcaaaattatataaaatgaaacccaacgagacaataaactcaataaattataaggtccaatttttaaaggttcgggcttctaaaaagtaagaaaataaaccccaatgataatcatgtttgattttaaaatctcaatgacaataaagaagggagctaacaggcgagctgtagaggagtacagtgacaaagttgctgacgttttggcgaaacttcaagaaagtaaaaaaaaatgacctaaacaattattatgttcgatttttaaaataccaatgacaataaagagaagaggtagtggacaaccgtagaggagtataatggcagcggttgacgggacttctagaaattataaaaactaaacccaacaagacaatgaactctaaaaactataagatccaatttttaaaggttccaatgacataaggggtagcaattggtgtgacttttaaaaactagaaaattagaaataggaggatgataaggtttggtctttcaaaatattaacacaacgagataaccatttaataaattttaagtaaaataatattaaaatatatataattttgtatgggtgctagccgcgcaattgcgcgggccacctagctagttacatatgatttgtgatttgtttagaatatatcagtagtacataacttccatccgtgatggcctctaacaagcctagaattagcgggccgtcacaaggaagttatctcaatcgcccgattgagatatggtcacacagacatgttagataggcataaaactcaggctcgtcacggataacacctataagtgacggtctgtagtttaggcccgatttagataacattccatatctcaatcgggcacgggcccgccacggatgacacctatccgtgatggccggatgcccgattgagatatttgcttagtgacgggggctctacccgaaagaaacaaggctttaagcccgttagagataaccgatcccgttttagtgtatacagaagttcaacgccgattatagttgaacactgccaatctatggagatcaatggtcggatgagtcgtttcacaagattttgtcacacgtacgtttagcagccataaagttttgccggtaaaggcttgccgtaacctatacatctatgcgaatgcggatgaggcggcaaggggacaaccgatatcagcgtcttcctcctcacgtcgatctcgaccgtccaattcttgccgtcctcgtcgtcatcgcatgcgacgaaccagacgacgtcggggttctccgagctcacgaacgggcacaccacgtacacgcgacgcgggaggccgtcgcatggcgccagcatcgcccagagctcctcgcagtccagcacggcttccttcacccacgccatcggctcgccgccgccgtcgccgtcgccggcgttccgcagggcaagcctccagatggtcaccatgaacgccgagctggagcggtcgcacaggctgcgtatcaccggcgcgccgcagcagcagcggttgtcgatgctgacgaaccgcattgtgtcgtcgccgtcggcggcgacgatgttgcggaaatactcccatggaatcagctcgtcgtggtggtggtcgtcgtcgaagtcgctctccttgggtggaactggcttcaccggcagcggcacgtacaggagcttggggttgtcgagatccgccgccgccatgtcgcagatgaggaaggtggcgaggtcgtagttggcccagcacatgaagcggtcgccgacggggacggccacgttggtctcctgccacatctccatgccatggcggcgttcgccgccgccgtcatggtggacgatgggcaccgccgtcttgagctcccactcgcggtggccgtggccggggcggagcacgaagagctcggccgtttcgaacggcggctcgtgcgcgatctggagctgcgccactagaggcggcggcgcctcctcgccgccgtcgccgccgcggaggcgcaggatgccggtgtcctgctggtcgaacacccggcccgtggtgcggaagctgtccttgaaacggtgcttgctgacccagcagcgctcgttcatggggatgtcgcagacggggagcagcgtcagcgacggcggcttgccggcggcggccatgtagacgaagtagtcgttccaactcatccggaagaggacagagtcgccgtgagccgcgatgacgtagccatcatccccgcgatcgaagcagatgaaggagatcgctggcggcgacgcgcgggcgagggcgacgcggaggggttggccgcgggaggtgcgggactccgcggcggtgttgtcgtcggcgactacgttcgccggcgtggagcccctgaggcagccccaacgttccagcatcaccgaggccgggtcagcagtcgcggccgccgccgtcgaaccagcggattccgtcggcggcgggtgggtcacggtggttgccatgtggcggcggcggcgacctgggaagacgagatcgatggaggaggagaagcatcggaacggatgttcttctcggttgagcaacctcaggccaccgagaggccgcagcagcttgttcattggtgatggtggcgatcggaggatcggagctcagcaaggtgcgtttgccctagctaggttgatcacgacgatggcgtacgcgctaacaggtgatgtccgatcgatgggatataccatgtatatacatatacatatacatatatatatacatatacatatacatatatatacatatacatatacatatacatatatatacatatacatatatatatatatacatatatatatatatacatatataagccttgttaatagcagtctcttagcgaatattcgttgatatgagagagagaaagattagagataaaatattatatattattgctatgggtagggaagaaaacggtcggaaacgatcggaaaacagcctcaaccatttccataatcatatttttctcggaaatgaaatcgaaaacgataaactcggaaacgaaaacgatatcagaaatatcgaaaaaccggaaacggaataatactgaaggaaacatgtcggtatagatcgaaaactggtaacaaatacagaaacattaaactatagaaaacatatatttaactttacataagtatgttatatgtacaaataaattcaagctatactatataaattagaaatcaactccattttagccatgcaatcaagttagggatttgattaaatagtcaatcaatctctaaactgtaagtcaagtagagacataccctataaatatcaacgggaccatctatatatttgtcgacaaattttctcctaaaaatttgacagatgtaattatagtacaatcatagtgtaattacactgtaacttatatgtaattacactgtaacttgcatgtaactacggtgtaacttgtataagtttcacgtaattttgaattgttaaatctattataagttttgttttggtgaggaagaaagaaaatcacagcgcacacatatgtgtaaggatttgttcccacgacctctattttaccaaaataacatattacagagagatttttgaaagttacatacaagttacactatagttacagtgtaattacactacgattgtactgtaattacatctatcaaatttttggg

SEQ ID NO: 32714 - DNA, 5709 bp, Oryza sativa
  unsure (1)..(5709): unsure at all n locations
nnnnnnnnnnnnnnnnnnnnnnnnnnnnnnnnnnnnnnnnnnnnnnnnnnnnnnnnnnnnnnatgtaattacactgtaacttgcatgtaactacggtgtaacttgtataagtttcacgtaattttgaattgttaaatctattataagttttgttttggtgaggaagaaagaaaatcacagcgcacacatatgtgtaaggatttgttcccacgacctctattttaccaaaataacatattacagagagatttttgaaagttacatacaagttacactatagttacagtgtaattacactacgattgtactgtaattacatctatcaaatttttgggagaaaatttgtcgacaaatatatagcaaaatcgatatcaacatatttagaaatacggtaattaccatattataagaaacgataatttctataagaatacggtaaatatggaaatgatcggtataacagcaaaactatttccgtttccatttccatattttttaccatttacttacaaaaatcttccagaaaaaaatcttatcttaataaccatcgttatctaaaagtaacatgttagttacgttagatatactcgtcttaaaaaaaaccacggaaaaaaatccgccagcataagcgatagagaaaaacaacggaaaaaatggaaatccagaaaaaaaaatctaccgtggtggaaaaaagcaacggaataacaatggaaaaaaaaaaaagaaacccaccctcgggctgcgtgcgtgccggtaagcacacacgtcaactaggaagcccctgaaacaatatactcatcactatcttctgtataccaaacaaacagaggcagggttgaggtgtggcgattcagagtaaaatacaggtataaaacacagaacatgcatgatcagatatgctggatcaggaaatagccacgatgactttagtgatcgtgtggtagataccactgaagaagtctgatcggaagagcattccaatctgaagactagtggcaataaaacattacaagacataacatcagaattcgaggctcgcaccttcacacactggaaacaatccggagagattctgtttgatggcattcagttcgtcgatgatatctccggttggcgttctactcaatggcaaaacctgagagcaagacaacccaagtctaagcagcgaaacaatgcattcagtgattcttctacatggagaattatttgtactgttcagccagttctcagaatccaaaatgagcttcgtgtcaacaacatccgtcactctgccatgtaggcccagttcaacgtactgacggaggcccaaatcgggtctgaatgtactgtcagttggccgcttcccggttactatttccagcactagaattccatagctgtaaatatctccatgtgttgatgcaatgtgcccgacgccatactctgtttgagtaggaaatacgatttcaaatttccagtgttaaataaaaaagaacttggatgtataattatgtaaaattacgtgttaaatatcacaaataacaaggatggctggacaaatggtagatgtaaaggttggattaatttttattatataaagaaacataaataccaatgaaatttcatatttaactttaagaatctaatttacaaatacatatctaaagaaatttggtatgattgtgctatacagttaccccaagcaatcagttgctataatggctaattacttttgtacgaatcctgtttgtgttcattgtgattatagtatatcacacaacataggatatttcgtttttgtatctatattattttcaccacctccatgtgggaattagaagtagtaccaagtatttttcatggtcaatgcaagttcttgaaataaaaaattgtaataactagtacatacaaaaaaaaagtgtttcttaaatgtagaattgacaaatttactcaaatttgatccttctgataatcatttcatattgcagtgtagagcagaaaacacccataatttgatttgagtgtgtagtagctctagagtcctatataaaaaaaaatctgtacctctatgaactagctatatttagcatctgaatagatatggcaaataatcttatttttgtgcaatttaattagttcaattaattacttatattctccatcagtttcactagaggtaaaaactatttcatatagcactagagatcagaaaatgcaaaatactggaaggacttgctgacctggtgctgcatagccaattgtccctctaaatcccatcgagcttgttgactgttgtatcaatgaggtcccatcaacaagtattcttgcaagcccaaaatctccaacatgcgctaccatatcagaatctaacagcacattgcttgatttaacatcacagtgtacaacaggttcagggccatggcgggaagatagtccaatgcacaggcaacatcaagtagtatggtcactcttcgatgcagattcaagtgcctctggtctgctggatcatttgtttcagggtgtatccaatctttcagactgccgctgggcatgaagtcatacacaattgctttgaaatcgttccctctgttatcaatgctcgagcaaattgtaactatcttgacaagatttcgatgtcgcatatttcgtagtgcttcacattcggcagtgaaactcttgagtgccttaggattttcaagctttataccttcactgcaacatgatcttggatattaagctttcctttgtatactgagccaaatgatccagaacccacaaaattagtcggcgcgaaaccatctgttgcttttaccaactgcgaataagagaccaatgggtggcctttcatggaagttcttgaaggggctccctttttagttctcttgtgccaggttataagcaagtagagtgatgagaggatggccagtgctgcgaccagagaaacagaaataggtagaactgggaaatgttttctattctctagtaatggacaacatcgaggcagatgtagatcaggtattccaccacagagtttggcattgccttggattgagatcccggatgcatctgcgaaagcaccaatggttggcacttcccccataaagctgttgaaagaaaggttcaaggaatgaagcatagtaatatctgctaaggatgtgggtatctggcctgacaaattgttgcttgagagatcaagagtttcgagacctttcagctgacccaaggctgatgggatgctaccagataacaaattattttgcagataaagataccgtaagagctggcaatcaccaagcgtgttagggattttacctgataatctattcgattctgcatgaaattctactagatttttgagatgccctatttcttgtggtattgatccctccaagttattttttgatacattgatcattattgatagtgtttgaatattgaataattcactgggtattggaccactaaggttattagttgaaaggcctaatgacaacaagtttgtgaggtttgagagtgtgtatggtatccaaccactgaatttgttggtgccgagcagtaagatattaagttcagtaagatttcctatggccaatgggatcgaaccgctcaagttgttttcgtaggcgactagaatgcctaagtttctaagcctgcccaacgatgatggaagagaccctctgaaattgttgttgcagagatagagatgttgtaagccaataagattgccaatatcctttggaatgcttcctgtgatcttattcaaatcaagtgcaagaaaactaagcgaagtggaaagattggaaaacgaattaggaagaactccccccaggttattttctcccaagtccaatgtttgtaatttggagcaatttgttaggtcagaaatgaacccccaatcttcttgttctctagtttgaaacaaatttctccagagatacagtgttgtgagatttcttaaccttccaaaccccgaggtgataattccactgaacaagttgccatcaatctgaagctgtgtcagatgagaagcattagcaactgaggcagggattttgccatagaaacggttagtgcccatatctatcacctcgaggaggtgaagggttttgaatgcatttgtagggatcataccacctagcttgttttcgctgacactaaacgctcttagagacgaaaggttccagatagaattggggatcatcccacttagattgttctgtcgcaaattcatagtcaatagactgctgctgagctgccctagcgatgaaggtatagctcctgataatctgttgcagctcaaatcaaaatactgaaggctagtgagattgcccaaagcagatggaatctctcctgataaaccattggtgtgaaggtacaaattcgagagatgtttcaagctggcaccaatctcacgtgggatcatacctcgcagttggttgtggctgaggtctagcgatgtcaacttggtgcatgctccaatggccgcggggatgctcccttggatggagttaccgctcagctccagcagctgaagcctgctgagacggctgagctccggtggtatctcgccggagaggtagttgtcgctgaggtccagctccctgaggaaggacaggttgcccagcgacggcgagatgatcccggacaggttggacgagcgcagcagcagcttcaccaccctgtgtgggtgccggcggcggcggcggccgcacacaacacccacccatgtgcagtgctggccgtggccggacgtgttccaagatgccagcgacaagcccccctggtgtagcagggatgacttgaaagagagcagcgcgagttcgtcgccggcgacgccgcctgtactggtacgagcagcagcagcagcagcagcatcgtcactgctcgctgggccgatcaacagcagcagcagcaaagaagagatcatgaccgacgttggtgatctcgccatgcatgcggaggaggagtgcgctacaatgagctgagctgatcaatgcagtgtttggattcaagcactggtcctataacagtaaagggatcccaagtcccaacaaatggctcctgtcaaaaaaaataaaaagaagtcccagcaaaaggaaaagaatgaaacattactggctactccaagaaaaacggatcaagctcttctggtcaaagtcttcaatgaaaataaaagatactccagttggtgtaccttatcaaattttcaaagtttcagtcatgctgcgttctttaccgcctcttcctaactttctaattaagggagtgtctagatcacaccctaaaattttgcaccatgtcacatcgaacgtttgaacacctgtacgaagtcttaaatataatctaaaaataactaattgcacagattatgactaatttgcgagacgaatcttttaaacctaattgctccatgatttgacaatgtggtgttacggtaaacatttgttaatgatagattaattaggcttaataaatttgtctcgcggtttactaacggattctgtaattatttttttattagtgcccgaacacctaatacgacactctacgttatcgagatgacatgccaaaactttacacctatggatgtaaacaccccctaattttatatgcatatgcgtgatgaaaaatactcagtgacactacctatagctatnnnnnnnnnnnnnnnnnnnnnnnnnnnnnnnnnnnnnnnnnnnnnnnnnnnnnnnnnnnnnnnnnnnnnnnnnn

SEQ ID NO: 32715 - DNA, 3516 bp, Oryza sativa
  unsure (1)..(3516): unsure at all n locations
gcatatatttagatagtgttgggaggtaatcttccgcgcatgtaaaacggagctactcatcggcgcatgattaattaagtattagctattttttaaaaaaaattaatatgatttttttaaagtatttttttaatatttgtttgtaaaaaacatacggtttagtattttgggaagcatcgtgcgaaacgagagatgtgagttgggaaagaagaggaaataacacagccttagaatctgcgagagaatagggcatgggccctgtgggcagaaagagtgcaccggcaacgcatttatcgtgtctgcaccaattaatcttgggagtagctacatttatagcgttattttttttaccaaaaataattagcatgtatttatattataagtttctaaattacatatgtaatttagtatatttataacgtaaatccccaactataagtaggatgtaagtataatattgtattaggatgtaaatattttttatataatttatatgtaaatataatatacaccatagttttgtttccttggtttctattaaaaaaatatttttaatcaacttgaatcactgattggacagtgtgaacgagtaatattcattgtgtcagagcgcgggcataggcattgttcaatagcttggttacactttactctctccgtttttaaatattagaaattttaattggatataatatatattagtataacgattctaagatgtatcacatccaactaaaatattttatatttaaagatagaagaagtaattatttattggctaacagtagtttcgtattctggcgctgtcctgaaagaatctgggacggaatcgagtggcccaaaaaccgactgctacctgtccaaaaatatgtcgacataattctagcaaatttgcttgtgaaatctccctttggtagaagttaccatcactcatgtaatatgtttctaatctccacttaataaagtttatgagttctaaaagaaaacaatttcatacaccctcagaaatcagaacacctcacacaagacaagacgactgtcttttgcctcaaatttagcattctgagctgccaaagttactaggctttcgtaataaataattttcttcaggcaatcaaaactttatgtctaaggctgtgtttaattagatttgaacttttttcttcaacttctaatttttctataacatcaaatgtttaaatacatatatgaagtattaaatgtgaacgacaaaaacaattgcacagtttgcatataaatcgcgagacgaatttttaagcctaattacgctataatttgacaatgtgttcctacagtaaatatttgctaatgacagattagttaggcttaatagattcgtcttgcagttcacctgtggaatctataatttgttttgttattaatctatatttaatacttcaaatgtgtgttcgtatacttcaaataattttggtacacgaactaaacacaacctaataggctttctcgtgaaagtacccagaattctctaaaggaccggagtcttttcattgagcagtgaccaagaccaatagcaactaattctgggtcaatgctcacacttagggtgtgtttagttcgtgaaaagaaaatttttatgtcacatcagatgtttgattggatgttggaagaggtttttgaacacgattaaaaaaactaatttcataactcgtctggaaaccgcgagacaaatttttgagcctaattaagctgtcattaacacattgtggattactgtagcacttatggctaatcatggactaattaggctcaaaagagtcgtctcgcgattttcatacaaactgtgtaattaatttttgtttttatctatatttaatgatccaatgcatatgtcgaaagatttaatacgatgtttttgagaaaaaatttaggaactaaaccagaccttaatgccatctttcatgtaccgaacatcacaaaaactatggatcaagtgcttacattcgatgccatattgtacttgttcttttcatatgctgaagaattttctaggaagactttgggtcatgtgctcacacctggcgctatatcttgcatttacggattgatgtgcaggttcaattttccattttactcccagcaagctaacgtaccgacattcatacgtgtttgtgtctggactaaggcaaagttattttttaagtaaatcgaaatgattttctgttgacacgtttatcaaactgctaaacggtttatttataaaaaaaatatgtatagaagcttttcttaaaaaaatcaaataagtctattttttaaaaaatttataatagttattaatattatctatctatctatcctatacattaggcatttcctacgagctctcacgttaatcagaaaaatctagccattaattattaattatttagattgtattatcacaaccgaagataataaaatataacctcatgggctacctataaaacccatctgaccacggtacatttaaaacccatctgactgttatgtgtgctttatcatgtaacaaacgaatcatatctatgtatcatctaacaaaaaaatcaccatagatgagaaaaaaaatcaccatagatgagaacgagcctaccttcattacgagagaacagatgcgaactcaagcgaacggcgaacggcggcgcatgagattattttcaccaccgacgagctacctgctgctgtgaacgactcaccgttcatcctgatttgaagcgaaaagaagatacctgcaaacagtagttgtgcgtacttatacatacagcatcgattgatttgcttggcattcctaacactgctttttgaatcctcctatggcatgcaaccatcctgcggcctaattgactgaaaaaaggcacacaatgacgggctactgttgttgtcgctcctgtagaaccgagctgttacttcattggttgtattgcttattccgccgtttccaatacttttctcattaagatttaaatatatggagaaattatcggatgactttgtattacacagagtttttaaaattttgaccttatttttcttcctgcacaacatgttcttatgcgaaagaagaccggggtgaattgcaataatcatggtacccaaccatctacatgcgtgcacaaatgaatgaatattttaatagcgtaatgcaatatcgatgcacctgaatgtactctcaacacatataaagaccaacaccaaaatccctagctctctaaaattcttttaaacgtgcatctatatctgcgtaatatatagtggtgtcaagattcaaatcatggtggctagtccatgctaatattatatttatttatttatttatttattatgttgcttttgctaatatatttttttctgagtcaacgagttagtataggatgggatacaggctagatctgctggaagaggtaactcgaagatcataactgaatacctttttagttaacctcgagnnnnnnnnnnnnnnnnnnnnnnnnnnnnnnnnnnnnnnnnnnnnnnnnnnnnnnn

SEQ ID NO: 32716 - DNA, 21103 bp, Oryza sativa
gtcaccgagtaagtataggatggaatacaggctagatctgttggaaagggtaactcaaagatcataactgaataccttttaagttaacctcgaggccaatgcactatttctaattgtagtgtacctccaataattctccatatttaagtatattcatgctaaatttcttttgaaaattaccgaactacgcttccatatcattacaaccttacaaaagcattgcaaaccgatccagctcgatcttctgtgtggacttaaatatgttttaagtagtataagcaatatgttcatacggccgtaagtgaatcatttcttaattcatatgtgactaatatatatttagcatgttacttcgcatcaagtcgatgaatcataaaaggtgaagaaaataacacatataagcacaatatacttctatttcatatgacataaatattttttatattatatatactccattagtttaggtcgatgttactatgtatcaatagtagatctggtcaagaatttattttaaattaaacataccgtataggcaatcctttagttcttttattttgttttttttagtttagtctggaaggaagattctaaagttacaacttgcaacttattacttcctaatttttgaatatcaaactaaaaactatcaaattgagagtaaaatagaagaacaaacatgaagtgattaatttcagaaatattaaatcatgtaaaattttataattgttactccaataacagtacaaatcgatacttactaattatgaattttagaattacaaaataatgaaaatccataaatgagaatccaaaccaattacaattcaatagttattaaatatgattttagcattattaaatcatgaaaaagctaacattaagacccccaaagccttttctctgagaaaaacatcaagaccccaaacggagtacaaccgatattttttaatcatgaatcgtgaatcattttagacttcaaaaaatatacaattatatactaactaattatgcatatcaaattattatgtcatgaaaagttataatggaggggaaatatcctgtgtacacaagcttttttttttttacacatcgtgcacactaacaaattttatcgaaaaatctaaaaaaagcgtaattaatcatgcgccagtgatccatcacttttatgagctgcgaacagccgcatagatatctgtgataatccaggatatgcccaatcactagttatctgttgcggccaatcttttggtggctagatgttcatgttcaaaggaagaggtatcttacatctagccaaattctaactactctgcattagtgtgcagcacatgtggattcatttgcgcatcttattataccaagtgggacagcagagactgaaaacaggcaccagccaaccaattgcctcttgtcctttgaaatgagtatttttgggccctgattggaattttagcttctaaaatcctaatgattagatcaataatagaagcaatattgaatgggaggaggaagaggagggacttacatgttggtcccacagctcagtctcagtgacacgttggtcccacattcacccgactcgactgtatcaatgtttcgctgttgtgtttagttcacactgaagtttgtaagtttggttgaaattggtacgatgtgacagaaaagttgtgtgtgtatgaaaggtttgatgtgatgaaaagttagaagtttagaaaaaaaaaaactttggaactaaacaggaccatactactgcatagcctgtacaaatcaatgctagcaactaaacacgataataaaattgcctcatccatttttattttacctgttactttgaccacttttcaaggttttacaatactacctccgtcccaaaataagtgtagctgtggatagtcgtgaccaacgtttgaccgtccgtcttatttgaaaaatttgtgaaaaaattaaaaatatttagtcacacataaagtactgttcatattttatcatctaataacaataaaaatactaatcataaaaaaatttcaaataagacgaaaggtcaaatgttaaacgtaaatagtgcaaaactgtacttattttagaacggagggagtactaatcaatacattctttccaaggtggtgatttccctttttgtcctttgtaggccaaaaagtgatatttaaaatactagtcaatacatgcttttcaaggatgatatttagttgacatatgtatttagaaggtttagatcatacatcccactcaactagggtctttttcatcattttaccttaaacaagttgattgcattggtatgtgtacatgttcaaaagtgacaaataaataaaaatggaggtagtacaactaatatgtttattgttagagacacatgatatactcgttataacgatcacaaagtacaaagttgcatactacaagtgaaaaaacataatcttggatacgtttatagacataattacaacagcataacaatcagtttttgctctcagatgtccaaattacaagtgagacatacttcagtgccatgcataatccaacaagggaagggtaggaaatgaacactccagggatgagctccaaaatctgacaaggggttcaaggatgttatctattccctacaagagggtttgttttatggcattcaattccttaataatatctccagttgacattctattcgacggtatttcctgagagcaatacaatccaagcctaagcaatgaaaccaggcaatcaatcatgactttgtattcatccgtggtacgaagttcattctcaaggtgcaaagatagctgagtgtcgacaacatccatcattttaccatgtagacccagctcaacatactcacggaggctcaatccttgtatgaatttcttatctgtgggcctcttcccagttaccgtttctagcacaagaataccatagctgtaaatatctccttgagtcgataccgtatttccagcaccatactctgttcaatcaaaagtttgccaaaaagttaagatttttgtaatccaaaatttaacatagatttataatattattggcaagaaccataagttgcttccctaaaaacaaattttcttttgcatcttccttaaaagtttgtttagctgcacacgtcattaataaaagcactagagtactagacaacattaaggaagcaaatgagagaacagtaaacaatatttttaaaaaaaaaaaaatgttacagtaaacacatcaggctaacctgggggagcataaccgattgtccctctaagtcccatcgagcttgtagactgttggagcaatgagttgccttcaaaaagaatcttagcaagtccaaagtctccaacatgtgctaccatctcagcatctaaaagcacattgctcggtttgagatcacaatgtacaacaggtgttggtccatggcaatgtagataatccagcgcattagccacatcaagtagtatgccaactctctgaagaagatttaagtactttgggttgtttgtggcaggatgcaaccagccttctaaattaccactaggcatgaagtcaaacacaattgctttgaagtcattgccgctgttatcaatgcttgagcaagctgtaattatcttgacaagattccggtgtcgtagatttcgcagtgcttcacattcagctgtgaaactcttgagcgctccaggagtttggagttttagcactttgacagcaataatatctttactttgaccagattgtttatctaattctcctttatacacagaaccaaatgatcctgatcccaacaaattggtcgctgagaaactgtctgttgcccttgccagctgagagtaagagatcaaaggatggccttccatgcatgtggttgatggtatctttgattttattttcttgtaccgagccagaagcttgtagaataataaaagcaggagtaatgttgccacaagagacacaacaataggaattaccagaaatttctgccttctgtgcggtgcttgtgatgtacatctaggcaaatgtagatcaggcacgccaccacaaagtttgccattcccttgaattgaaattgcagaagcattcaaaaagacaccaagtgtaggtacttctccaacaaaatcattgaatgaaaggttgagataaccgagcatggtaaggtttgataggaatgtgggtatttgaccagacaaattgttactcgaaagatcaagagtttgtaggcctttcaattgactcaggagtgatggaagactaccagttaacatgttattttggagatagatattctggagaagttggcattcaccaagggtagtagggatttcacctgataatttatttgatctggcatctaagtttacaagatttttcagattcccgatttgttgtggtattgatccctccaagttgttattcgacaggttcaaaccttcagagagactgacaatgctgactacctctgttgggatttgaccagtaaagttattgctgtctaggcttagtcctaataagtttgtaaggtttctaaaaatgcttggtatgctaccgctaaaagcatttgatctgagttgtaaaatatatagttctgttaggtttcctaatgtcaatggaattggcccaccaattttgttgttccctatggagagaagatgcagattttgaagcctaccaatggaggagggaagatgccctgtgaaattgttgttatcgagattaaatgcttgcagattgatgaggttatcaatatcttcaggtatgcttcccgaaattttgtttgtgtcaaggaaaagatttgtcagagaggacaaattggaaagtgaatcaggaagaactcctccaaagctgcaactagccaagtacaacacgctaaactgggaacaatttgttaatgcggttatgaatttccaatcgttggggcttctagcttcaagaaatgtttctgaaagctgtagaattttgagatttcttaagcctccaatctctggaggaacgataccgcttaagaagttagcaccaagctgaaccaaccacagatgggaagcattggcaatcgacgtagggatactaccatgaaacttgttgtggtccattcctataagctggagactgggaaaattactgaatgcatttggaggaatggttccacttaacgaattttgctggacagtgaacgccattagtgctgacatgttgttccaaatagaactgggtatcagcccagttaaattgttagagcttaatgtgagcctagataaaccagacatcttgcctaaggatgaagggatgcaccagatagcctgttgtaatcgagaccaagaatccagaggttggtgagattgcccaaagcgggtggtatctcaccagagaatctattgactctaagattcagctcttcgagcaaaggcaaatcggccaatgaccgagggatctcaccagagaaaccatttttctcgacgttcaaaagcacaagatttttcagactggctcctatctcggtagggaactcgccttgaaattggttatcgcttaggtggagcaaggagagattggtacatcctaccagagcaacaggaatgttaccttggagagaatttgtgctcaggttaagcagccgcagcctgctgaggcgaccaagctctggaggtatcgacccaactaggcggtttcatgaagatcaagaatcttgagaaaggacaggttgcccaagaatggtgagaggagcccagagagtctagaagatcccaatctcagtgagataaccctctcagggtgccgacggctgcaaacgactcctggccagctgcagtagtggattgacttgttccatgatgccaacgagccatcggatgcgaacatcgacttgaaggagaggagagcgagctcgtcggcagtggcattgctgctgctccctggagacaccagagcatcagaacagaagagaaacaatgagaagaaaaacaatatgattgttcttgccatgaccatgaggaagtgactataagcacaggcctatgttctctaaatgacttacatttttcatatcgttgcatatgtgtatatttatgtctgaaactctgacaaattaggaagctgtcgctttgtcagtcattggttttatttttctagacaacaagtcactggttgtctcgcaccagtctttggtcaatgttcttttcatgaagatgcatccaagaactacactcttaacattcatgggaaaccttccaagataaattgtcaagtgggaaggcgatacagacactgaaaagcagccaataattcggcgctgcatcacttcagcagtactcttttgaatgataggattcatcctttcgctttccaactgcacaagcacagatctgcaagttgcatatatcatatgccgatcaacaaggaaaatttcgacagcaactagctgcgctcttcaccaatttcacacgactgtccccaaattatttcatatccaatcaatcaactaatcaagaacacctcattatacccagtattcattactcaatatgactccccctttatcctcaagttcttagcagcccaaactttatctgggttgcaaaagttgcaaaaacatttttttaaaataaaaaggttctttttcaggaaaattttgagccaattttttttctcccccctttgcttttggtctacgcccatggtatcaagaaaagcgggagttttttcattgcagcagtgaccaaatagtctacagtaaagttgcggaaagcgaagcgaagaagactaaccctcgatgccatctgatcttcctccggtggtttgcccgtcgccaagaaccacgaaacccgtcggctctttgccgcctgctcgctcaagccgggctccagggcatcgcctgcattcctatcgccggagagggcctccacctccgccgcctcctacgggtccgccgcatcggcgtccgagaggaagtattcggattggtttttcggactagccggagggggaatacggtggacggaccgaggaagaaggaacttaggccctattaagttcccaaaataaaaaatttcatgatacacgtgcatacattatttaaacataggaaaaacaattacacacgtaacatctaaactagtatggtggcccgcgtaaattgcgcggctagtatcattatattttctctcatgtaatagcatatatgttttctcaatgtattattcaaatatattaaaatggcaatataattttaaattttgtactaactttacgaaactaatatgtaatatttatattgtattatatatacgtgctagttattaattatttttaatatcaaattttagttatttgtaaattatattcctatatttactctagactcgtctttcaatatttcctttttttaatttcaaatttccgttatatgtaaattgtatttctatatagactctaggctcttcttccatttgtaaattatatttttatacggactctaaactctactttaattttattatgtttattctaaattttaggttaattttaaatttttatatagactctatactctacttctaatatttcttattttttaattccgaatttttaatttttcttaattgtatttctatatggactctatactttacttctaatattccttatttttaattgtatttttctaatcatctggcctcacaacaaaaacaggaagttctttactagatcaatgtataggatcttgtcttttgggagggtcagggatactgatatgtgggaaatctggaagtgcaatctgcctcttaaaatcaaacattttctttacctagtatgtagagggagactgccttgtgctgatcagcttgttaaaagaaagtggaggggtactaagttctgtaaactgtgtcttaatactgaaacaactaatcatatttttgtgtggttgtcccttggctgtttttgtttggtgtgtaattagagaggccctgcacctctcctctcatccagccaatttctgggactgtttgaggctttgggtgaacaaaaaagattcgaggctttgggttttctttgtgggctgtgtttgttggtccttgtggattattaggaatggttgggtttttgagaacgttttattgtcctcacctccacaggcagtttataaaactttatcttttgtatagaaatggtctattctgctaggagaagaggaacgagccacgctgagaagctggtgtgagaagatcttggaaaagctgaatcatctgagacctcgtgctttacctgtgtccctgagtctgtagtgtaaggaagtgtgggggttctggttgtattttgttggatggatgctataggctccttaagtgtttgctcttgtaagctggcggtcccagcaaactttatcttttacagttttccctttatgtaaaaactcagttatgtttgggctttcttcaaaagccgggtcataatgatctggtatcaaaaaaaatactctacttctaatattccttatttttaattccaaatttctattattttctaattgtatttctatatggactctacactctacttctaatattccttatttttaattccaaatttctattatttcctaattgtatttctatttggactctacactctacatgtaatattccttatttttaattccgaatttcagttatttcctaattgtatttctatatggactctatactctacctctaatattccttatttttaattccgaatttcagttatttcctaattgtatttctatatggactctagtctcctcttctaatatttcttatttttaatttctaaatttcaactatttctaaattgtatttctatatgtactctagtctcctcttctaatatttcttatttttttaattccgaatttcagctatttctaaattgtatttctatatggactctgctttttctttttctccgattaatgtgagaatttctaggccgtgagagcgaacgtggaggctcctttttctattcctttaataatataatagattgcaagacgaatctgttaaacctaattacgccatgatttgacaatgtggtactacagtaaacatttgttaatgatggattaattaggcttaataaattcgtctcgcagtttcctagcggaatctgtaatttattttgttattagactatgtttaacattttaaatgtgtgtccgtatatctgatgtgacaatcaaacccaaaatttttttcccaactaacgaggccttagtacacgttaaatttcgatgcctgcaatacgacatccattaaaaatgagatataactgctgatagtttcaaaattttaacccatcaaagatgactatgctacgtatattccccaacattgtagtgaaatacatgcgcctttacctctacctctactttcacctcagacacgagaaaacaacattagcacaagaggtggacggtggcaacctcctccatcccccttaaccgtggtatcttatagcccttgcgcggtggctagacaccttcaaatttgtacgtgccagcctagtgcgatgatgaaacaatgtgccagcaaggcgcagtgaccagtgagagaggcaagacgaggagcaaatggtagcgacttccccaaagtagacgaccttctccaacttttgccgctgtcatgtccttgatccctggtgtggtggcagaggtgggaggctaggacgataggaagggcaccgaaattgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcaatacaaaagggaaacggaagccaggatttggaccaaacatcacaggcgcgacttgggaactaggccgaaaccctaaaactcttcatagccggcttgctcctggaagaactcctcatcagcaggatccgcttcatcttcttcagcaactgggggcaattatttatatagagcaagagtgagtacggggagtactcagcaagccatgggaaataagtgtttaatgcgggcttcaaggaaaggctgatgtttttgcaattaattttatttgaactattttctgaaacgactaagtgagtgcttctcaaacgacacggatgagacagtgcatctcgtccggtcggagtatgtgcaatgtatcagtctttagaatttaaacaaggttggcacccggccaacagctttttcaacggccacccgggccaacaacttttcaaacggccacccgggcccagctgatcccatcagctgcagatttttcaaacgccgaaccccttttcacacagcaatttcacaagcagtagtcaaaccaaactacgctaggaatcacctcacatccgcccatgaccgtggacacggctgttcgaacagtttgttaacctctgcagagggggtacactttacccacacgacattactaacccgggtcacctagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggttcccctgataagctagttactcagccaggggtgtcccattccacccatgtggtcgtacttgtcttatgtttggatgaaattccaaggaatcggtccttaagtgcgagagcgggaaaccgtacacccggtacatttcccggtccgcggtttttggaaattcatttagttcgcaagcaccgacccaggtgtcgggttttccaagtctttttaaaactccagttttacccaagttgttactcagattttaagtttgaaggcggccgtcgatattggcacagggtgcacgaatatcgaggcgcaactagatggttacaaggggacatggtatagaaattatcaatggaaggatcaatgcaacaagttaggtaggcctgccaatctgtcttgcagacggaacaacagattaagtgcgatcctatcaatgcataatatttttcaagcaacataattagatttcaaatataggctcaagatgttcaaaggtggcttgccttgctcgagatctggagcttgatcctcgaaatcctcgcactgtgggtcttcgggctccgaaactatacgcgaaacgggacaactcaacaaagggcgaaaataaagccctattaatgacctctaagcgtgccattaaatagatctcgagatttgagaaattttggaagttgaacggagtcaaacggatttacggttgggatgatattgaatttctaagattattggatttttggtctaaaggaaaaggatttaattaaatcccccttttttttggaaaagaaaagaaaagaaaaaggaagagggagggaatatagacttttcctcgggcggctaaggcgcggcccaagggaattggagcggctcggccgagcttaacgggccggccggcctaagaaggcggcccagagcggcccaagacgcgcgcgcgcggagggaggagagagagagccggtggaccaggctcaccacgcgcggtcccgggtgggacccgcttgtcagcggctcggctcaccatgcggagggagtacgtggctcatgcgcgcgggcgggggagggacgcggcgcacgcgcgcggttcgcggtggacgcgggtgcggcgggcccacgcgcagcctcacggctcgcggtggaacgcgcgcacggggagggactgaccggggtcggctcggcccggtctaggctgagctggcaccgacgtggcgcctacgtggctgccacgcgggccggcgggaggtagacgacgacccggccgcgaatggacggcgggcggcggcggcgagcggcggagcgaaccacggcgatacgggcaaaagcgagcacaccgggcggttgctcgagacgaggggagacgagccaacggctcggattcgccagagggagttcgacggcggcgaatcacggcggcgacaaccggcggggagggaagagggaaacgccgacgaggtcacgagggaccgattcccggcggtgagagcatctacgcggcttcgggaactcgatgccagcgtcggattggacggagctacgccgagcgaggctggcgacgtgcgggtgctacagagctcgagcagcgacggcggcgaggacacggcgagcgacggcaacggtcggggcggcgccggctaactacggggagtctactcgggctaccaccgaaagctagggggaggagatggagcgaggaggaagaacggagggaggcatcaccgagaagaggaggggcgctgtgacgagaggccgacggcgcgggagtaatctctccggcctcgggccagggaagaggaagaagtggcgcggccgaagtccccttccgcgtcctcgaacgcaccgggtctcccggcgctcggcgaaggacggcggaggcgagacagagcacgggggcggcggcaatggcgcggagacgaatggatggggggggaaagggggaggctggggtttaaagggggcggcaatgtcggtttgggaaccgacttgcgcggtcaagggcgcgagctggcgctcggcggtcgcggccaaagcggcgacagggaggatgacggcggcgaggaggaaaaggggaaaaggagggggagaaagggggcttgtccccttgccgattcgggaaaaaggaggaggggagcgggggcgacgcggcagagggaggaggggcgctgcctccgtcccttggcggcttgcacgcggagtggcgggggccgggcggtgacgacggcgatgacggcgggcggtgtggagcggagcggcgacacggacgacaggcgcggcaggcgctgacgacggcggcgaccagacggtcggccacgcgcgcgcggctcgcaacgggaggcgcggctgggcagcggggccgggcggcaaccacgcgggcgcgcgcacgcgaacacggcgcgcgggggccggctttgcgagcggggagctcgccagggatggggagaaggagagcgaggggagggggcgctcggcgcgggcgactcccgcgcacgcgcgcgggcggaccggaggaggaggagcacttggcgcggctcttcgcgcatgcgcgcgcggcgcgcgggcgaggcggagcggagctgagcgggggagaggaacggagcgcgccggggaggagagagggcgagagagagagagagagggagtgcccgggagagggagagagagagggccgggggagagggggagatgggccgggaggaaatcggcccatcgaccccgggaggcaaatagacttttgcggaggaatttgatttggaagaatttggattcggaattggactcgacgatagatcggggattgagatcttgagatggcacggacactagacgacaagcaaagaaacaaatttcgcaattagggtttttaagagataattttcccgctaggcgccacgacggaacgggcgctacagaaatcctctcttttggtgttgtgggcttactgagctccttcccgatgctcgtcgccattggaatcctcccaagggataccgccgttcagagagaaagagagagggatttggcaagcttgagctcaaacaaccaatgtgtgctcgccgctgcccccttctcctcgagtcgatatattggtgggtgacaaaggacaacgccgatattgttgggtagaggatgcattcatgcacctccttccctatggcactacatacactggtgcacagcgcagctccttcccaccatgcgttggtgtgctttagacatagcgaaaattttaagggggtgtaagttagatagttagacttatctttttctttgagtaaagtgcacgaacggtacttaaacttgtaatgatgtgccatctacgtccctaaaatctcagaatgcatatctaaatcttagaacttatagagatgtgtcatctaggtctctaaaatcttagaatgcatatccaaatcttagagcttgtcatagtgtgtcatctaggtcccaaatcaccacagcctcttcagaatcctacgtggtgctgatttggcgtgccacactgacatttaaaagtttcccttttcttttttcttttttttgttctccttcttctcttttttttccctttcttctcctttttccgtgacccgagcaaaagaaaggaaaaaagaagaaaataaagaaaaagaaaagaaggaaaaaaaagaagaaaatggcacatcacgtccacgtggcatgccacatcagcaccacgtatgatactaaagaggttgtgtcgacttgagacctaaatgatactaatgatactgttagacaagttctatgacttataatccattttaagagtttgacgacttagacaacacaaccctataaatttaatgagtgtctatgtactttacttttttattttttttcttctatcacaaatttaccgagccaagccgagtcaaacttgtccgttccaatgtcactaaaatgtggaccaacgtgtaagttccttcttcctccccacatccccggctacggccggaaaaaaaaaaccaaccaaaatactcacggacgccggcggccggcgtgccgactagtagggggcggcggatgtggagcccctccggcgaccggaaacgaaggcgacgtcttggcgccgtccggctagagctctcaggccgcagcgggcgggctggcctctctgccgccgccgcctcccagccagcgctgatgagtggcctggtttcgtgcaattaattattggcgacgtacggacaggaccaagaaatctcgcatcgagagtgacaagtgagaacatcacttgacccctagtctacttcatttcaaatcccgcaacttgatgctctagactactggtcactaccgcatcgaagacctagatgggcatcgatttcaagtcaatgtcgtcccatgtgcacaaatcagcttctggtggtggtagcattctagctggaaagaagatggattctttttccctagtggatgcatgcattcataccataggtcagctgagcatatccaattgacagtggccttcttcacacgttttctttttagatatttattcgggcttttgcttggatagaaactatagccaaaccaattatgtagatatgcctagtatacatatgcattctaaccttacttcctggagagacattgcgagaaggatagtcttcctcatggcaggagcaagagcaacagcattgtcctgcttctcactgttgttgttctgttcctatgccctggtctctccagggagcagcgatgccactgttgtcgatgagctcgcgctcctctccttcaagtccatgctgtcaggcccatccgatggtttgctcgcgtcatggaacacctcaatccactactgcgattggacaggggttgtctgcagtggccgtcggcaacctgaaagggttgtcgcgctgctgatgaactcctccagcctttcgggccgcatctcgccgttcttgggtaacctgtcctttctcaacaggttggaccttcacggcaacggatttattgggcagataccatcggagctcggccatctcagcaggcttcgggtgctgaatctgagcacaaattctctggatggaagcattcctgtggctctgggaaggtgcaccaatctcacggtgcttgacctcagcagtaacaaactccgagataagataccgactgaggtaggagccttggaaaatcttgttgatctgagacttcacaagaatggtttgtcaggagagatccctttgcacatatcaaatttgctatcggtggagtacctgtatttgagagataactggttctctggtgagataccacctgctctgggcaatctcaccaagctgcggtatcttgaccttgcgagcaacaagctatcaggatctattccttcatctctgggtcagttgtctagcttatctttgttcaacttaggccataacaacttaagtggattgatccccaattctatttggaacatctcctctctgacagtgctctctgtccaagtaaatatgctgagtggaacaataccgccaaatgcgttcgatagtctgcctcgtctccagagcatttcaatggataccaacaagtttgaaggctatatccctgcatcacttgctaatgcttccaatctgtcctttgttcaactcagtggtaactctttacgcggtattgttcctcccaagattggaaggttaagcaatatcaattggctgcagctttcgaacaatttgcttcaagctaaggagacgaaagattggaacttcatatcggcattgacaaattgctcccagttagaaatgttggacttgggtgctaacaagtttagtggagttcttcctgattcactctccaaccattccagttcactatggtttctctccctttcagtcaatgagattacagggagcatacccaaagatataggtaacctcatcagtttacaacagattgatctcagtaataactatttcataggaactcttccatcttccttgagtaggctcaacaaattgcaagctctctctgtttatagcaacaatatcagtggattagtcccatcaaccattggaaatcttacagaaatgaattatttggacctcgactccaatgcttttagtggcagtataccaagcacactcggaaacatgacaaacttgttggcactaggcctttccgacaataacttcataggccgaattccaatttgaatacttagcatccctacgctctccgatattttggagctatccagtaataacttggagggaccaataccacaagaaattgggaatcttaaaaatcttgtggagttccatgcatattccaacagattatcaggtgaaatccctagcacccttggtgaatgcaaacttctccggaatctctatctccaaaacaatgatttaactggtagcattccctgactcctgagtcaattgaaaggtctagaaaatcttgacctctcaagcaacaatttatccggtcaggttcccaagttctttggaaacattaccattctctattatctaaatctttcattcaatagctttgttggagatattccaaactttggtgtttttgcaaatgctactgccatatcaatccaaggcaatgacaaactttgtggtggcatacctgatctacatttgcctccatgttcttcagaatcgggaaagagaagacataaatttccactgatccctgttgttgtttctctcgctgcaacgattttcatcctttcattgatctctgcatttctgttctggcgcaaacctatgagcaaacttccttcagcaacatctatgcaaggttacccattgatctcttaccaacaaatagtgagagcaacagatgatttctcgacaaccaatttgttgggttctggaacatttgggactgtgttcaaaggaaatataagtgctcaagatggtgaaaatacaagtcttgttgctataaaggtcctaaaacttcaaactcctggggcactcaagagtttctcagccgaatgcgaagcactgcgagacttacggcaccgaaatctcgtgaagataattacagtctgctcaagtattgataacagagggaatgacttcaaagcaattgtacttgatttcatgtctaatggtagtttagaaggctggctgcatcctgacaaaaatgaccaaacagaccagaggtacttaagtctccttgagagagtttgtgtactgcttgatgtggcttatgggttggattaccttcactgccatggcccaacacctgttgtgcattgtgatcttaagtcaagtaatgtgctcttggatgctgatatggtagctcatgttggagactttggcctcgcaaaaattcttgttgagggaagctcaatgttccaacagtcaacaagctcaatgggatttagagggacaattggttatgctgccccaggttagtgttatatgtttccttacctgtttgcaccccaatcaccttttcaaaattcagaagaaaatgtttaatttgatgcaaccttttgttttccgatttctagcttatcctacatttctgttctgtatttccaaatgtttgattcaacagagtatggtgctggaaatatggtatcaacaaatggagatatctacagctatggaattctagtgttggaaacagttaccgggaagaagcctgctggtagtgaattcagacaaggattaagccttcgcgaatacgtgaagtctggtctagaagacgaagtgatggaaattgttgacatgcgtctatgtatggaccttacgaacggcattccaactgggaatgatgccacatacaaaagaaaggttgaatgcatcgttttacttcttaaacttggaatgtcctgctctcaggaattaccctcaagcagatcgtcaaccggagatattgtgaaggagcttctggccatcaaagaatctctctcaggcgacgagcacaagatgtgatgatggaagatatatatgccaaatgtcatgctgcgatgattcatgtatcgatgatatatatgctgttggatgacattaggctcctttctcaagtgttccatgaaatgttttgaacatcgaatgatcactgaaattgtatctttctgctaatctgtgaacctgagagaattatttcctgtattttagtcagagctcaatactagttcataagcctccactgcatgctgaacctctgtagtatatcaagtatgcagtagcagtctattagcttcagctataatcctgtgccgtattatcgtttaccagtaacgcgtctagcattgtcgtttcttcagtttcgtcagagtctgtttcggcgtctgtttctctgtttcttttttcctataagccgagtcttccgggtcgtgcgtcgtgtgtgagtcatccgggtttcagcgtcgtggtcaagtcgtcgtggatgatggcgtaatggtgtcagtttgagtttgtacatattggctatatatatgagcatcagaaaacgtcgcatgttggttcgtggcaccaaaatcctgttcgtgttcatcgttaccattctcagagaatttgcgtgagagagagagatagtgaggatccacaatcttgggctcgggcgctcggctatcatttcgtatcatagccatgtccgctcccaccagcggcgcgccacgcactcccggcgaactggccgccggctctcgccgtctccgccacggccgcgcgggcgacagttcgttgttgctatttcttaatgatattactagaaatataattcccaacaatagcgcagaaatacttctagtatattatggttacagagttcatccgcaagtgtatggatataccattgtagcatttcactcgagagtattccaagggtatcgtatttgtttaatcccataaaaagattataatagagagaatcatactaataatttatatatgacttgtaataatccaaagtctaagcatgggttaatataattcagagggtagagtgacactaagcagaagcatttatactctcattcataattatctaaactaagtggaaagaacatagaaagatactattcctatacttctagtatacatacatattatacatacatcctaggcatattattacttagctaatatcctctttccgataccctcttggtgcttcgagaagtcacccctgattgccgagtttcttacgacaatccgtcatgactgtccaaccgggctaaatacggagtaccctccccaggaaattaacttaggactatatacacgtgcggaggaatacccgtactgagctgtcaccatcagcggcccacctcgcttccgcagcatataaccccaaataatgatatccagtaatctaaacaccacgcttaaattaccaaatactactctaatatcatcgtcatgacatagagtcatcgtataaacgatcattatacccacaccattgcatctcccagataagctagcatcataataaatgtaacttggacatataataaaattggtattcatatactcggaaagtaatacaataccaaagtagtataaagaagaatattctaaataaagtacaagtcttacaaaagaaagaaaagctactagagccacacccgaattcttccgaagactttgaggactgaagattatattctatttctattccactatactctagagactatactaaacttgagagatgaaacgagcttcttgcttaagatgtgtggagaaagtgagaaggtgaagcccttttatagcctcccaatgatggttgtaacagttggaatgatcggaaataccctccaaccgtcattaggatgcaatcccagacgtccacgccgaaccttggtttcaacagtggagatgggggttcggctgaaccatgggctggtccaatctagcccattttcggctggcggcctcctggacttcttctcttcgcggacttgtgaatcttggcccaattgatcgtgtcatttctgagttcttggcccattcgttgataagtttaattctcgacattgtccgattgattgatcgcctgttttgatgtcgattcttctccatcttatatttattctctgcgagaggttagtaatcctagtgctagtgaaatatttattatcaaacataaatatgcattgcaagcatgactagttctcctttattttggtactattgacaatcgaaactgatcgttaacgaccgtcaacaaaatcccccaagcttgaacctttgctcgtcccgagtaaaggacgaaaggaaacaaagtcctgattgttgatcaggagttgctactatgatgtatatctcaaatgtacaggtgcaacgtatgtgtactctttctcaaatcaaataatttttggcacggtgttttacccttacccctgattttgtcacgaccggaaataaccc

SEQ ID NO: 32717 - DNA, 1241 bp, Oryza sativa
taagcaagttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacgaacggaagacgtgacatagtttccaacccatcctagccatagacaagagtaccgacccaaccccacctacggccggaacccccgggacaggcaggcaggattgagccccctagcagcaggacacccgccctgtgccatgacatctcgactaccgggccgcagctcgtgtagccttcatttgtcctagagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaacaatccaaccattccatagtgtccaagtgatatgaatattaccacagtctagagttataaaaccacctaatgttgcctaattaatcagcgaagcatctacctaaaatcatactagtgataccacgagtagagtgtccactagttggggtttcgtttattctagggtgagcaaagaaataataacaataacaataataaggtcataacaaaggtaaataggcatggctaattaaaacaatgataacgcgggaatttaaataaagcgataatgcattaatttaaatcaaattaattttataaactgggattcaatatgctcaaggatgatgtgacttgccttgctcgctttcccaaacaccggcttcaacttccacgaagagcggatcttccgaagctgcaacgtctacacgaccaacggaaaagaaaaggcttttactctaacaaactccatataacaagcaggaacaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaattggatttattgcgtca

SEQ ID NO: 32718 - DNA, 12075 bp, Oryza sativa
cccaaagtctttccctcatccctcctttttccccttctctctcgggcctcctctcccctcggcccagctccctccccctcccttcctttctcaggccgcccctccctcctctccttcccggcccactcccttcctctcccctcccacctgggccgtgtcccggcccagccgagcctccccaggccgcgccgcacgcgcccgtaacgcgcgcgcccacgcgcgctgaccacgcgccccgcgtgggtcccaccgcccggtcgtcgtcctcctcccgcccagcttctctctctctctcccgtgaaccctagtttcttcctccctcaaatccacgcgaatcaatgccattctttccaaattgattggggggaattaatccccattccttcctttttgatttcccccgttttcccccttgaatggcgcccccaatcgtcgggaacggccgcgcctttcccggccaccttccatggccgccggccgccttttccgccgccgttcccaccactcccgtgcccggctccctctcctcccctataaaatggaaccccctccatgcgttctctcgttttggccccttcccgagctcccccgtggccgcatcacctctccccgccttctccttctctctctccggcgccggccagcatccagccgcctttcctcctcgcccgagcaccatccggtcgcgccgtcgccgcctcggcctcgcagccgcctcctctcccccggtcagccctccgtttcgcggggaaatcaccggagacgtgtcctcgccggcaaaacagtggcgttgccgccactgtactgcctccagccacctctgccgcgtcccctgtgcgccggccgacgtcgccaccacctctcccggcaccggaacgccatcctcttccccggccaagccacggcgtcgcccgtatttcgccggaacgccgtcgcccgcgccgtctctccctcggcctcgtcggcacccactccggccgccccttccgccgtgccagtgcgccggccgacgtcgccatctccacctccggcctcgcagcggcaaggttgccctcggcctcgcctccccttcgaccgaaccccgccggtgttcgtcgtcgtcgtcatcgttcctcctcgccggctcgtcgtctcgcggcgccgcctccgtcgtcggcatcgcagcggcgtgttccacgccgtcctcgtctccgtgcagccattgccggctgccctcgttgcctcctcgccggccccggtcgtcatcgttgtcgtcctctcgtcgttcccggtcgtcgtggcattcgtccctccgtcaagccgttctcgtccgtcgtccgcgtctgtcaagtgtgccgctgcagccccgtcgtcgtcttcgtcctcgcctccgcgtcgtcaagccctgcgccggccgtgtctcgccttcgtccaaggatcgccgccgaagtcgtcccctcgccgttcgtctccgtcgttcccgaccgcctccgccgcgcccgttcgtcgttgtcgttcccacgcctcgtcgcgtggtggtaaggatccctctccctcgctgccccgtcctcgtcctttcggtgtcgcctgtgcctgttgtgcggttgtcggccccggtacccgtgtatcggtgtcggtagtcgttcgcttgtgcgtgtggtgaccgtgttagtgtgcccgctcggtagccgcgtggtttccacgtgagcagcccgggtggtgtctagtggagtccgtttgtcggccactcgcctcggttgacacacgggatccgcttccgtcgacccgtggaccgtctctgtgtactcggtccaccgtggtcccttaggttgacatgtggggtccgcatgtcaacagtgcagccttcctgtcttttccaggctagcgcttacacatgttttatagttgcaaaacctaattacaataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggatctcgaagcgtggtttgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgtttattattaccttgttcaccctaggaaaataaaaccccaactagtgggtactctattcatggttccactagtatgaatttaggtagatgcttcgctgaataattaggcaacattaggtggttttataactttagactttggggatgctcatatcatttggacactgtggaatggttggcttgtgatggaattgaacacacacctccccccccctctattcaaaactcccaaaatggttttaggctgggctcgaggtacagggttttgctagtagcacctcggccactgtaaggaccggtcttcgggcctctgttgcaaagcactaccgtactaaccacatgtctaatgggtaaggcttaactcggtgctcagtttagtcctgaacaaaaggacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacacgggtggtctcacccctttgtgtgtggcgcacccggtctagatcttgttgcttggggctcaatcctggcctgcctgtcccgggataccggccgtaggcagggttgggtcggtacttctgttcacggctaggatgggtgaagggttatgtcatatgtttacgacgggttccaaggccatggaatgcggagtaaggatgtgtcttgtgggtaaagatgtacacctctgatcagagtaaatctattcgaatagccgagccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttacggcaaaacctaacccctattattatccccttgtacccccttgcattaatcatgcatcttccggtgtggcttgctgagtactgtggttgtactcattcttgctctatctttcccccccccagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagagttcgggaaaaggcaattttctcggtcgcgacaccgcctcccgccggccgcgccgccgtggccgccttcgggcgcaccgagcggctgccgcgtggggcccggccgtcagccgcccgcgccctcgggtgcggctgacgcgtggggcccacggcgccggtcggtgtgagccgcgtgcacccggtccaccgtggaccatgaggctgccgcgtgggccccactcccatggacccggtccgcgcgcccctcccctcggctgacgcaataaattcaattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttcctacttgttatatggagtttattagagtaaaagccttttcttttccgttggtcgtgtagacactgcagcttcggaggatccgctcttcgtggaagttgaagccggcgtttaggaaagcgagcaaggcaagtcacatcattctttgaacatattggatcccattttgtgaaattactttgatttaaattattgcattatcgctttatttaaattcccgcgttatcactgttttatttagccgtgcctatttacctttgttatgaccttattattgttattgttattatttctttgttcaccctagaataaacaaaaccccaactagtggacactctacctgtggtatcactagtatgattttaggtagatgcttcgctgattaattaggcaacattaggtggttttataactctagactgtggtaatattcatatcacttggatactatggaattgttggattgttgcggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggacgaagtcgggggttcgatggacatctctaggacaaatgaaggctactcgagctgcggcccggtagtcgagatgtcatggcacagggcgggtgtcctgctgctaggggctcagtcctgcctacctgtcccaagggttccggccgtaggtggggttgggtcggtactcttgtctatggctaggatgggttggaaactatgtcacgtcttccgttcgtataccgtggtggtatatggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggctcgtgtgggttcacggccttgattaataatattgtatagctctaggatcgtgttcacaaaatagctttgagcaactaagtgtcttttaatgctatttactgcaactcctaacccctatactataactccgttgtactcctttacatttatgctgcacttgtgggtgtgtcttgttgagtacggtggttgtactcagtcttgctcaattttttcccaaacccagaagaggagcccctcgaagatgaaggctttggtgtctagctcgtgcctgccgtcaagcgcctgtggtcgtcgccatagtcttccgctgtttttcgttgtcttcgtgtgtgctgggccttcgttgcccatgtaataattaactatttacgcttccgcttgttaaactctgagttgtatcaacttttggtgtaccttgcctcctgggacaaggaataatacacgcacgtaaggaacgcccgttgggttatttccggtcgtgacaagttggtatcagagcccccttgaccctaggacgagccgtagatcccaagccttagtgatattttcgaaataaaaatcctttcttacttgtgaaaatcctctagtctttctctgtcctgctgcttcatttatcgccaaaatctaatcttgaaaatgttgcttttctattttgtttttgtttgtagatggccggcagcatcaaccgtcgtggtctggacttgactggcttcgttttggagctgcggggcatgtgcgttgtcttggggtatccacatggagtggactaccagggcaagccgctcccggagcaggagggtgacgatgcagagccccacgctgcttgggaggtcactgcagtgatcctctctggctcacccgagaggacttcgttggcagtcaccgcgggtggagattccttctccgccgcttgccagaatgccgcactcctcgccatcggcactcttcagcagcgctacccggacgagttgcagcactcgccctaccgctaccaccctcgccgcggaggagcccgcgactacgccaccttcggggatgctagctcggaggatgacgctaccatcatgcacctggcgcgcatggtggaggcgtacgacgcggcccgtatcgacttccaccagatggtgcgccgtgggatggtcgagaacaacatgaagatcctggagctgcgtcaggagaatctgcagctgaaaaaggatctggacgcgctggaggcgcagctctgtcagctcaggatcgcccagggagaggtctgccgtcccaagcgccgccgcgtctgccgtagccagaagatcaccgcccgcaagagtacctccaggcccgagcttattcgtcagtccctagcgtggacctgcttcgtggagacccctcgtgccgagcccgtgctcgtggttcctcaggagggggaagcctccggcgttggcagcacggaggatgcgctgctgctcaccttccgccctggcccgtcgcagaagtagacgagcagttagtaggcttgcgcgtgtgttctttctcgtttgtcttcctgttggagtcgttcggggcatggttatgccggtgtgtggtataactatgtcggagcctgtctttattttatttgtttaagcaacttgaaccttaatgaaccaatttaatagcagtattaaattcaagaattatggtagtcgtgggtggttagttttaattgtcagctctctctgtttgctggttccgtgtggggttttcagatggtgacaaccaggagaaccgctgctaccggtgaaggcagccaacccgaaggcagcaacctcaacgaccatggcagcccacctccacctcctcctccgcctccaccaccaccaccagacaccaacgccatcctcacccaaatcctcgtccagcaagccaacatgatggctgctttcctctaccacatccaaaatccaccacagcataatgctccacctccaccaccacccccacaacactctaagctcgccgagttcctccgcatccgcccacctaccttctctagcaccaacaaccccgtggatgcgttggattggttgcacgccgtggggaagaagttagacactgtgcagtgcaatgatgaggagaaagtcatctttgccacccaccagctgcaggggcccgcatctctatggtgggaccacttccaggctacgcagcccgaggggcagcctatcacctgggcccgcttcaccgccgctttccagagaacccatgtgcccgccggagtcatggctcttaagaagagggaattccgggaattgaagcaaggcaaccgctccgtgatggagtatttgcatgagtttaacaacctggcccggtacgccccggaggatgttcgggaagatgaggagaagcaagagaagttcttggtgggaatggaccctgagctgtccgtacgtctggtctccggggactatccggatttccaacgcctggtggacaagagcatccgcttggaagccaagcacaaggaactggagtcgcacaagcgtcacttggcgaatttccgcaaccaacagagggctaaccaaagggtccgctacaccaacccctatccagggggatcgtcctcgcagcagcaacagcagcagcaacctcgctccgcgccccgacctcaattcgtggtgcgcgtcccacagccgcagcaacagcagagtcagcaagggactcgtgcgccccgtcctcctacgccagccgtgtagcctggtcaaggccgcagggacgttcaaggtcagcagcgtctgtgcttcaactgcttcgagcctgggcactttgcggataaatgcccaaagccgaggcgccagcaaggccaagcgccgccccgctccaacaacggtagtaaggacgtcattcggggtcgtgtgaaccacgtgactgccgaggatgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctatgctcatcaccacccctggaggggttatgacagcgaagttttatagccctgccgttcctatagaaattcagggaattccgtttccctcggatctgattcttctagacaccaagaacttggatgtgatccttgggatgaattggttggctcaattccaaggagtagtggattgtgcaagacgcactgtcactctgtaccgagggccggaacaaccggttgttttctttgcaccctcaatcactgtcggcaattcagaacttcatcagataggactgtcgggaacccctatcgtcagtgagttcggagatgtgtttccggaagaactacccggtatgccgcccaagcgagagattgagttccggatagatcttgctccaggaacaactcctctgtacaaacgacactaccgtatggcagcaaatgaactggtcgaagtcaagaaacagttggaagagttaaaagagaaggggtacatacggccgagcacttccccctggggtgctcccgtaatttttgtggagaataaagacaagacaaagaggatgtgtgttgactaccgagctctcaatgaagttactatcaaaaacaagtaccctcttcctcggatcgatgatctgtttgaccagcttaaaggtgccgcggtattctccaagattgatcttcgttccggttatcactagttgcgcatccgtgaagaagatatcccgaagactgcattcaccacgcgatacggactgtatgaattcacggtgatgtcgttcggtcttacgaatgctcctgctttcttcatgaacttaatgaacaaagtgttcatggaatacttggataagtttgttgtggtcttcatctacgacattctggtgtactcacaatcaaaggaagaccatcagcaccatctccgtccggtgttgggaaagttgcgggaacatcaattgtatgccaagcttagcaagtgtgagttctggttgtccgaagtcaaattcttagggcacgtgatatctgctaaaggagttgctgtggaccccgaaacagtgaccgctgtcactgattggaagcaacccaagacagttactcaggttcgcagctttctgggtttggcaggatactaccggaggttcatcgagaacttctccaaaatcgctcgacccatgacacagttgttgaagaaggaagaaaaatttgtatggagtccgcagtgtgagaaagcgttccagacgctcaaggaaaagctggtttcctcgccagttttaaccttaccggatactcgcaaagacttcatggtgtactgtgacgcttcgcgccaaggattggggtgcgtgctcatgcaggaaggtcatgtggtagcctatgcctcacgccagttacggccccatgaaggcaactaccctacccatgatttggagttagccgctgtagttcatgctctaaagatctggcgacactatctcattgggaatcgctgcgaaatatataccgatcataaaagtttgaaatacatcttcacccagtcggatctgaatctttggcagagaagatggttagaactcatcaaggattatgatgtgggaattcactatcatcctggtaaggccaatgtggttgccgacgctctaagtcgaaaaagccattgcaacactcttggcgtccgtggcattccaccggaacttaatcaacagatggaagccctgaacctaagcatagttggtcgtggattcttggctacgctggaagccaagcctaccttgctcgatcaaatccgcgaggctcagaagaatgatccggatatgcgtggactcctcaagaatatgaaacagggtaaagccgctggtttcacagaagatgaacacggaaccctatggaacggaaatcgggtatgcgttcccaacgatagagaacttaaacagttgatacttcaggaagctcacgaaagtccttattccatccaccctagcagtacgaagatgtacctggacttgaaagagaaatactgataggttagtatgaagcgggagattgcagagttcgtagccctttgtgatgtgtgccagcgtgtcaaggcagagcaccaacgaccggccggacttctccaacctctccaagtaccagaatggaaatgggatgaaattgggatggatttcatcactggacttccaaaaacccaaggcggatatgattctatatgggtagttgtggaccgactaaccaaggtagctcggtttattcctgtgaagaccacctatggagggaacaaactagctgaactctatttcgccaggatcgtaagtctgcatggcgtctccaagaaaattgtatctgatcggggaagccagttcacctctcacttctggaagaagctccaataagagttgggtacccgattaaatttcagcaccgcgtatcacccgcaagcagatggtcaaaccgagcgtctaaatcagatcctagaagatatgcttcgcgcatgtgtcctagatttcgggaagacctgggataagagtctcccctatgccgagttttcctacaataacagctaccaagccagcatacaaatggcaccctatgaagcgttgtatggacgcaaatgtcggacaccgctattgtgggaccaagttggggaaagccaagtgttcgggacagatatcctgagagaagctgaagctaaagtcagaaccattcgggataatcttaaggtggcacagtctcggcagaagagttatgcagataaccgacgccgtaacctggaattcgcagtggacgattttgtgtaccttcgggtcacgccattgcgaggtgtacacaggtttcagacgaaagggaagcttgcacctcggtatgtgggtcctttccgtatcattgctcgacgcggggaagtcgcttaccaattggagctgcccgcctccttgggcaacgtgcatgatgtgttccatgtgtcacaactcaagaaatgtcttcgagtgccatccgagcaggccgattcagagcaaattgaagtccgcgaagacttgacctacgtagaaagaccagtgaaaatcctggacaccatggagcgcaggaccaggaatcgggtaatccgtttttgcaaggtccaatggagcaaccacaccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctctaaattatgcctagaataattaaaatccatgtgaaagccttcaaaaattaaaatgtgcaaagttaaaagtcaaatagggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagttccctttccctccccctctccctcttgggccggcccggcccagctccctccccctctctctcctctccccgcggcccatccggcctctccccgcgcgcgcgccgctgacgggcgggcccgcccgccaccctcgctgacgggtggggcccacccgtcatccccttcctcccgccgttcccgccggcccgcccgcgccaag

SEQ ID NO: 32719 - DNA, 1147 bp, Oryza sativa
cctcgccggcgccatcaatggcggccggatcttccgcgctcgtttccccctcgtccggccgccctctctcactcccaaccctatataaaccctccccgagctccccacctccgtttccgccactcgtcgccctctctccccgtcggaatcgagctcgcgccgtcgttctctctctccgccgtcgccgccgagctccggtccgccgccgtcgtcgccccggaccatctcccgcctcggcgccgcctccttcggctccgccgcatcctcgccgacctcgtccacccctccgtttcgctcgccgaccgccggaacgccgtcgaccccgtcgacccgagccgcgccgctgccttcctccgctccggccgcctttttcgtcgtcgccgtcgacctagggtgagccgtggaccgtcgcctcgtttcctcctttccctcccttctctcggccgccgctccgccgtgcctatggccgccgccggcgaccataggggcgcgggcgcgccgcctgtcacgtcctgataaattcatcccgaaataaaattcattttctaaaaggaataatagaattaattaaaattcgaaaagaaattggcaaacactaaaatacgtacaagaaaaattcgaatgtggcccggagaatttttgttaaattctccttggtctaaacggagccctcaaattttacttgaattttcagagcactggaaataattattaagcaacaaaaacaattatcggagtttattaaaaagaaaaactaaaaataatcccccttcctcctttgggccgagtttggcccaaagtctttccctcatccctcctttttccccttctctctcgggcctcctctcccctcggcccagctccctccccctcccttcctttctcaggccgcccctccctcctctccttcccggcccactccctcctctcccctcccacctgggccgtgtcccggcccagccgagcctccccaggccgcgccgcacgcgcccgtcacgcgcgcgcccacgcgcgctgaccacgcgccccgcgtgggtcccaccgcccggtcgtcgtcctcctcccgcccagcttctctctctctctcccgtgaaccctagtttcttcctccctcaaatccacgcgaatcaatgccattctttccaaa

SEQ ID NO: 32720 - DNA, 377 bp, Oryza sativa
  unsure (1)..(377): unsure at all n locations
nnnnnnnnnnnnnnnnnnnnnnnnnnnnnnnnnnnnnnatgtgtgagtttggtggggtccttcctaatttactttccagtcttagcacgtcgctaaaagatctctctctttcatataacaatattttgggaagcatacctaaggatattggaaatctcttcaacctacaagtccttgacctagcttggaactctttcatcggaactcttccttcatcccttggtaggcttaaaaacttgcactattttaacgtatacaacaatgatcttggtggaccaatcccatcgacaataggaaatctcacagagttaattacgttgtatttgatggcaaacacctttagtggtaggttaacaaactcacttgcaaacggaatt

SEQ ID NO: 32721 - DNA, 592 bp, Oryza sativa
  unsure (1)..(592): unsure at all n locations
ctcggtacccagatgctgagatggtagcacatcttggagactttggacttgcgaagattcttgttgagggcaactcattgctccaacagtctacaagctcaatgggatttagagggacaatcggctatgctcctccaggttagccttttatttttcctgtcctcctttcttatttagtcctgcctagtgcttttattaataaaatgtacagctagacaaactttttgggaagttgcaaaagaagtttgatttatgtgaagcagctatagttattatgaatctgttacattttggattacaagcgctataaaaatcgtaactttttttttggcaaactttgattaaacagagtatggtgctggaaatacggtatcaactttaggagatatttacagctatggaattcttgtgttagaaatggtaactgggaagaggcccatcgataacaaatccatacaaggattgagcctccgtgagtatgttgagctgggtctacatggtaaaatgatggatgttgttgacacccagctgttcttgggccttgagaatgnnnnnnnnnnnnnnnnnnnnnnnnnnnnnnnnnnnnnnnnnn

SEQ ID NO: 32722 - DNA, 669 bp, Oryza sativa
  unsure (1)..(669): unsure at all n locations
ctatagggcgaattcgagctcggtaccccgcatatttcgtagtgcttcacattcggcagtgaaactcttgagtgccttaggattttcaagctttagtaccttcactgcaacatgatcttggatattaagctttcctttgtatactgagccaaatgatccagaacccaacaaattagtcggcgcgaaaccatctgttgcttttaccaactgcgaataagagaccaatgggtggcctttcatggaagttcttgaaggggctccctttttagttctcttgtgccaggttataagcaagtagagtgatgagaggatggccagtgctgcgaccagagaaacagaaataggtagaactgggaaatgttttctattctctagtaatggacaacatcgaggcagatgtagatcaggtattccaccacagagtttggcattgccttggattgagatcccggatgcatctgcgaaagcaccaatggttggcacttcccccataaagctgttgaaagaaaggttcaaggaatgaagcatagtaatatctgctaaggatgtgggtatctggcctgacaaattgttgcttgagagatcaagagtttcgagacctttcagctgacccannnnnnnnnnnnnnnnnnnnnnnnnnnnnnnnnnnnnnnnnnnnnnnnnnnnnnn

SEQ ID NO: 32723 - DNA, 1604 bp, Oryza sativa
acatggtagcccatgttggagactttggacttgcaagaattctagttaaggaaagctcattgatgcaacagtcaacaagctcgatgggattcagagggacaattggttacgcagcaccaggttaagcctaaactgttttttttttttttttgcctttctactctctagtgctgtatgaaataatgtttgatcctagagatattaatggagaattgaagtaattagttggaataaattgcacataagttaatgtaattttccatattatctatcaagttactaaatcaatttcgtagctacagacttttctagagttacacactcaaaccaacttgtggatttttttctaccccactaatggaggattttgaatcgtttagtttgagaaaaattttacaatattccctccttccacaaaagttacacctattacttttatcactaagacgaaggagaaattaactcatcattcatgtaacaaagatcaaggagtgtatgcacccatgcaaccaatgagtattaagataactccccggattctaatcaaatatttaatttacctctctattttagttttggatgcataaagaatacagataggaataacgcatttgaaaaaactaaaatatgtaataggtataactctcttggatggagaagtactacgctaacttttcataacatcaaagaactatatatttatgaattatttctttacggagaagttcatatccctcaaagaactatatattcaagaattatttcattgcttggtttaacctatagttcaattatagaaactttatttgaatatataattctacaaattagattattaaatatttaatttctttgttatttccaatatctcacatgtaatttaatgcagattattatatcagtttcagcgatgcaaccctatattatatcgttatactccctccattccaaaatataaggcacagctactcttaacccaaagactaagaaataattattatcatcttgtagtttaaatcatcctaataaatataatacatgcattcaataggattagataacataagagtggaagatttaaaaaagtaataatttaatggagaagatgtcatatttaattgcatgcttgcatgtatgccttgtattatggaacatctaagaaaagtggttgtgccttatattatagaatggagggagtagtaattaaatttcaaattgtacatgtttaaaagatacagtttttttcctactggaacagagtatggtgtcgggaacattgcgtccacacatggagatatttatagttacggaattctagtgttggaaacagtaagcggaaagcgaccaaccgatactacattcggacctggattgagcctccgtcagtatgttgaaccgggtctacatggtagactgatggatgttgttgacaggaagctcgttttggattctaagagttgggttcagactccagatatttctccatgcaaagaaatcaatgagtgccttgtttcactgcttagacttgggttgtcttgctctcaggaattgccatcgagtagaatgcataccggagatgtcatcagtgaactgcatgacatcaa

SEQ ID NO: 32724 - DNA, 632 bp, Oryza sativa
  unsure (1)..(632): unsure at all n locations
gaattcgagctcggtacccacaaacgtatagagaatttggagacaatttagtaagtgctttaacatcttagaaattatcctttgaatgaatctttatctctcgtctgattcctgcggtccaatcaaataatggtcattcctgtgtttagcaatcgtctgttttgcacttacattcctatcagaatcttgtgtttttttattcctttgtttttccattcctgcgattcaaaggagctcttagattcattcttgatttaatagttgggattaaatctgtcttagatctgacggcttataattgcgtattggcgtggtgcattctagtggtaagaagtattatcttttcactacttttagatatcttgtggctaggcaaatgatcacactacaccatatcctcacccctttgactgcatacctgtgatgggcataagtgttggtcagtgatgagggttacctttgacgggttctacgggatgccgtcattagtgagccatccggctatagcccgtcacaggtatctactcacttgtgaatgcaacccgtttacggtcgagaatgcaacccgtcagagnnnnnnnnnnnnnnnnnnnnnnnnnnnnnnnnnnnnnnnnnnnnnnnnnnnnnnnnnn

SEQ ID NO: 32725 - DNA, 510 bp, Oryza sativa
  unsure (1)..(510): unsure at all n locations
ctatagggcgaattcgagctcggtaccccgtggggaagaagttagacactgtgcagtgcaatgatgaggagaaagtcatctttgccacccaccagctgcaggggcccgcatctctatggtgggaccacttccaggctacgcagcccgaggggcagcctatcacctgggcccgcttcaccgccgctttccagagaacccatgtgcccgccggagtcatggctcttaagaagagggaattccgggaattgaagcaaggcaaccgctccgtgatggagtatttgcatgagtttaacaacctggcccggtacgccccggaggatgttcgggaagatgaggagaagcaagagaagttcttggtgggaatggaccctgagctgtccgtacgtctggtctccggggactatccggatttccaacgcctggtgctcgcggcggcgtcaggacactggannnnnnnnnnnnnnnnnnnnnnnnnnnnnnnnnnnnnnnnnnnnnnnnnnnnnnnnnnnn

SEQ ID NO: 32726 - DNA, 609 bp, Oryza sativa
  unsure (1)..(609): unsure at all n locations
nnnnnnnnnnnnnnnnnnnnnnnnnnnnnnnnnnnnnnnnnnnnnnnnnnnnnnnnnnnctttcaattgactcaggagtgatggaacgctaccgctcaagaaattattttggagagatatattctggagaagttggcattcaccaagggtgctagggatttcacctgataacttgttggaatctgcatagaattgaacaagatttttcaagcccccgatttcttgtggtattgatccttccaagttgttattggatatatccaaagttaacgacaacgtgtgaatcttaaatatttcaacaggaatagaacctgtgaaattattgcttgaaagacctagttccactaggtttgtcaggtttccaagtgcacttggtatcctaccagtgaaggcattcacatcaaggcggaaataatttagttctgtaagattccctatggctaatgggattgatccacttattttattattgtctatatataaaacttgcagatttttaagcctgcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32727 - DNA, 640 bp, Oryza sativa
  unsure (1)..(640): unsure at all n locations
gcattccttgctagttaataaaaaatattcaagctagctaaggtacgactaattaactaattaaatttctctcttgagagaatacaggattgaagatggaagttatgtcaatgtaacattggaatgatcatgtggagatccatgcagcggtaatttttaaaatattgcagacattgctgtactcccttttaaagtacacaaattttactatggtctctactagactgtaggtaaaagatacgacaaacatcttgttattttttcatctgagatggagggagtatttcagaccgacaacatctgaaatactcatttctgactaaagtcctgataaaaataaaaaaaatttgacaacatatatagattaagcaccaaatactttctctgggttttacaagttgtgaaacagtaaaagtattcgaaaaaaaaacactctgttttcagtttcctccaaaattttataggattttcacatgaaaccgttcaataccttaaagttcgtgcgaaattcctccaaaccgaatagcacccttcaaggtttaaaagccaaacaaactctgccagaatgacgtgtctgattgttnnnnnnnnnnnnnnnnnnnnnnnnnnnnnnnnnnnnnnnnnnnnnnnnnnnnnnnnn

SEQ ID NO: 32728 - DNA, 547 bp, Oryza sativa
gtgcgccggaagtattcaggaagattaattgaagaccgattattgcaaggcaagtcacacagatcctaaacacaatcctttgagcatgttgattctatatttaaattctctatttatttcaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagcaatgcttagaaacattagctcactaatgtgatgaatcatatatactacattattatttatggttatatttaatggtagctcacgatggttaatcgggttatgataattaattgataattaaaacttgattaaaggtgggtggtaagcaaatggttttaaaagtcgtgctcatggcaattaaggaccggttcgcgagctactgttgtgagacatttaccgtaccaacaacaagccagcatgggcaacggttttaccttt

SEQ ID NO: 32729 - DNA, 6196 bp, Oryza sativa
  unsure (1)..(6196): unsure at all n locations
nnnnnnnnnnnnnnnnnnnnnnnnnnnnnnnnnnnnnnnnnnnnnnnnnnnnnnnnnnnnnnnnnnnnnnnnnnnnataaagcattgttgtatggtttgaaacaagcacctagagcatggtactccaggcttagtagtaagctttgtgatattggttttaagttatccaaggctgatacttcgttgttcttctatagtaaaggaggagttactgtatttgttttgatatatgttgatgatattattgtggctagttctacacagaatgctactgatgctctattaagtgatctgaagcaagactttgctctcaaggatttgggagatttgcattattttcttggtgttgacgtaaataagatacgtgatggcatattgctaacacaagaaaagtatgcttcagatttactaaaaagagcaggaatggaaaattgtaagtcttctactactcctctttctacagttgaaaaactctcagcctataatggttctgtgttaggagtaaatgatgcaacaaaatacaaaagtatagtgggtgcactttagtatttgaccttgagtaggcctgatatatcttatgctgtgaataaagtctgtcagtttttgcatactcctacagttcaacattggtggatggcagtaaaaaggattctgagatacattaagtcctctatagatcttgggttgaggattactaaatcctcttctacacttgtaagtgccttttcagatgcagattgggctggctcaatggatgacagaaggtcaactggaggattctgtcacatcctgatttttgttttaggattataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattattaattttaatcatacaaagagcatttcagtaattattcacatattaaattaattattaaatggtctaattataattttgttaagtacttttagtgtccaagtattttcaggatttttcttgaaattatttgagcattggaagtatttttaacaattcaaagatcatttcagtgattaatttaattggaaaagtaattaaaattcaccttttccttttcgggccgaattaggaaaagtcctctcactctcggcccagtctcctctcagcctgcagcccttttcctctctttcccgaagtcttctttgcgtccctcctttaatcagtccttggtagtagaagcccagccgaaagtctagtttgcttccctgctacagtggcatcttcaatctccagccggctggagacagagcccgagccagccgcacagtacctgtatagccgcggttttcccctccaaatccaaccttttctcttgtgttttcctaaaattagttgaggggaaatattcctcttatcctcctctatcctctcccccaagaatcggagcaaaccgttgagtatcttatccgaatcgaactcgttttcgagtttatctccaaaaccgagtttttatttcccggatcgatttcttgcgggaggagtccgatctcttcaatccaaggctataaataggaccccctagtcctcctctttcgtttgccccctctcccgtggtctcccgtgtcccgtagccttgccgccaccaccgcctagctcaccggtcgccgccggccatctccggcgaggtagcgccgccgtctccatcgtcgtcgccggtcgccgtcaccaccgttgggtgcgctgtggtgagaggaagctcggccacccttccttttccgtcgccggtcaccggagctccgccgccccgtgcaagccgagtcgccgccgccgccccttcgtcgccggccgtcgtcggtggtcgtccggtgtgttggtaagtaccgtcgcgttcgtctcgtcgttctctacgtgtagatgccctccaaaatcccggccgaccaccctagctccggcgaggttgccatccgagccggccaccattgatgacgtcatcatgacatcatcatcttctccttttccagtttttctaatagattgaatctttgaaattcatagtaactcagtttaatatggttcaagttgcaaaagttgtataaaataaagatctacatattaaaattgccataaattgaattaaatttatttaattttttttaaatgggctttaattagatttaatcttgtaaaattcataataaattcatttgaagtcagaatgaggccgttcaagtctcatattcatctaaaattatgatctacgtgtttgtttactttttatgtactgtttatttgggttttattagtctttttcctcggtttggggggtaacttggcgtttccgtcgttgcgaaagttcccgagtgcccgggaagtatttcagaagattaattgaagaccgattattgcaaggcaagtcacacagatcctaaacacaatcctttgagcatgttgattctatatttaaattctctatttatttcaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagcaatgcttagaaacattagctcactaatgtgatgaatcatatatactacattattatttatggttatatttaatggtagctcacgatggttaatcgtgttatgataattaattgataattaaaacttgattaaaggtgggttgtgagcaaatggttttgaaagtcgtgctcatggcaattaaggaccggttcgcgagctactgttgtgagacatttaccgtaccaaccacaagccagcatgggcaacggctttaccttttgtatagcatgattcattgcggggcaccagactgtgaagcggcgagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttaagcaatgtttttcgtgattagtcccacacctctcacaataattatggatgttataactggtaataatttgcttagctcctggtttggagttagatctgtacagccggggttggttgttcaggtttggttgggcctgagcagcatgggtgtgctgttcagtgttgattaaaattgatgattaattactctactgttttatttatcttaaatctttgctaaatgctgcttttgcaaatgagcctatattatgccatcctttggtatccttgtgcacttgcatacttgctgtgtggcttgttgagtatgtcatatgctcattcttgcaataatcatcaaacctcctttgaagataaaggatccagaaggagaagacgtttggcttataccccagttgagctgcctgtgggagtggagctgaagccatcgctagaccgttaattccgctgctgttttctttcctttgtaagtatgtaacgttattattaagatggatttgtatattaaattgtcagtttgtgtacctcggctgattcctggacgaggattttatgcacaaattagttcggaaattactagtgaatttccgggcgtgacagattcactgtgtttttaggatcaaatctaatatcctggagtgctagaaagcaagccacagtatccaggtctagtacataagcagagtataaagcagttgctaatgctacagctgaggtaatgtggatacagactttgttaaaagaaattgggattcattcgcctcagtctgcctgtttgtggtgtgataatctaggtgctactttgtcagtaaatcctgtttttcatgctcgtactaaacatatagaggtggactatcattttgtcagagaaagagttgctagaaaacagttagaaattaagttcatttcatctggtgatcaagtagctgatgggtttactaagcctcttcttatacaacagtttcagaagtttagatacaatcttaacttagataaattatgattgagggggagtgttagaaaggttgttcctgttacatgcgtttgcgggtggacaaaaagctcaaaactcgtggctcggatcggcttgtagcaagctcggcttggatcgactcgaactcgtagtcttaatgagtcgagtcgagctagccttttagctcgtgagcttaacgagctaactcgtgagctgctcgtttagctcgttactataaaatatcaccaaatctttatgaacttagtgtttattgactagtgcttagtcttttatttacatcaaaactattcatatttagtaagtactatattagttagtgtttattattatgttaatacataataaaatgttaaatttgaaattattaatatgatactaataagatatagctcgttaacgagcctaacgagccagctcgcgagccgagccgagctagccttttagctcgttaacattaacgagccgagcagagctggctcattaagataacgagctcaaacgagccgagccttaacgagccgagctggctcgttatcctgcgttgttacatgtgataatgcatgagataataggatatggttggttcggttagtttgtttcagagtttgtttctttcttctatccgaatcaactgagattgatctcatctattgtaagccacgttgggggctgttcccaactcatattaacacacgtacgcggcctcgagagaggtgacaacgcttccgtattttctacaggcggagccggcgacgatcatggcgatgaagatcttggcatccgcagaggcggaggcgaggatgaagcgtcgaaggcccccgtaggtctccgatgcacgcttgcagatcggttttttttggcatgtctcatgcctgtagatcgatctgtttgcggacgtgcatgcatgcatgcatgccatcgtggtgggcgcgaggccggccggtcgcccggcccctgcatacgggccggcccgtgcgcatggcttacgcgatcagcggcatggccgaagcccgccgttctgcggcgaatcgcttgatctcgatcccccatccatacatgcccgcgtgcggcaacatcggcggcggcagcggttgcctgcgatcggcaaggcgacgcgacgacgatgttgatcatcagacctcatcgaccggcacaaacatgcaagccaaacaaccaacagattagattcataatttgtaatccaaaatcaatctagctaattaattagcaaggacaaaaagtgattctctgtagatgtgatgcatgtgttgacgatatgattcaatcagtggcgtagccaggggtagtcccggtgggctcgggactacccccgaatttggcccacgaaccctcacccccaatattttagcctagactcaagcctaaagaagcaagcccaataagaaactagaagcacaggggcatgactcatcacttcatcagtgtgcagccgtcaccatcgtcgctccgcgattcataggaatttttttcgtataaaaggattgataggattcaatccttttgtctcaaaagctttcataggatttctacttttttctccaaatcatagggtctaagtaaaagagacttaattagtaaaagccaagtgtttttatgaggctttgatgagggttcgcaaagtctccctcgtcacttagctccagtcctgctcagtgcgaggacagtgcggtgaaatactctggctagcgtaaaaatgggaaggatgcgtgttttacatgcatatgtaaaatatatttcaaacaattttggtaagtctaaaaatatatgtagtattattgttcctatatggtctttaacattatattttgattgttgatttctttcataatattataaaggacaaagaaatccacatcatgagaaaatattttaggatcaaaatataataata

SEQ ID NO: 32730 - DNA, 8006 bp, Oryza sativa
tagatagttgacatcgtcggactttttctgaatcaaacttttataaatttgatgtcaagaaagacttgataatagggcaccctaagttcgacccatataacgcacttctcaaacaggaattaggagtggcctgctatgtatgcatgctgtagtaagatgtatttaacttctccatgtataagtgcttccttatattttatgatgatgatgccccccacctctctctctctctctctctaagaatattgagattggcaaaatagaatgtgctgtacgactacagaagtaattaagtagtactccctccgtttcgaaatgtttgacaccgttgacttttttaaacatgtttgaccgttcgtcttattaaaaaaatttaagtaattattaatttttttcctatcatttgattcattgttaaatatatttttatataggcatataattttacatatttcacaaaagtttttgaataagacgaacggtcaaacatgtgctaaaaagtcaacagagtcaaacatttcgtaacggagggagtagtatacatatatgattgccaagatacacatgcaccacgtatagctagctagctgcacaacatatatggagtatttctcataacgtacgtacacactacacgtacagtagtgaggaaccatgattgaattaagaaggtacaaattaatagtacaataggatattatatagatgatgaatgcatggtcacacaagcatttttgccgagcgggccacactaaggttgccggccggccaaattgttgttaagatagaaattaaagagtgagattacataacataggggtggtaccccatcaaattcattaatcaaagttaaggtactgcatgcgatgaagaaagatcgaaaataggaaaaagatcgagatacagctgatccaatcatgcaccaacgagacttcactgcaggggctagcatgagatgcaacttatataattaaggagctagctagcaatataagcagtatagcagtaatagatgatgcatatatggatcgatggaggggagctagtagagaccaggcttgtagttgagagcgttgggcagccactgggtgccgtggatgaagcggtcgacggtgtactcctcagctttgctagcgtcgaccacggagaagccctcccagttgacgcggcggctggtgtccgatccgggtcccgtattgttgaacttcatgtacgacacggtcttggtcgtctccaagacgtgcttgctcttgtcccactccacccagcccttcgggtgcacgatgccgtcgaggaacgactgcatgaagatgacgtgcgagtggttcttccacgggcggccgaggaatgtctcgacgcccgtcaggttctcgttgggcttggccatgatgctgcagttctggaagctgaagccggtgtcgtcgccgggcttgtcgcggccctgcgccgtgatgatgttgtgcgcaccttcccttccgcggcgcacgaggagatggcatctctggaacaccgccttggcgttgccgaagacgaagtccaccgtgcctgaaatcacgctgtcgaggtacaactgcagtccgttctcagcgtacaaggtgtcctgaaagctctccagctcgcaccggtacagtacagtgtggttggaactagagcgaagagccaacgactggttcccctccggtcccgccgtgttctgtatcgtcaggtctcgggccatgaaaccgcggcctgaggcagctgcatacagtatatatacgtacatacactgatcaaaataaaatttcatatatatatatatatatatatatatatgtcattccttcctatacaatacaatatataaacatcagcacataacatattataatgtcatactataattcaaaataacatatttcttttagaagtattggaatatagttaatatgagtctttaactgcaaattagttataaataatccaatgtcgtaagcttataaaaattagctatttattttaaaagattatcataaactatggtttataatctaaataatatagcatgaaaacaatgaaaattgtggcaagtggatagacatattgtaagcatcatatgcatgattacataatctcggtgtacttaatttatgctccagtgcagtctagctaaacaaattatttgtagagaggttggcttcgagtacataattcctaatattaattattccaaaaaaaatgatgccttcgtacgtagttatattttaccatccaatcgtgttcttgctaggctatgtgaagctttgcacacttgcaaaaaataatcctatataggttgtctcctatatactgcgcaatagatttggactctacaagcttgtgtatttaacatagtctcgaaccatcctaatccatcaattaataaataatgagaacatactttagtcttagatgtttatacaaaaatcgattcatttttttcgaaaatggttggcatataaggtgtaacacgctgtcactattttgtcatctcacaaaatctgaacttaaagtaagatttcataaagaaaatagaaaatacaatagggagcaaagtgaactaattatagaaaaacatagaaaattcttagaaaaaagctctttgcttccacttaaactagaacacccattaccataaccattacatatttttcgagtgctccgatgcttacatgtaaatatacacgaaccaattagagggcgatgattgtataaaataacacgtctattaaacactaatagtttttaagatttgtttaaaaaataaagcccataaacaatcaattctaaaaacgaaaacacattacttttaatttacactttatttgtgaaacgagactaagccaatcttctttaaactgattaagcaaattaatggaggtaaattaaatattatataatataaagacaacaaatagtttgtaaaaaaatatttaagaaatactggtgaagaatgtttttgggcaatcatacttttccactgcagcacgaataatccagtagatatgtttttcttatagtttctaacacaacttaatatgtatgcccgcgcattccttgctagttaataaaaaatattcaagctagctaaggtacgactaattaactaattaaattaagcaaggcatatgcatgcaaattaattaaacacagttacatattctttaggtagccataagagaataatactaggactacttactaacggtagccgatgaaggcatgtcgccatgcttgagggagccacggttgccggtgatcaccgtcttgcccactccgtcgccgaacaaagtcacatcacgcctcgtgatgttgagctgctcgatgtacgtcccctccccgatacggatagtgtaggacgaccgtaccttcttcgtgctcttgggcgctgccgccaaggcagcagcgatcgtcctgtaatcgccgctgccgttcttcgccacggtcacctcgaccaccggagaacgcctgccgtgcgccgccgctgatctggcgccgccgcgcaggagacgctgcagccgcggctttgcccaaccagggagttctgcgccactagttgggaggcagcaaacaagagcagccacgacgagaagaagaggcagctgcagactagtgttcttcatgcttgctcttggctcactctaactggactgaacgagttgatgtgccagcctctggttaatttccttcatatatatatctatacacacacatgcccggccggctgatagatcatgagctggagctagggcgaagctagcagtacaactccgagcctatatatagctagctagggattgaaggctcagcccaagtatttaacctaacctaattgctagatccctcctacgtactattaccctacttcccctataccttggtcggccacttgtgagttagtatatactccctccatctacttttgatagtcatatttccaaatctgaaaattttatttttgatagtcatatttcaatcaacaacccatcatcttaatgactttctcgaatttaatgcgtgactctccattctaccacacatgattggctacatgggtattgagaaatgtaaatattaatgaatcgcttgtttacgaggaataactagtagcatatttaaatgaatgataagtagaattacttatccttggtctgtgtgtcaaggtgaaatatgactatcaaaagtagatagagggagtactagtgtatcaattatcatagcgtacaatattatattataaaccagctataaacacgtatcgaaaagataaaagaagagagataagcagcgggctacaaatttatagccagctgcagtattgactccaacacacaatgtgtgtataacgagtgggaccatatattaatactgtagtatatatatatttatagataactattatatgaattgactattaaattgactatatatgatttggagctgttagttggctatactattaaacaacttgctctcagttgtgtatccgaccaaaaaatgttaaaattaagataagtggcctgtcataattgttagcctagctactgctgctgtatatcctccactatatattactctactatagctattgtatagtagtacttaattagtactagtatatataggtctcctcccaacgttcatctcgatcgatccgcatcggtcaattaatatatgtttgtgctgtagttgcatgcatgcatgcatgtacgtagggcgggtctctagctgaagtaattcttttcgccattgatccccttgatgcttggtcggtcctgcatcgatcgatcatttccatcaatatcgatcacaagcaagctaggttccattttttagtatcgatcgtctctgtcttaatagtactgaacgatcgcgagagaagaagatcgataattatggggagcaccagtcttggatgcatattatttgtacctgtattatttcgccggtgcaatgttaatttcccgctccatattatcactaccacaaaaatactcattggtgccagttataaaggcctcataggtgccggttttgggcccggctccaattggtcggtgctagatctggaaccggcacctatagctttcaacaaataaaaaaaaagaaaaataatcccggcaacccatcgccggccgtcggccacctcgcctggcgtacgcaccagccatctccaccttcgccgccatcaccagatctggaggaaaagggggtagggcggacgaagaggatgagggagggcccccagggagagagagacctgcatcgatccatcatttccatccatatcgatcacaagcaattaaggtcagattgtccatttttgagtatcgatcgtctctgtgtcttaacagtgatcgatcgagagaagaagatcgataagggagcagcagtcttggatggatattatttgtacctgtatatatatatgctgctagtacgtatacaagctagcaatagagtctgtaatgcaacacagttaatgcttgtgctatatatcagattaattaatggccatactattgtcatatatatctgcaaattaaggagcttctttttaatttcactctcaagttctcaatttgttcagtagtacgtggtctgcctatgaatatatgttcagaccggagaccatgatcacatggtgggcgctggctctgtatctaacaatatatgcaagcatgcatgcatgttctatgttccatcgtatcctcataaaccaactcgatagatctaccagagatgactcaaactcaatgctggagatcgagaccatgatagggagtgtttaatttgtatattcggtttattagtcaaacactaatttaacccaaataaaatattagtctgttggtaattttgctgattatcttataatagtttcagtgaatatttaaaaagatgaagcatatggttgaccaacgttaatcacacttgaatttatcgtttagtcactggtaaaaatatttaaaagatgaagcatggctgcatcctgtcggtcactacttcaaaaattatttttgttgacggccaaaataaaaatttatatataacgtatatagaaatcgcagtgtagttacactgtagttacaatacaactatagtgtaattacattatacttgcgctacaactatactatagcacatccacacaagtaatatacatcacaaattgacacaactttgagtaataaactacaaatccacataagcaaccgtgagtataacctaatctgaaatttggcaatgaaaatttgcagaacctacaagagttggaaatggcggcggcgctagcgggtgaaggagacggtggacgatgccggcggtcgagggtagaggccgccggatccaacggttggcggtgcggtggaggcggctgccgccggatctggcaagcggcagtggggtggcggaggaggaggcgactggcggtcggtggagaggcgccggatccgcgtcccccaaacgtgtcaaggcttgcggtcgttaggcgtgtgaggcagcggcgtccggcggtcggcaggcggaggaggaagtggccggcggtggggcgggggagaggccgtggtggtcggatccgcgctctgtagcccagatccagtggccgatggtcggaaggtggggggaggcgacggtgtctggtgatcgggaggcggaggaggaagcggccggcggtggggagagaggccgtggtggctggatccacaccctgtaggctagatccggcggccggcggtcgaaaggtgggggaggcggtgctggccggcggtcgggagacggaggaggaagcgaccggtggtggggggagaggctgcgatggccggatccgcgccccgttggccagattcggcggccggcggtcgggaggcggaggaggaagcggccggcggtggccgctactcgcgcgtggagtcggaggccgccgccggacttggtgctcggcgcgtggatgctcattgacgggagaaagaaagaaaaatgagagagagagagagggatggataaggtaaaagaaaaaacgagagatgagtggtctcggaccgtcggtgggagatagataaggattgggttgggtggtttctacctgtgaagaacaaaaaaaggacctgttagagatggattgggttggatctgtgtaacacactgaaaattcgaccaacaaaatcaaaaaactctaaaaatacggaccttcaaaaactttttaaataaattacatcatgccggttttattcgcctttttcattggattttgatttcgtagtttattaatcgcgaataaagaataagtaattaggaataaaccctaaaattcatttggctaaataaataattgaaaaacaatttaaaataaagattaggtgaggaaagaaataaataaaatattatcgcgaccatattggtaacaatcaaatttaagtgcgatggaataagaattagccctaattaaaaattcaaataaattatataaaaataaaatatgggtaatattaatctagggtgaatacattggttagaataacagagtaaacttcatttatgcaaaaataaggatttatagaataaaatatatataggaaataggctaaaatagggttaaatgggacctggcactattcattgcacgctaggtgttcgagagcgtccctagccctggcccctcctctgccgcgcgcgcctcgcgccccgagccgccgcgcgcccatcgccatcgccacatcgcgccccgcgcccttgccctgccgcgcgcctgtcacgccgccgtcgctgcgcgccgctcgcccgtcgccgtcccgcgcgccgagccccgtgccgagccgcaccaagccccgcgctgcgccgcccgcccgtcgcgtcaccgcctcgagccccgtgccgccgcgccgtcgcgtcgccactcgtcgccgtcaccctgagccccgtgggccgccgtcgcgtcgccattaagccggccacccccctctccttctatcccctcttccttataaatacct

SEQ ID NO: 32731 - DNA, 4163 bp, Oryza sativa
cctctccttcttccccctattccctataaatacctccaccccctccccatttcttcccaccccattcccctcttttctcctctcttcctctcaaccgcgccgccgccttcgtgccgcagtgccgccgcgcttggtgccgccgcgccgtgcgtcgccccgccttgcgccgtcgtcgccgccgccgtcgtcggtaagccgccccccccccttgttcggtcgccgttgccgcctgggtaggcagggagccgagagggaagggagaagccgggagggagagaaaaagaaagaaaagaagaagagagaaaaagaaagaaaagaagagagaaaaagaaatggaaaaataaatagaaaattagagagagattaaggaggtttagaacatttaaaataattagaatttaattatagattatttgtagtcgtagaattgcaaaattttatataattatagattatttttggtaatctctataactaatcaattcgcggtagatattcggatttaattactaagagttgtatttttcgttgaattttaaagaagatacttttaaatcgcaaaatgacttaggttgaatgagcttaaaattggaatagcgtggtttcgcaaactttgtagtcgatatagaaagatcgattcgcgttcgactttttgagtttattggatttttatttgaattctaattgaattcaaatcgtttcttcgcatgtaattttagggcacaagggagttgcggatccgagcgaggatcaagacccgcaggactacgagcaaggcaagtcatcactattctttgaacatgttgatcccaattgcgaaattgttctgtttacaaataaaattgcatgcaatgatgaacatcctacttgagatgcggcatgtgcagacatgagcgccacattgccatgaaattgatgacatgatttgtgaaaggagaaataaaactaaacaactattttcgactggggcggacggaggatttgggtgatatctggaaaaggctagtaccgtccccggtcaattaaggaccgagccatgaagttaagcatgaaacgacccccgtacaatcgtacatctcgaatgggtatagacctagcggattagatagccgagcagaggcagtatccctgcatagatggttcacccctaagtgaggcatgtgcgctaccgtggggcagccgttgaggtagggccacgtggcgtgctcctacatcggtgtcgctattggtaggactgccataagtgtgtgtgagagagaacttaacttgaaccataatttaatatgtgtgtgagatgtctctttcccaggagtgccagaactcctctcactgctagaaacatggacgcctagagtgcatgaggatttaagttcatggagtgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccatgcttgcggttattgagcaccgggacgtgtattacacttggctagactcaaaattcttaacttgtgtgggagggaaggtggacgtcctcagaaaaccatgacgactcaatggcgggaagctatccttgggatcacaatggatggtggacagaaccgtcgttgtttaatgtgaacactggtactaaaatttgatcagtctatgctaggttttaggcttgtgaaaagaattacaaaacttgctttgcgcaaaagaaccatagccattccttgaatacccgctatcatgtacattgttgttgtgttggcttgctgagtacggttggtactcacccttgcaatatacaaacttaatcagaggttggagatgaagcttcggaggatccctacgcttactaccaggagggtgatgaagacgatggcgctcagtaggtcttagttacggtcgttgcctgtggcaatggtgtgccgctgccttagctccgctgccttatctacttctgcttttggaatgtattccggaccattcggtcctatgttctatgactatgcctgcgggcctatgatgtaataattcacactagaatctcgtgtatgtgcacttggtatttctgctatgaactcgtgtgtaccagactacttgatccagggaaatggtactatttacacaattgattcctgttatgaaaacgggggtccacaatctgtatggcccatcacaggtatctaatcacctgtgacgggttgagaatgcaacccgtcacagctctgacgggttgcattctcgaccgtaaacgggttgcattcacaagtgagtagatacctgtgacgggctatagccggatggctcactaatgacggcatcccgtagaacccgtcaaaggtaaccctcatcactgaccaacacttatgcccatcacaggtatgcagtcaaaggggtgaggatatggtgtagtgtgatcatttgcctagccacaagatatctaaaagtagtgaaaagataatacttcttaccactagaatgcaccacgccaatacgcaattataagccgtcagatctaagacagatttaatcccaactattaaatcaagaatgaatctaagagctcctttgaatgcaggaatggaaaaacaaaggaataaaaaaacacaagattctgataggaatgtaagtgcaaaacagacgattgctaaacacaggaatgaccattatttgattggaccgcaggaatcagacgagagataaagattcattcaaaggataatttctaagatgttaaagcacttactaaattgtctccaaattctctatacgtttgtccatttcagaagcattttaaaggatatgatagaatttaatcctttgtttaaagatagcgctattccgagcgcaagagcacggaatattgtttcgagcaccgcacatcatgtccagagtccacagaaactggtgttcggttgccacgttcgatctgtgtagattagttctatttgaattcggggtaaatcaattacagatccgtaaaattggtggtcggatgaaaataatcgttgtaattggtttatctctgtttccaatcgaggtagttacgatatggtgtgcaacaaactgagaccaaatcttgtagtaaacgaataaccgttgatataaataaaaattgatggtgcatgtacctgcagtaattggattaacgacaaccatgcttggtaaaatcttgtagtaatcgagttactgttgacataaatgtgcatgtgcttgtagtagttggattatgaataacattggttgatcaaatcatgtagtattcgtattactgtcgatgtaaatgaaaattgatggtgcattaacttgtagtaattgcattattgccagccttggttgatgatttcttatagtgagtgcatcaagcaagaaaaaaaggaaaaataaataaggagggagttactggggcctaattagtttgccccaaataacacgtgaatcaattttttacttatacattgaatcactccatcctaaatcacgggacaaaaaataaagattttacatgcacatcatagtaaaagcacaagaataaaaattttacacacaaacacatcaatacacgccatcgccagttcctcgtgacggctgaatggagtttttgtcctggtagtgagagcaagaagacaaagcggtagagatgcaggctggagccgaggcagcaccaagtctggcctctacgacctcggtaggagccggatccggcgacggagctaaagatggaggtcgccgttgccgttgtcaccgcctcactgtcataaactgggcaacgacagaggtgatgaaacaaatcacagtttcttgccgatgttaccaaatcgattgaccatcacaaacatgatctccgccatgcaagggagaatagagaagcacgccaagctgagtgctcaacccaatcgaagtcagactgcatagaatcaagaaggatatagaatttaattaatcatagattgtatacaattcttgcgagaaatcaagaatctcattaggaattgctgagagaactcaccgtccccatgacgtccaccttgttcgccatgggccagacgtctcttcagctcgatctgaagcagatgctgcggcagcgaggcctaaa

SEQ ID NO: 32732 - DNA, 4692 bp, Oryza sativa
ctctatttctgctatatattccattaatggtgggagcacgatgtgggacgtggggtgggatcgaaagggaagttgtttttattatcgaagtaaatcgtttactccgataacggtaggagtgggatgacggaaagtgcggatcgtaaccagagaagttgattttatcgaagtaaattgttactccgataacggtgggagtgggagtgggatgatcgaacatggggtgaggtgggcctggctgatacacgtttggcgcttggaatataggagcgcgcagcgctcccaataatagttctatgaaattctttaaaattcctatgtttcctccaaatcaaagggtagtaagtaaaagagactcggtaaaagtagagtaaaaggaaagagttttcacagggctctacgagggttcgcaaagtctccctcgtcgttccagtcctccagtcctcctgccagcgtgaggatagtgcgttgaaatactctggttatagggtaaaaatggaaaggatgcatgttttacatgcatatgcaaatatctttcatacaattttggtaagtaaatatccccttcgttctaaaaaatatatttagtattattgtttctacatggtctttaacattatattttgattgttgttttctttcataatattatcaagaacaaagaattaaatccacatcataagaaaatattttaaaatctaatataataatactacatgcatgcataacactaagcacggatatttttagttcatttattggtcaagttttcaagtgttgattttcgtgaaagcaagaacacattattactttatcatataataatttactcccgtctgtcattggtggtttatattgtttggcttttttccggattaaacttttaattaaagttcagttctatctgccaagaaaaacttgataattgggcacctatgcccgacacataaaacacacttctcagacaggtattaatagagtcgtgcaagacgcgacttatgtacggctagtattgattgatgtcgccaggcgttagctagatggctaagctgctttgctatatcccggcgcctggcctattctcaatctaccgacaagctaattctctaatgaaagaagcaaattcagattttatggacgatggttgtaatatttgttaatttaatttcgaattaataattgtaaaattatgtttaccttgagtaggtaatttagaaaataaccaacatatttagcctacaattaaatatttactatatatataaaagaatatgcccccatataaaagcccgtgcaatgcacgggctgatgactagtattactaattggtgaaatcccatattgataacatatattcacaacgatgattcagcattgtgggttgtggtctgaagaaaaaacagtcagtttccattaattaatgggcgccatagctgtgtaccattgtataaatagagaactctaaacaaggaaaaagaatgtagggagggtattcgcagccatacttgtgaagtcctccggttagacagagcctaattaaggaggtcacttgttatactaatatatatagatatataaataccatgcagagatatcgtggcgtagaggaaaacagcttgattctaattaacgaccatggcttcattcacgcctaattgctctacgttgttctttttccttgtcttccttgctgcagtattcgtctctgctgcggcagcctccgagcacggccgggtgttggaggaggatcagaacattcggtaccgtgtggaggactcggaacttccggacctctactacgaaatctgcatgtatgcgagggagcacaggccatgtaggagggtgatggccaccatcccggatctaaaattcaagctctccggccaggttgatttagccttgctgctctctcacgtcatagccaaccggagcgccgaggccaaggccctggccgatccgttgctcgccgccgccgccgcaaagaagggcggtgatgagctccccaagtgtctcgcatcctgcgccgccagcctcgacgacgtgtccaaggccatgtccgggctccccgcggatatcgatgtcgagaggtacccgaaagtccagagcttcctccgcaacaagttcgaatcgggcgccgctcccccactatgcaagagcggctgccccgacaagacttccaccgccgatgaggccgccatcgccgacaagtttcatgccatctgggcgctcatggattgcgcagagacactcgcccaatactacgtcctccctccgcctccgccgccaaaacgctaattaattaattgacctactactacgtacgacagggaacatggtcgtcatcactcatcatattgcagacaaatactgcatgcgtccattccaagttttttttttgataatcgattaagttctcaaatcaattatatgtactcctatacttggagactgattacagtacatttatatcgcagttcgttcattcacatgtactcgcaagtgctatatatattatattttgatatgagataacattcacgagagtcttccggccattcatccctgtgcgcttgatcaaaccgaatattcctacagttaagccgccttgaatataatgcattctttcatttttttaaccataagctagccggcagttgctgcctctcttcctcctcgtccgagcggccttggtcttctccgctagctgcaggctccgagcctacgacggagatgggttttaattactcgggtggatattcaccaatttattgcatgttaactaaataatcataaaaaatctcaaaaaagttgacaagaaatattgatatataatatacaaatgcaagttcaaattcaacttttataagttagaacaaaaataataaatttaactatgaatatgcatacattaatcagagattgatttgttacaacttgtagaaatcttgcatgtttgtggggtgacatattacatatgaatctatcttgtcaatttttttttgaaattttcttatactcattttgttgatatgcaacaaataggtggatattgtcacgcccagtaattcactagtaattttcgaactaatttgtgcataaaatcctcattcagaaatcaaccgaggtatacacctgacaatttaatatacagattcatcaaaataactaaagcgataaatacttacataagagacaattagtcctcaccacaaagaaaactgcagcggaaaaataaatctagcgaagcttcagatccactcccacgggcagctcaactgggatataagccaaacgtcttatccttcgcaacgttttttcaactgaggtttgattgattattgcaaggtgagtacatgaatactccgcaagccacaaaacaaatatgcaaaagcacggggatacaaaagaatagcataatagagctcatatgcaaaagcagcatttagcgaaacatttaagaactataaaaccatagagtaattaattatcaatattaatcaacagtaaacaacactccaatgctccccaggctcaaccaaacctgaacagccaaccccggtcatacagatcaaacctctaaactaggaattaatcattccaaaccaggagttaaattaactatcattaattatcacattattattattaatgagtagtgttgaactaatcacgaaaaacattgttagacccacccataaccgcgggcacggctattcgaatagttttactgtggccagaggtgcacaaatttacccacaagacacaactccataatatgtcaccatgtcatcatgtgcccatactgaacatgtcaccatttgtgtagttgtgacaagacccctcacataactcaactcagagcagtgcaccgttcctggttcttccgcgaacggcatggttatgaaaataataaagtcatgctctcttaagcatgagcatgatgttgaaaaaaagaaaagaagagaataatgtatagccatgccttctccttaattataaaagaaggattttggagaaggaagaaagcacaaaagagaagcattttctttattttccacatttcatttccaccatatatcacacacacactttgcacgatcttgatcttgagtatgtttagtcatctattttagtttaagtttttgacttagtaataaatgtgaatgcaagtatgccatatttgatccctaccaaactccacatatcaaccttagaataggaataaaaaggcaaactggtgaggaattcttattaatacacttggagagatcaagtgaatcatttgaggaacttggatttcttttgcaaaatcatttgaaaacctccggaataaaagttgaataaagattgggtgattagtgttctaattgttgttctgtctctcaaccgctcaagacaaggagaggcactgtctcatgggaatctgtcgcgtcccaaaacgactctaaaatacatcctctaaattatgcctagaataattaaaatccatgtgaaagccttcaaaaattaaaatgtgcaaagttaaaaatcaaatagggcttggaggatttttgtatatttcctaaaagcctaaaatgcgtaaataaattttagtggaatttttagagcacaaataataattaagaagaaataaacaaagttaaaaaggttttataaaaagaaaaaccctaaaagttccctttccctccccct

SEQ ID NO: 32733 - DNA, 28213 bp, Oryza sativa
tataaactttggatgtataaactttagatgtatagaaatactatatatagaaaatatttgaattcaaattcaaattcaaattcaaatttgaatcggatataattcaaattcaaatttgaaacgggtatataaacttttgacttataaactttaggtgtatagaaatcctatatatagaaaatatttaaatttaaatttgaatcggatataattcaaattcaaatttgaaacgggtatataaactttaggtctataaactttaggtgtataaactttagatgtatagaaatactatatataaaaaaatatttgaattcaaattcaaatttgaatcggatatataaacttttgacttataaacttttagtatctaaactttagatgtgtaaacttgaggtgtataaactttaggtgtataaatttactaaaataggaaagtaatacggtgccaaaaaaggaaaccaggtagagggagggaggggggagggtcgctacccccattggcagggcgatcgatcgcccattagggctgcccgtataacgcgccctataaaaatttgaaataaatcagaaccacaagttttccctcccactttatcactgcaaaactacctccattaatcaatcatagatttagatctaaatatgccactattgtctcaatgattagcttggaggtgaagataaatctcagtgttcctattgtacttgaaagagataattcaagaaataccattaacaagtgtttagatccaagaaataccatcgacaagtatgagttctaagaaatgtcattgtacaaacgactttgtcccaaaaataccatcgatgttagggttccgtccattccgcgccgttaagtactataggatgaacggtgtatttaatggcgcggaatggacgaaacctaacggcgatggcatttttgggacaaaattgtttgtacgatagcattttttagaactcacacttgtcggtgtcttttcttggatttggacgattgtcattggtatttctcgaattatctcttcttgaaattagcaaccgtaaacatactatccaagcagacttatcaattattatatactaaagtttattaaatttcctacaaacgctctcaaacgctctcaagccgccacacgggactcctaaaaacactcgtatgctgccacgtggcattttaatatatgaaaaacatctagccatcgatttttacttaaaccagtgggtctattattttagacgattagattagtattagattagaaaacgttagttccccctctcatctacccgcatgtacgtacgtacgcctccctcatcttgttagttcgcaagttacgtgcatacccatctttttatacttcctactttttccttttatatttatatatttccatctgtaataccctagcacggtagatataagttgctaatagcacgccgcagaagcaagcaagcaggaaacgcgcgcaaaccatggccaaatacaaaggggctcacgttggagaagaaaggtagcagctatgactttctccccatagtattcgatatataagctacaaagggagtagtgtgtagttggtttaaaatttatatctgtattagtaaaaaaaattatgcaattataatatgctattagcacataattaattaagttttaattattacaaatttgacaaattgaaatatttgatattttaaagcaagttttatatagaaggtttttacacggaatacaccgtttagtagtttgaaaaatgtgctaacgaaaaccaaggtaaaatttgtatcttcgtgagaaagaacagggccgagtgaaaagtttgctccaataaaaaacattccaaggaactcatatagaaagtttttttttcaaaaattgtactccatccatcccaaaacataacattttttggtggttggaacatattcttaatactatgaagctgcacaggttttctgtccagattcatagtactaacatatatcacaacctacctaaaattattatattttgggacagagatactactgtttaggagatcaggaatcgtccccatgaaaatccataatttgtaagaggaaaaaaaagggcagcgaaagttaaggaaaaaattgtagtaaaaattatgaatatgtgataaaaccttacttgttatagcatctccaaactatacaaaaccatcttaggaggtatataaacggtattctagagttagagggtgctagatagaattttatccaaagtttaaaactttagggtgctagatagaattttatccaaagtttaattggttacttggacttttttcttaaaaaaatatggaaaaaggttgaattgtgagatgctcttttcgtcctagaatatatgacatagtactgaattggacatacatattcagatccgtagaactacaatttattccatatgatcatagttattgtattttgggacacaaatagcattaagtactccatctgttttaaaatatagtaatctagtattagattgtgtctaatccagtattaagttgctataatttacaagagggagtagtacgatgagtaaatgtaatggtttttctttgaccgaaatactatgggtattgttagaaaggattacaccgtgaaataaattttaatgctataaatccttgacgaagggagagtatcctataaatctataaagttcatctccactaagtacaattaatgctaattctctcttctctcatgaagtcacatcacctcaattttttttagcccttggatgattcatcaagggtgtaaattatatctcttcacatcaccttaattttttttagcctttggatgattcatcaagcatatattgcatctcttccctctcaaaagacacaccatacaacccaatcatttataacctttgaataaactgataaaggtaaaaaaaatatgaacacatgaaaaaaatcgtatagtaggtaagaaagaaaattttagaactcatatctactatattatcctacaattctcccatagcaatgtgcggggtacccatctagtttaacagacgacgcaatacgagcgattaaataagcaaaaattgcaaaaaccaccccaaatgccactttgagtttgagatgcccccataagaagatttgatgcaaatccctacctcctaattcactttggtttgatttaggcaccttctctccacacgtgcatgattcctgaagaatctcgtggcgaaatcaactgagtcccactcgacgggagcaagagattatgttgtttgttctgtataagacgatcatttcgttgtgttatcatgggcatttcactgtgtttttcatggtatagtagctatatattccaaactgatatcatgtgtactgaacaacatattcctttttttaagggacgtaatgagcatataaaaacatttgaacatgaagcagtaatcatatagctatattagaactgcatgacttcatccgttgcaattggtcagatgacccaaaatagcaggtttcaatacagtttaatcagaaattaaaaccacttaatcaaatgcaaaagggacctattgacaaatcatcacgatgagcggaactcggctaatttcgcacgagatgctccaggaatcaagtatgtgtagagagaagtggctaaatcaaaccaaggtgaattaggaggtaggaatttgcaacaaatcttcttaaggggacatttcaaatttagagtgatatttggggtgctttttggaattttcccattaaataatggaaggacgtgtgcattgtatcgctgaattgtgggacccgtttgtcagttggccatctcttatcgttttgcgtttgcattttcctgtttctttcattctttctttccccgtcgctttcatcggattcctcgtgagtgagatgcccctggcgccggcgcgccgccggtgtaggccggtggtgggggaggcaggctcaccggagcatttaccaccaccatagaagcggggcccccgccgcggaggaggagcgcaggaggcgaggcggccgccgacgcagagttgggcggggcaaccggcaacgtcctgacggacgctgtccggcgagagcgcggcgccctgaacctgaagtgaaatctccaatgctatgggctccgaagaaatcctaggtgcgttcttgagaccgatctagaagccccaaacatttcaactgcaacaatttgtccttttcatttgtcttgcagttcttgcggctgggctcaaagttttagacctgtatagaaatttatattttgttttctttcgattgcctttgcaaatcgcaattcttggctactcagaaagtcttaccacgcaaaagattaatcatatagtagtatattgtgtgctgagttttaggtgatcttggtagtaataggaggagaggctgcatgaaatccgggcacagccgtgtggaattggtgaagaacctagtcagtagtcaccatcgattattgtctgattgtctggagataggcttgctggtcatggtaagtagggatgcaagcgggacgggcaagcgggcttgtttatcccgcttatcccacttctaattcattttttcttttaaattttgtactaccatgcgaaaaatagactagcaagcaggtttttatgtgggtagcgggactacccacttgcatccctaatggtaaggtgtatgatgtatccgtgtatgcaacttgcaaggcatgtccatattctggatggatggaccctgataaaggtactagtttgtgcgaaagagtgcagctggattccatgtgccaagatgaacatttcttttccatgtggaacgaacctctcagctaccaccatgtgcattcccacccccaaattcttagaaattagcttgcatataagttggaacggtatgaagaatgaactttccatctagccacagtcgtcatggcgcgggcaatgatgttgttgctcttctgttcctatgctctggccttggtctctgctgggagcagcagcagcagcaatgccacagccgatgagctcgccctcctgtccttcaagtccatgctatcaagcccatccttgggtttgatggcatcatggaactcatccagccacttctgcagctggacaggagttagttgcagccgtcagcaacctgagaaggtcattgcgctgcaaatgaactcttgcggcctgtctgggcgcatatcgccgttcttgggcaacctatcctttctcaagacactggaccttggcaacaaccagcttgtcgggcagataccttcggagcttggtcacctcagcaagcttcggatgctgaatctgagcacaaatttgctccgaggaagcattcctgtggagatgagaggatgcaccaagctcatgacccttcacctaggcaataaccagcttcaaggtgagatcccagctgagataggttccagcttgaaaaatctcatcaatttatatcttaccagaaatcttttgtcgggagagatccctcaatctctggccgagttaccatcgctggaactgttatctttgtcgcacaataaattatctggagaggtaccatctgctttgagcaatctcacaaacctcttgaatattcgtttctccaataacatgctttcaggagtcatcccttcatctttaggcatgttgcccaatttatatgagctcagcttaggttttaacaatttatctggaccaatcccaacttctatttggaacatttcatctttgagggcgctttctgtccaaggaaatatgctaagtggaaccatacctgctaatgcatttgaaactcttccacatctcgaggaattatacatggaccacaaccacctccatggtaagattcctgtctcgctgggtaattcttccaatctgtcaatgattatccttggcgctaaccttttcaacggcattgttccccaagagattggaagactaagaaagttagaacaacttgtactgacacaaactttagttggagcgaaagaacaaaaagattgggagttcataacagcattagctaattgctcccagttacaggttttggtattgggtatgtgtgagtttggtggggttcttcctaattcactttccagtcttagcacgtcgctaaaatatctctctctttcatataacaatattttgggaagcatacctaaggatattggtaatctcttcaacctacaagtccttgacctcgcttggaactctttcatcggaactcttccttcatcccttggtaggcttaaaaacttgcactattttaacgtatacaacaatgatcttggtggaccaatcccatcgacaataggaaatctcacagagttaattacgttgtatttgatgtcaaacacctttagtggtaggttaacaaactcacttgcaaacctgacaaagttgacagaactggatctttctagtaataacttcataggcccaattcctagtggcttgttcaacatcaccacactttctatagctttggagctatcctataacaaatttgaggggtcaataccacaagaaatagggaatctcgtaaatcttgtaaaatttaatgcagagtcaaataaattatcaggtgagatccctagcacccttggacaatgccagaatctccaggatctcactctccaaaacaacatgttaaatggtaatatcccagaacaattgagtcaactaaaaagtctacaaactcttgatttctccagaaataatttgtcaggtgaaatccccatatttatagagaactttaccatgctctcttatctcaacctttcattcaatatatttaccggagaagtgccaactactggtatatttacaaattctactgcaatctcaatccaacacaatggaagactttgcgggggaataactactctacatttacctccatgttcttcccaattaccaaagaataaacataaacctgtagtaattcctattgttatttctcttgttgcaacactagccgtcctctcattgctatacatactttttgcttggcacaagaagatccaaacagaaatcccttcaactacatccatgcgaggccatcctctggtttcttattcccagttggtaaaagcaacagatgaattttccatagccaatttgttaggttctggttcatttggttctgtgtacaaaggagagctagttgctcaaattggtgaaagcccatattatgttgctgtgaaggtactaaaacttcagacttctggtgcgcttaagagttttgccgctgaatgcaatgcactgcgaaacctacggcaccgaaatctcgtgaagataattacagcctgctcaagcattgataacagcggcaatgacttcaaagcaattgttttcgactttatgcccaatggcagtttagaaggctggttacatcctgacaaagatgaccagattgatcacaaatacttgaatcttcttgagagagttggcatactacttgatgtggctaatgcgctggattatctacattgccatggaccaacacctgttgtacattgtgatctgaaaccaagcaacgtgcttttagatgctgagatggtagcacatcttggagactttggacttgcgaagattcttgttgagggcaactcattgctccaacagtctacaagctcaatgggatttagagggacaatcggctatgctcctccaggttagccttttatttttcctgtcctcctttcttatttagtcctgcctagtgcttttattaataaaatgtacagctagacaaactttttgggaagttgcaaaagaagtttgatttatgtgaagcagctatagttattatgaatctgttacattttggattacaagcgctataaaaatcgtaactttttttttggcaaactttgattaaacagagtatggtgctggaaatacggtatcaactttaggagatatttacagctatggaattcttgtgttagaaatggtaactgggaagaggcccatcgataacaaatccatacaaggattgagcctccgtgagtatgttgagctgggtctacatggtaaaatgatggatgttgttgacacccagctgttcttgggccttgagaatgaatttcaaaccgctgacgattcttcatgcaaaggaaggatcaattgcctggtcgcattactcaggcttggattgtattgctctcaggaaatgccgtcgaatagaatgttaactggagatattattaaggaattgagttcaatcaaacaatccttgtagggaacacataatatatcttcgagctgaatgacagtttggagttcattccttgggtgttcatctcttaccctttcataccttgttggtttatgcatagtacactgaagtatactgttatcacttgggatttggacatctgagcgcaaaaactgattgccatgcagttgtaatcatgcctgtaaacatatccgtgatttatgtcttttttgctaggaaaagcatttttccagtcatgtactttgtccagacataataaattactacgcaactttgtaatttgtgatcgttacaacgagtatactatgtcgtgcatctctctaacaataaatatttagtagtttataattttataatcgtgtttagctgctgtacattcctttgtaaacacggttttgaaacatcatctccgggcaacattgatgcaggcaggcgagcgtatcactgagactgaaccgtgggaccaacgtgtaagtccctccttacacgtagaccggaggcgtccggtgaccagggatgcatttgcccgggtttttttttcgcttattcgacttgtagtttatacttaacccacttttagtttattttttttctaaattttgtacaccatacgagaaataaactagcaagcggtttttatgcggataatgggaccacccacttgcatccgtaggtagtgctgccgtcgtccgccgcctgatcctgacgtcgtatatatttttttaaaaaaattactacagcttgaatgtctgtggatctactggtagaagagtattcggtgggttcataagacctcaacatttttgcttgcaattacaaaattgtgtatcaacgtcagcaacttggataacacacacgtcctgtgcatttctgcagagtacgtggttagaatttggctagatgtaagacgctcattcttggataatatactaccaaaggacctttgtactatatgaatctatgatgaatctaggagagcataactgttcaagttccatgcatatttgaggaccggtaacgtctgatttgcactttgtgtgtcgtcagctgtttttgctggggccatgtttttcacgttgcatcaagggtatcatcatccatgttatgcagctttttttgtctgtatgaagtgtggccaacttaattaattacatggcaggtctgttaacaaacaactactactccctccctccctccctattttaattttaatgtatgacgccattgatttgttgaacaacgtttgatcattcattttgttcaaattttttatacaaatacaaaaatatttatgtcatgcatgtttaaagaacatttaataataaataaagccacaataaaatagatgataatcacataatttctttaataaaatgaatggtcaagcgttgataaaaaagtcaacggcgtcatacattaaaaaacagagggcgtattatttatgtacaacattcatgattatggtatcaatatgacatttttctaattttaattcatgtgtccattttaagcttgacaccgtaccgtcacggaaatcaaagcttgtattattgcatgattaattaagtattagctaatttttttttaaaaaagaattaatataaatttttaaaataactttcatatagaaagtttttgcataaatcacaccgtttagcagtttgaaaagcgtgagcacggaaaacgagaagatgtgttggggaaatggggaaagaacacagcgtaagtgcctattatataatactacctcatgtactaaattttatactagaaagtatcttgaggtaaaaaaaattagtggtaccacgaggtataaaatgttaaacggtaaaattgctcgggataaccgtacgtgcaatgtgtccatatgcgtgtccaacacggtcagataagaaagaattacagggctagtagtcagtcgatcggtctcgcacgcaaagctatcagtcgatctgtctcgcacgcaaagtcatcagtgtcaagcaaaaaaagcatctctcattcaaagtactccgtttgatcgtcgtcagatcgtgtactgcgtgatcgttggtgcagaaccgttctcatctgcaaaaaggaatctgcgaaatttgaagggaacatattgagcaatgtactaaatttttcttactaaacttttactaacaatcatatcaactgtttgatttaagtagatggaagttaaaaaaaaatctagatacactcatagcatgacacatcagtgttagtaagaatttaataagaaaaagttagtacgtatagtattttccgaacatatatacgtttcgagttggcctcttatacttctcctgggaataacccaactgaatggacgtatggattatggattatctgactacaaagtgaaaagtttgctccaagaaaaatattccaagctaaggaactcatatatagaaagattttttttcaaaagttgtacttccaccgtcttaaaatatagcaatttttaggccgatgagatatatcctaagcctgtccagattatagaaataggatatatcgtattcaataaaaaaatattatattttagaacagagataagtattatttaggagacaggtctctttcccatgataattcatattttgtaagaggggaaaaaacagggcagcgaaagttaaggaaaaaataatagtaaaaaatatgaatatgtgataaaccgtacgtgttatagcatttccaaacttttatagtcaaatcaaataatataaaaggaatctcgctcaagaagtcaaggtcgaacatggcttcatcataactaatgagccgtatgacaagcgtatacatcaccatcttcttttcggactatcactatcaacggggatagaaatatcttaccacaaatttgagaaccaaaacttattttttaaaaatggattttagttaaatttgacaaaaattcaaatggcggttccacctctctctatatatgtaaatcacctcaaacttgattgaagttgatgaaaaaatataatttagtttctatggagaggaaaaatagagaaataaagatggccctctgaaatttcattttaagtttggttgcaattcattaaaataattttaaaatgttcccttgtagtttcttgtaaatgaagttttcacattcacaattttggttttacaaggattctgattgttagtggtgacggccggggtgtcatcttgctgctcccactcccagcacatccctcctggtggcaacgcgaactccacctttggagcgaaggagggaagaaccaaagaagatagatgggagggaaagttgaggggtaaattttgatccttgagaggatatccatcgtttgtttagaaacctcatttaaacggttatgaaaaatcctagaaaattttgataacactcatacaacatatctatacaactctataaaattttataggtccaaactcaactcacacgtcgagatataaaaaaggataaattcagcgtatgaatagtagcgtactatttacatctgaatttgtctttatttttgtttctcgatgtgtagatcgaattggagcttgattttttatgaaccgatatatatcactattctagcattgtcaaatttttaaagattttttataactatttatatcgaatttggaagaaaaagatacttgatgggatattcccttaagagattactatccactctcgggtactaaggttatttctcacccagattgctgagttgacagccaagaatggcaaaataaaaacaatccagtcggtccagatcgacctgaaaagaaaatttttggatgtcacatcggacgtttgaccggatgtcggaagagattttcggacacgaataaaaaaactaatttcataactcgcctgaaaaccgcgagacaaatttattaagcctaattaattcatcattagcacatgtgggttactgtagcacttatggctaatcatgaactaattaggctcaaaagattcgtctcgcgatttttatgcaaactgtgcaattagtctttctttttatctatatctaatgtttcatatatgtcttcaaagattcgatgtgacgtttttgggaaaaaattttttggaaagtaccgggcctaagtcacttagtaaaatggtatttgggaatatgctctcgaagaaaagagagtggcaaatagtaaaaaagaaaaatgccggaaagagatggagtgagaacatggcagcacacaggaactttcctcttaaacagatagtctaatttcctatatatcatttctccgatatgtccatgtactcccttgtacaattctgcatatatacatgctccctctatatttatcgacatagtttgatcatttgagagattatacaaagctagccttgcagcacaagctcgatcatggtcgacatggctggagaagtagcattcatctgcctcttgctggtgtgcctctgttcccactctctggctttgtctcctcctcctcctcctccttcttctccggtgagcagcaacgacgcaacaaaggccaccgtcgacgagctcgcgctgctctccattaagtccatgctctcgagcccatccagctcgccgctggcctcatggaatagtactagttccatccatcactgcagctggccgggcgtcgtctgcagccgccgccacccgggccgtgtcgccgcgctgcgcatggcctccttcaacctgtccggcgccatctcgccgttcttggccaacctgtccttcctcagggagctggacctcgccgggaaccagctcgccggcgagataccgccggagattggccgtctagggaggctcgagactgttaacctggccgccaatgctctccaaggcactctccctttgtccctgggtaactgcacgaatctcatggttcttaatctgaccagcaaccagctccaaggtgagatcccttctacaattggcgccagaatggtgaatctttacatattggacctcagacaaaatggcttttctggagagatccctctgtcgctcgccgagttgccatccttggagtttttgtttctgtacagtaacaagttatcaggagagatacccactgctctcagcaacctctccggcctcatgcatcttgatctcgacaccaacatgttgtctggagctatcccttcatctttgggcaagttatccagcttgatatggctgaatctagccaataacaacttgagtggaaccatcccttcatccatttggaacatttcttcatctctttggggccttaatattcagcaaaacaatttggttggagtggtaccaacagatgcattcaccgcacttcctgaactccggacgatatcaatggacaataaccgatttcatggccgtctccctacctctctggttaatgtctcacatgtgagaatgcttcaacttggttttaattttttcagtggcactgtcccttctgagcttggaatgttaaaaaatctggaacagttcctgctctttgccactttgcttgaagctaaagaacctagagactgggaattcatcactgcattaacaaattgctctcggctgaaaatcttggaactgggagctagtaagtttggtggggtccttcatgattcactctccaatctttccacttcattacaaactctctcccttcaatacaacacaatatcaggacgcatacctaaagatattggtaatctcattggcttacaatctcttacactagatgataactctttcataggaaccctaccttcatccttgggtaggcttcaaaatctgaatcttctatcagttcctaagaacaagattagtggatcagtcccactggccattggaaatcttacaaaacttagtagtttagaactccaagcaaacgcctttagcggtgaaataccaagcactgttgcaaaccttacaaagttgtcagcacttaaccttgctaggaataattttacaggtgcaattcctaggagattattcaacatactcagtctctccaaaattttggatatatcccacaacaatttggaggggtcaataccacaggaaattgggaatctaataaatcttgaagaattccacgcacagtcaaacatattatcaggtgaaatccctccttccttaggggaatgccaacttctccagaatgtctacctccaaaataacttcttaaatggtactatttcatcagccctgggccagctaaaaggtctagaaagtcttgacctctcaaataataagctgtcaggtcaaatacccagattcttagggaacatcagcatgcttagttatctgaatctttcattcaacaacttttccggtgaagtgccagatttcggtgttttcgcaaacatcacagcattcttaatccaaggcaatgataaactatgtggtggaatacctactctgcacttgcgtccatgttcttcaggtttaccagagaagaaacataaatttctagtaatttttatagtcaccatttctgctgttgcaatactaggcattcttctgttgctctacaagtatcttaatcggcggaagaaaaataacaccaaaaactcttcagaaacctcaatgcaagcgcatcgttcgatatctttttcgcagttggctaaagcaacagagggattctctgcaaccaatttgttgggttctgggacatttggctctgtgtacaaaggaaaaatagatggtcaaactgatgaaagtgcagaatatattgctgtgaaggtactgaaacttcaaactccaggagcacacaagagcttcgtcgcagaatgcgaagcactcaaaaatctgcgacaccggaacctagtcaaggttattacagcctgctcaagcattgataccagagggtatgacttcaaagcaatcgtttttgacttcatgcctaatggtagtttagaagattggctgcatcctaaaccagttgaccaaactgaaatgaaatacttgggtcttgtccagagagtgactattctactcgatgtggcttatgcactggattatcttcactgtcgtggtcctgctcctgttgtgcactgtgatattaaatcaagtaatgtgctcttggattctgacatggttgcccatgtgggagactttggcctagctaagattcttgctgagggaagctcatctctccaacactcaacaagctcaatgggattcagagggacaattggttatgctgctccaggtaattatctttgctttatgactttacatggagaccatctttgctcagataaagcttggctatagacaaattcatggtgaattttcagaagatatattattttactttcatgtgatttctctcctagtttttttctttatatcacttaattttaaatttcataacaagtagcaggcctgatgttctttcaatgttaaatggaacagagtatggagctggaaacatagtatccacaaatggggatatttatagctatggaatacttgtattagagacagtgactgggaagaggcctactgataacagattcagacaagggttgagccttcgtgaatatgtcgagcaagctctccatggcgagacgatggacattgttgatagccagttaactttggagctggaaaatgaatgcgcattgcaggattcttcatacaagagaaagatcgattgccttatttcacttcttaggcttggagtatcctgctctcatgaattgccattgagcagaatgcggacaacggatattgtcaatgaactgcatgccatgcgagaatctctcttgagagaatacaggattgaagatggaagttatgtcaatgtaacattggaatgatcatgtggagataccatgcagcggtaatttttaaaatattgcagacattgctgtactcccttttaaagtacacaaattttactatggtctctactagactgtaggtaaaagatacgacaaacatcttgttattttttcatctgagatggagggagtatttcagaccgactacatctgaaatactcatttctgactaaagtcctgataaaaataaaaaaaatttgcaccatatatagattaagcaccaaatactttctctgggttttacaagttgtgaaccagtaaaagtattcgaaaaaaaaacactctgttttcagtttcctccaaaattttataggattttcacatgaaaccgttcaataccttaaagttcgtgcgaaattcctccaaaccgaatagcacccttcaaggtttaaaagccaaacaaactctgccagaatgacgtgtctgattgttggcttgtcgtagtccgccaaaatttgaaatttaaacttcatttaataacttcagagtttattttggtttggcttttaaaacctgataacacggcatgaattgtttttcgttgcattatttataaaagtttagctcatgaattgtttttcgttgcattatttatatttatacggcatattggcctacctcaaccaatagaccatagctaattgagacaaacgaaacagagcaggctagagctcaagtattcaccctccatgccatttcagtgcgacaaaaacagcgaaaagaccactgtcaagttggtcccacatttcagtgcgcaatctttttctcttataattaattaaccaacgatgcctccaatctgtcatgaaatggttttgggcaacaagagttcattagtacaagttacaacctccaacagaagtactactacaactacaagtcacaagaaactaaatgataaatatagattggttagtgggtataaatataatttaaggctgaaaatgccataagcaaaaacttcagtctaaaatcatcgaaattatcatgcgaattaaagtatagctttgtttggtagtttggtatcatgcagactgtacccagaaatgaagggaatactcattttgcttagtactcttgtataaaattatcaaaggtatatgccagactgtagaagcatgactgcaactggccacactgtaaacaatttggatttgatccaaattaattgcatcaaaagaaacttaacagaaatatttattcagtggaccatcagtgatccagttatcataggatacaaatggttggaatgaccactacaggactcagctccagatacttaagagggagctcaagaatatccatgacagatttattagaacataaaagtatcccagcagaaaaataaaatgcagtgtcttcacttttctgtaccctctatttccagcaatagagattccttgattccatgcagttccttaatgatctctccagttgataatctactcgatggcatttcctggagcaagaaagtcctaatctaagtaatgaaatcaggcaatcgatcttttgcttgcttgaaaaatcataggtgtctcaggatcatgctgatcaatgcccagacacagtttgttgtcaacaatgtccatcattttaccatctaaacccagccttatagactcaacgccgacaatggggctgtctaagaagacagtgagtgccagcatcactttgctttttagccctaagaagcccgaggaatcaaagattccaattccaaaggaagtgatcgatcatttcataaagtgtgcacaaccttagccacccaagaaacctatatcggacttccgaagaactattacaaaaacaaggatctgcagactcagtctaaggagttgtaacttgcagagaaagcggacgagacagctgcattctgtaagtcaaccagtctaaacagccttgacgatctggataatcttgaggaggccgaattggtactgcagttccaacatggaaaactcatggtgcttgaatcggaacttggataattaggaactcaagcatggtggctgcataattggtatttggaggcggctgctcagggtcaacaaatgattggagcgtactacactgacatcgattttcaccacgcgcccaatacatgttatttggaatttaagcacaggtggagaaacgttttttacttccggttcgtaatccctttagtcccggttttccaaccagaactacgaatccgggactaaagatcactatctctagtcccgggtgaaataaccggaagtaaagatcgatctttagttaccaaccgagactaaagataggttacgaactcttcagcgtgtatgaaagaagagagctcgacatcagcgtcctccaaatgtggtcaatgtaagtccttcatatcctataattaggcttagtgattttgaaccgtgttcttcttttgcaggcattgctcttttgaatgtcaaagcaaaaaccttaagattgcttttctttacccagtggttgtgaacttcgataggcaattgtccaaagaagctgaaatcgagaactatcacttggacgccctcatcaagctcaattcctgtgaccacatcatccttccttaccttgctcaataagtgaatatcattaatttcaaatttgagttgctccccacgcgtataaagttattgatacattgtcctatgtgtagccattattgaaccctgatcgtaatcaatatcgacgatagtaagattttcatatatgacagtataagggcagtcccaaccctccacctaggatggtgtctatggcattaactacattgccatgtaggatttttacttatgtgtcactatattaattaagagagagagtgaagagaggaagaaactgggtctcatgtaagacacagcttcaacacaagaacttatgcactaaacactatcaagtttcgcattgggagagaatagtgtcttcataatagatgaagaataaatatgattggtagagaagagagatgatgtatttattaatggcccactttaagaaaccatgggttgtagagtatagtttctattatgatgtcttattgacatggcaccataaacactacttatggacactatgggttgggactgccctaaggaaggagagagcgcaccaccagtgtcttatcaatttattaaataggacatatatgagataccgttggtccggaagatcatatcgtagatcctaggtggatgcaataacattttggccgggtattcaaacatcaatggatccatagacagccacctgccaccaacctttgcggcttctacgtcatggggtccctgcacggctgcaccctaatgatgaggtatgctatttttcacaggaccatgccaccaacctttgcggcttctacgtcatggggtccctgtacggctgcaccctaataatgaggtatgctatttttcacaggaccaagtcataaagtaaacaatgtttttctaatactaagttttacgccttcctcccctgtgttgcggaaattgggtctcgacacatctttacaggtatcaccaaatgagctctgtgggttcattcataatcatattatagacccagctggcgaggacaacgtcaacaaagaaccaccagtatcacaatcactaggtgaaaccccgcgtgttgctgcaggagtttactataacactaagtaaaactaatgcgtaagatagctagacaatataaacttacataagttgatgtggtttacgataatttaaatttaaataatgtatagaatgataattcaaatgtaaaagtaaggtgatgcggctttaagagagaaaaaggagggagatagtttggaccatagattaatcatcttagacgacttaatgagagaggagagaaaaataacgctaagtgaggataaactatataggaatgtttagatttagtaacctttgacttaggatatactagaaaatgggcgcgtcgttggcacgccaactaatataacccgcggatattataatctatttatttagaatgtatgaataatatcatgttaagttatcatattactttttaagtatatatgaactggaataagaatgaatcaagcgacggtaattgtggtgttatttctcatatttatgttttgagaaatataggaatgtttatttactgataaacatatcacactaagattagcataatttggacaatgattttaatgtttatcttagttgtgcagatcaagcatcaggctagctattggagccgcatcttacatagccaccgcatcaggccatcacctcatgatggaatccactcaacctcatctgtgggcaggtgcgacaagatcaacatcaaacaacggcagaggcgcgccgggccaagagctcttccggcgttgttgcagtgcatcacccacagatatgacactgggttggcgggtagatcgagtgctttctctaggatttttcccttccttttttacatttttctactcacactgatttttttattagttttgatcgattgaagacgacaaatgggaacttcttctttcatgctttgatgtctatttttatttcaatttgaagagattgcaagggatagtaagtttggaatcctctagaatttaaatgaatgtttgcacgggagactacacaaggttctccaccttctctcaatatagacacgtggcagatttaggaggggttcaaacccaaatattagggcgccatgtggcccaatgggatgccagggattggaccttgaaatcggtattaaagatatgcaaattttagatttaggaatggctttggactttgttattttacacctaggaaggtttagacttataattgttgacttaggcatttactcttttttaacatttctatgtgttgatatatatgtgaatgtggatgtcgatgtagatgtggatggggttgtgggatgtaaatttggatatggctataatgtgaatgaatttgtgtgaatgtgaatgaatgtgattcgaggcaaattctgttatcgtatgatttgtatataaaattggaaggtcctgcccttttttttattgtcaacatataggtgccggtttttacatataagccggcacatatactaattgccacatgtccagttcagttaaaaaccagcacctatatgctacttataggtgccggttttggtaaagaaccggcaccaatatggtcagccacatggcaagttattttagaaccggcacctataattatacatatataggtgtcggttcttgggtgaaaaccggcacctatatctaggggtgaaaatggcacgggtattgcctgaccacccatcggacccaagactcacgggaggaatatatatgggagaaaaaaatgagatactcgatactatctgagttcgaatccaaattcgttagaaaatatgggttaggatacgagaagacgtgtatccgccccgtatgtcccatgttataaaacatgtatgaaaatctattataaatcaagctacaaacatgataaaagatagattaatcactattttacgagctcacatgtaatattgtataatttttctctttatgtatctcttttaatactttaattgccttattatatttaatatccatgaattagagatacaagcagatatccattcctgaatccaattcaaaggaaacaatatgggataggatacatgataagtccgtatcaggctccgaatttaaaggaaaatatggtttaggatatgggaatgtcatgattcaaccgtacccgtccgttttcacccctgcttatatctcttaaccgatgaccgaaattatcggccccacctactgggtgtcggttacctaaggggttcctaaccggtaccaatgagttttctgtagtagtaatatttggtaatttccaggagtatcgaagcagaaatcatacatagcaagcaaaagtcgttgagcaacatgacaccaattgttccacttgcaacaacacggtttcatcggttctattttctcctgcatgtacgaacactcttaataagtttaataagtgtccgtagtttctattaaagcaaaggctggattttaagtttgtatggaaatcgcgagacgaatattttgagcctaattagtccatgattagccataagtgctacagtaacccgcatgtgctaatgattgattaattaggcttgataattcgtctcatggtttccagacgagttattaaattagttttttcattcatataaaaaaacccattcatatccaagtgatattccgtcgaacgttcgatgtgacacctataaaaactaaacgcaccctaatttaaagaaccgagttgtgaggtctatactgatagtcaagtcaacgcccaactgcgacaatcgtatgtacgccaacttggacgtgccattcaattcggtgcaatgcatacgacggggcgacgccttcgttatcttatcagtcacacgctagctagggtcatctaattaaaccagccgacgacttggatctttcaaaaaaaaaaaccaaacagctgaccacatccgatcgactttgactatggtcataggttgcgttatttaaaattgatgaatgtaattacatactaaggccctatttggtagggctccaaaatctaactttgagctctaaactctaacttcagtgatagctagctcctattagagatgaaaatttgttgaaaaatgtttggctacgttttagctctagatctggaaaaaaaaaagaaaaaaaacagccgtcggccccaggcgcgccgccaacccgccggccgcttgccgtccccaggcacgccgcccgtcgtctccgcgcgtgctcgcgtcgatccgccggccgcgcgacatccccaggtgcacgccgcccgccgccgccgccacccccgcagctcggttgggatcaggaggaagatggggaggagagagaacaggagaggagtgaagggtagttgagtggtatttttgtgtaaatagacttaaaagattaaagggtagtgggtcttttgggatggagtgaagcaatggagcagcaaaactccaactccacccctgtagttcattttctaggggtagctctgctagatctactccaaaagacgaggatctgtaccgtttggcaattggcacagctctggctcgaagtaagttagagttgggagctcgaaacgggcaacggtggatacagtggtcccgggaccacctgaaaaaagggcgatcgactcactattaaaaaaaatagcgactattgaaaagaaaaaaaagcgatataatcccccttcccgactcccgacgccctaactatggctcacaggtcccacacgtgagtcgcgacgtgcgtgtatcgaatcgatcgacacaactctctctgtctctctcctcatcgccctagcccgtagccccgggccatagcccatagcgaggacgccgcgacgcgagcagccgatcacggaggcagagccacaccgccgccagccgcccagcccatgcgcgacccggagcccgcgcccccacgctcgcgccgccgcaaacggggcctatatgttataaaactaacaactagttcaaacacaagttacctaagaaacgttgatatccaaaatttttaaagaaatcatacttttgaaaacatggcataaataatccgcacaaaaatctacatatgtaatctaaaacgacagtgcttgattatttatatactacttcaaaaaagatagtgatgatgttagtaaatctgtctccccacttactataattgtagtttagaaaattatcccttaatttcttaatattaaaaaattcaaatctaaatagataatgacatataaaatcaaatcaaatcaaatcaaattaaatattccttataacaaaagatggctaacatatttaattaaaagtatatttttgtttatttctggtaatattataataatattttcttttattccaagcaaagtatgtaaggtcattcctaattaagctataaagagttgctaaggtcattctggtcattcgtaagtataaattgagctaagagggttggccgtgcacatacagaccgccgatgctgtcgtccactattagtctattactccacaagtagtatctctacgtgtgccccgatgaacatgaatcccaccagtaagccattgctcctcctcggcagccttctcctcctagctgccagcactttacccctgcaggcaacgaccgcctgcgtgccacgggaatgggatgccctgttggccttcaagcgaggcatcaccagcgaccccttaggcctcctcacctcatggaaggaagacgatcatgactgctgccggtggagaggcgtcacctgtagcaacctcaccggccacgtcctcaggcttcacctcaatggcggatatgaccttgaccgtttcgagttggttggtttggttggagagataagccctcagctgctccacttggaccatattgaacaccttgatctcagcatcaattccctggaagggccaagtggtcaaatccccaagttcttgggctctatgaacagcttgagatatctgaatctctcgagcataccattcaccggtacggtgcctcctcaactcggtaatctttcaaatttgcgatatcttgacctttccgatatgaagggaggtgtgcacttaacagatatatcatggttgccgcgtctaggatcgttaaaattcctcaatttaacttacatagatcttagcgctgcatctgattggccttacgtcatgaacatgatcccatccttaagagtcctcagtttatcattttgccgtctccagagggcaaaccaatcactcacacacttcaacctcacaaaacttgagaagctcgatctgtccatgaattactttgaccacccgtatgcatcttgttggttctggaacttaacaatcctcaagttcctcgatctttcacaaaaccgtttgtatgatcagctaccaattgcactaggagacatgacgtccctcagagtccttagaatttcaaataacgatttgggcagtatggcaccaaacttgctgaggaacctatgtaatttggaagttctagaccttgatgagagtctttcgggagggaacatgacagagttgtttgggagtctaccacaatgttcatcgagtaagttatcggaattgaaaatgtcatacaataacatcaatggatctctaccagcagggttgttccgacagtttcccaaccttgtcactctcgacatgtctatcaacctaatcactggacctctacccgttgagataggtatgctcgatagtttgacttatttgaacctacgtggcaataacctagaaggtgtcatcacagaagaacactttgttagcctaaagagtttaaaatacatagatttatctgacaatcaattattgaagattgtggtggatcctggatggttagcaccatttacattagaagaagcacgttttgcatcttgccagatgggtcctcgatttccctctttggctccagtgtcagttaatatttcgtacattgatatttcaaaagctggtataatcgataaacttccagtctggttttggacaacagtttcaaaagtaaaagacttggtcatgtctaacaaccaaatcagtggtgtctttccagcaaatatggaaaccatggctatggaatatcttgatatacgttcaaacaaactaagtggtcaaatacctctgttgccgagaaacctttcagcattggatattcacaataactccctatctggaccgctaccatcagaatttggagttaatatatacatgctaattctttcccacaaccatttgtcaggccatattccagggtctttctgcaaaatgcaatacctggacaccatagacttagcaaacaatctttttgaaggagacttccctcagcaatgttttagcatgaaaaacataaaagttcttcttttaagtaacaacagattcgctggcacattcccagcttttctagaaggctgcatacagctacaaatcatagatctatcaaggaacaatttctccagcaaattaccgaagtggataggagacaagaaggatttagtgttgttacgactaagctataatgctttttctggggttattccagacaatatcacaaatctccgaatcttcgccagttggacctagcagccaacagtttatcaggtaacttaccgcggagtttcacaaaattagaggggatgaagcgagaggacggctacaatgcttcaggttccgtacctgaagatggcttgtcatcaaactgcttaattggtggaattcccgaacaaatagcttctcttgctgctttgaaaaatctgaatttgtcaaggaataacttgaatggaaaaattccatacaagattggatcattgcagtcactggaatcgctcgagctctcaaggaacaatctttctggagagatcccatctaccctatcaaatttatcatatttgagcaatttggatctgtcgtacaacaatctatcaggaacaataccctccggatcacaacttggcaccctatacatggaacatcctgatatgtataatgggcaccattggtctatgtgggccctcctcttcgaaggaactgctcgggagatattgaaccaaggcaacatggctatggtgatgacaactattgttcaatttggggaatttttctagggttagcttactcagctcaccccttccctcatctattctattagcataacactttacagataggtccttagtacaacacatatttacaccaacactcctcctcaagatgggcaaagatatcaatcatacccatcttgttacatattgattgaatctcactaggacctaacccctttgttagacaatcagctagttgttcacatgacttaatatactccaacctaatcaccccgctatcaatcttctccttaatgaagaacctatcaatctccacatgtttagtgcgatcatgctgaacagggttgtttgcaatgctgatggctgatttattgtcacaatgaagcatcacagtgtcacttcttagcactcgcaattcagtcaacaagctcctcatccacaacatctcactcaagctcaaagccatagctctgtattctgcttctgcggtagaccgagccaccactgcctgcttcttgcttcgccaagaaacaagattaccaccaacaaacacacaataacctgatgtagatcttctatcatccatactactcgcccaatcagcatcacaatatccttccacatttagatgcccattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcacgacacccaagcattcctatatctgtcaacagatccaaaacatacttcctctgagagagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagatagtgtgatctccattacactgagaataccccatatcacacactgcatgcctgaacctatcaaaccatgcacgtggagactgcttcaacccatacaaggatttcttgagtttacatacttttccaactgtctggctattcccaaatcctggagggatctccatgtagacctcctcatgtaaatcaccatggagaaatgcatttttcacatcaagctgatgaaggggccacccaaagttcaccgcacaagataccaaacctctcactgtacccatttttgccactggtgcaaatatctcatcatagtcaattccatatgtttgactgtagccttttgcaactaaccttgctttatacctat

SEQ ID NO: 32734 - DNA, 22074 bp, Oryza sativa
  unsure (1)..(22074): unsure at all n locations
tgcatctttccactttggatcctgctttgcacacttccaatcctttggtataggcactgtctgtaatgatgcaataaatgttttgtatgctggtgaaacatgagaatatgtgatatagtttgcaatgtcatgcatagaactaagatgctcaaaaccaagacgtataggaggtctactagcattagatctagtctctctacgttgtgcaagaggtaattctacatgttcaagagttggagaagtattaccaattgtctcaagagaagccaaggaggctggaggagagagactctgggaggattcagagactggacattttgggtgtggtaactcttcaatttgactttgcactaacccttttcttttctccccctgactatcaaaccgcctcctttggtaaactagcacatccttttgtttcaccctttcggctccctccataggacatggaattgtcccaacaactacttctccttcttctccatcctcttcatgagggaccatttctctatcctcatcttgtgtatcttcaatgacttccactacttctttactcgcatcatcaatagagcatggtattgatccaatcactactgcctctccattcttgtcaccaacatttttttcatgtatgtcacctctctctctctctccccctctcgactatcaacctccatgacagtcgagaattcctcaagaaattggtcaagatctcctttacttttataatagggctcaactcacgaaatgtcacatccatactcacaaacagtcttctctcaatgggatcccaacatttataccccttctgactcgaagcatagccaacaaacacacactttactgcatgaggatctaacttgccaacagaaggtcggtgatctcgcacaaaacaaacacagccaaacacctttggaggaaccttgaactctcgcttacccaataacagttcggcaggagacttcataccaagtattctagaaggcatgcgattgataagatatgctgctgtcatcacagcctcactccatagatactttggtacattcatctggaacatcagagatcttgccacttctagcaaatgccgattctttctctcagctacaccattttgaggaggggtgccaggacaagtagtctggtgaataatcccctcatctgagacatatgacacaaattcattattgatatattctgttccattatcagtccgaataatcttaacttttgcatcaaactgagttgtcactaatttatgaaagtcttgaaagcaacgaaggacctcacttttgtgtttaagcatataaatccaagtcatacgagtgtgacaatcaataaaggtgacaaaccacttgaaaccactcacagaagtaactgggcatggttcccaaacatcagaatgtattaatatgaagggctcacagttacgaagaccaattccaacatatgtagagcgagtatgtttgccaagctcacaagcatcacacaccaatctatgcttatccactctactaaagaggtctggatacaacttactcaaaatctcaaaagatggatgtcctaactgacagtgaagcaaactgatctccttctcaacatctccaaccaccgcagctagtcccagttcctcatgattgatgtaccacaacccatcacgcctgactccagtcccaatcctcctcccagtccccttctcctggaacagacaagaattctcatcaaatacaacaatgcacttgagttgatcaatagccgagctaactgagagaatgttaactggaaaggaaggaacatgcagaacagaagacaagttcattgatgatgtgcactctaccgaccctataccatgaataggcttggatgtaccatcagcgatttggatagtttcagagtggatataaggagtgtatgatgtgaaagtattatgcaatcctgtgacatgctttgatgctcctgagtctatgatccaatctataggatgtctatgtagatgcaagtgcctgtgcctgagtaccttcgcccacttgggcgtagttggcgaagttaccaaagtgagtggtggtgttagagctctcattggtcttgttcttctaccattcctcccattgtgtcacttgttcacctattagggtaacagctttcccatcctccgtagctgcattggcctgaggaacacctctgcccctaccacgacctccaacacgacctccacgatcacctcctctaccaccacgatttcccccaaaaccaccacggtctcctccaaatccaccacgagttccaccatgccctcctcgaatcgatcccctaccaccaatgttccgggaagtgggacaattgtagctcacatgacccacttgcccacaattgtagcattccctattatcagctgcaatgtatgctgatcttatagaatttgtacctctcatcaacctcaatctcatctcttcctgcaccattgctgaaatggcctcttccatagtgggcaatgtagcttggtggaacatagctgctctccttgtcacatcctgattttttgtttcaggatttataaattatttaataaattattaatagaatttatattaaatgttctttaagttacaagtgaagttaaatgtgggaaataaaatttcctaaatataaagcatggatggatttaatttttattaaattctccatggttaagtcaactctctgaaattttctcggatttttcagagctcaattcttaaataatacaaagaacagttcagtaattatttgatcattgatgatctaattatatttgttaagagcttttcttgtttaaaatccttaaattataaattgttgtttaaaaggaattattagaaatgattttaaaagcttaaaagagaagatctaattttaatttgctaaatctcaacataaaattgggctagataaaattttgttaaatactttgcttaattctataattcctagatttttctgggatttatttgagctaaggaagtatttttaataaatggaattgcatttaagaaataatttaaattgaaaaaaaggttttaaaagtcttcttttggctttgggccgaaagccggcccaaaacccttctctctctctttccctcggcccagccggcccagtccgccgagccgccgctctccactctctctctgccgctgacaggtgggccccgcttgtcaggttcgtcgttctccttcggccgccgccgcccgcaaaccctagcgcgccgccgccgccttctccttccaaattcggccgcgcctttccttctccggccgaattgtttgagggcaaatgatccttgagatctcctcttccttttctcttttggaaacatcggctaattttctttggaaaccggtggattcgagtttgaatcggattcctctctctctcccgaacccgatctttcctttccgtcgccggcagtcgtgggccttcgccgccgcctccttgcacctatataaggacccccgagctctcctctacccgccgcctctctcgccttcgcctctcgtcgtccgtatcgccctagcgccgtgtgccctagcgccgccgtcgccgccgtcgctccagccgtgcgccgccgccgttccagacgtcgccgtcgctcgggaagaccgccatcgggttcgcaacgtcgtcgccgtccccgtccaccgcttcgccgccgccgaagaccgccggagcgccgtcgccgtcgtcgacccgaagagcttcgccgcttcctcctcgtcgccgccgccgtccgttggtcttccgccgacgttttggtcaccggtgagttcgccgcgtcgtcctctacgtcctggtgctctccgttcgcgtcgccgtgccgccgttcgccggcgagcatgcgcgcccaagccgcccgagtcgccgctggtgctgacgtcatcgctgacgtcatcggagccgttcaccgtgagccggtcgtggaccgatcgatctcggccgtccgcattggatcaagtcgatctcggccgtccgttcccgtgaaccgtcgcccgtgcgcccggtccaccgaaaccctagccgctggcgcaataatcctccttttccttttcaaaaataattcattattgcgtcataattcaattaaaatccatataagtgttttaatccgatttaatctttaaaaattcatatctaattcatcttaactcagtttaatgtggttcaagttgcaaaagttgtgtaaaataaagatctacatattaaaattgtccacaaattgaattaaattcatttaattctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttcctcgttttgcgtgttagcttgtcgtttccgttgttgcgaaggttcgcgagtgcgccggaagtattcaagaagattaattgaagaccgattattgcaaggcaagtcacacagatcctaaacacaattcctttgagcatgttgatcctatatttaaattctctatttatttcaactgtgcatttattttcgaatgtcactgggtggtgtgaacctattcctttgttatggcctgtttgcattgattactttattccttgataccttgggtgattataacttgactagttgagctttatatattggttcagctagatattagatgtgattgcttagccatgcttagaaacattagcacacaattgggataactaatgtttcactatcacttatggttatatttaatggtagctcacgatggtcaatcgtgattggttaattaattacttgtcaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtctcacacctctcacaataattattgatgctataactggtaataatttgcttagctcctggtttggagttagatctgttcagccgggtatggttgttcagaatggttgggcctgtgcagcatgggtgtgctgttcagtgttgattaaaattcctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccaaaaggagaagacgtttggcttataccccagttgagctgcctgtgggagtggagccggagcttcgctagattttatttttccgctgcagttttcttcttgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacactcctatcctcaaactccttgttcaaccccttcaagaaatgaatgactcttcgcctctgcagccatttatttccaatcacaatgtcatcctcatgtttcaattgtaagggatcatagtggtcaagatttgcccataactgttgcagctcgctagcgtactctttgactgttctcctctcttgcttcaaattctccactttgttctgagcctcaaccatcatcattacatttccctctcctgaatacatgttgctcagcgtcttccatacaactgcagcattctggatagcttctatcatcctgccaatagaaggagccaccggttcatcaaccaagataccacagtggaatttgtagtattccacgtcctccatgcttggctctccttatcagaaggttcttcacaactctctagtaaaaaatgatccaccccttttgctctcaacatcagttgggctctcctacaccaactcaaataatttttgctcccctccaacctcaactcatttggcatcaattctagtttcacttcagacactccagccgcattcctaggacctatcatgcccatcttcagcaaatcttctagcaaacctttcatatcacctttagtaacaagcaagaaagtatccacaacctcctttccctccccagaagacattttttttttcttcccttagcttcttctttaccacattaacagagatacaacaaggaccagacttcaatcccccatggcagatcaaatattagccaaatcaactaataggagcaacaacactactcctcagtttctcaccaaaacagaacagcagcaatagcactacttctcagttttcagcacagcagcaagtactcagtttcttccccaaatcagcacagcagcagcaaatacagtagcaacagcaagccaagcgcccacttcaccttctcaagtagcagcagcaccaacacctcaccagcagcagcaacaacctgctcctctgccacacgccgtcaccagctagccctccgcacgcgtcgtcgccgttggtgctccctgccgtcgacaccgtcgcttcctcactccacgtcctgccttagcagcgctgccgtcctgcgccggcacagcgccgcttcctgccgcggccaccaaccgtctccaccgcgtgcggccacgctggcctcgcgcgtgcgtcgtcgcgccgcgccaacctcgcctcggcccgcgccgctgcgacctcgccagctagggttcaacctccccagtcgccgttgacccgctctgataccatattgttcaatttggggaatttttctagggttagcctactcagctcaccccttccttatctattctattagcataacactttacagataggtccttagtacaatacatatttacaccaacaacaacaaagctggacatgtacctgagccaatgttcttttatcttggccttgtgtcaggattcattgctggcctatgggtggtgttttgcatcatactcttcaagaagacatggaggattgcatatttccgtatttttgacaaggtttacgacaaaatatatgtgttagctgttgttacttgggccagtttattccaaaagatgactgcacaataagctaattagaaagcttgagtagaatggtgtgcgtatttgccgcaggccggtgtggtggaatgttttctgcgcgtgatgcatgattatttagctttgcgtgttatttattaataagattatggcgtattacttttttcatctatctattatattattaagacagctcgaaaagaagacaccacgttcaccgtggaggctagaaattcctacattaatcgaaaaaaatatgaattatttacaccattggattataagaggcatagattttaatgtctgagatttaacacaaacttgacatgttaattaagggatacggagtaccgtacacgtgtagaattagaatcaatctctagctagaacctttacatgcaaacggactcaaaagagttttgtccgatttcctaaaccaatttgaattaggctataatacacatatataaatgaagcagcaggcaacgaaccactgtacaaccgtaatttggatgtgtttttgttgatacggagatagatgctggcagcgggtcaagccgtgcggctgcacaatgagccggatttgggtgatgcacgtcagcaaccagaaaagcatgatggcatgtgcacggattttttatttgattctgaaataataacacaataaaaaattcatagaagagttcatgtagaacacaattaaagattaattaaaatccgtaataaaaaataaaataaatttagaaactagaaaaatcaaatataagagttcaagtaaaaatacattttgcaaacaactgaaattagaaataaaaaataagaagtattagaagaataattcatatagacacagtatgagattaatagaaaaaaaataaatttcacaattaaaaaaagaaaaagaagagtacatctagtctaggaatataatttataaacaacaaaaattcgaaattaaagaaaagattgttgaaagaaaatatcatctagaacccatcatgagataaattaaaaatcgaaataaaaataaaataaattttgaaaatataaaataattatataagagtgcaagtatgaataaaatttataaataacaaaacatcggaatgaaaaatatgatttttttttttaaaaaaaaggtccatataaaacgcaacaatgataaatgataataaagagggaaaaacaataagttaataaaggagtagggtgatgatgcatgatgagacctataaaaactataaacaaaatctcaaatagaaatccaatgacaaataagatgagggacgattggctggacttttaaaaagtaaaaaagtaaaccccagtgataattatgttcgatttttaaaatctcaatgataataaaaaggggatttagcgggtgggccgtagaggattacagtggtggagctgatgactgtttgaccgaacttctagaaagtaaagaaaaagaacaccaataataattttgttcgattgttaaaatcccaatagcaataaagatgagaggtagcgggcggaccatagaggatccaactggacaataaactctaaaagctataagatctaatttgtaaaggctccaatgagaatgaatagaaacaatggtagatcaagcaagcaaattaagaatggtagatcaagcaagcaaattaagaatgatatgacagaagtaaggggtagcaactggtgtgacttttaaaaactataaaattagaaacacggggatgataaggtttggtcttttaaaagacaacgagataaccatttaataaattttaagtaaaatcatataaaatatatatatatgtagtgctagccgcgcaattgcgcgggccacccagctagttactagaatgtatactcgttttaatttttaataacagcattttaatgtttcttttgtattagcttgttattgattcctttataaatatgtataatacagcttatcgcggaacattgtaagtttgtaacaatgtggcactttgctctctagcttaggtgcagaggatatatattctaggggcaattatgttcttgcccctgctttgaattgcaattgtgattttgtcattgttttttagggtttgtgaatttaccctcacttttttaatcgaaactaccgtttgtccttattttagaatttagatggctattaggtgggaccaaaacttagcgagtaaatgaaaaataaaataaaactgatctacaaaatacgataggaccactatacgtacccttggaccaaatgtccttacgagccacctcaacaccagcccgttcccatcccggcagaatcagttgcgtcgtggcggcgagcaggcggcggcgcggcgcagattgcgcaggttgcgagcaggcggcgcggataggtggagaacggggtggcggcgagcaggtgcatcgcagatggcggggggaggcgaatcaaggagcaggcagcagcagcctacgcgggcagggcgcgtgacggcgcagagtgtgaggctgtgagcaggcggccgtgtgcgagcatgctgggaacagggccgcgagcaggcctctgcatctcaccgcgtgctggttaattatcttgttttctttgggtcgattttgattcggtttggttcgtctatgcgtaggattacatctccactgtgttcgacaacttcattgccaatgtctctagacggcagcttgatttttcctctaatgtttagtcatctgtgcctagagaaacagaacttagcaaagatatatgcaaaacaaaggggcgaaatatgaaaggatatacacgtctttttatctcatacttcctctgtttcagatcttaagattttttagcattgaccacattcatacagatgttaatgaatttaggcacacatatatgtttggattcattaacatatatatgaatatggacaatagcaaaaagttttataaccgtggaggtagtagttaacactgttaaatcattttaacataataaaggtaacactgagtgatcatttcgaagaaatgaaggcaaaatacaaaccctaaaaacgagggtaaaatcacaattccagttcaaagtaggggcaagaatacaattgcccatatattctattattaaaagggttaatttgatccgtgccattaaaaagtatcatttcaactaaatattgctactattcgtctattcgcaaccataccaaatacgtaaaagatttagttcgatgccatgccgtatggctcggtttgactcattttcttcgtaacgtgtttttgtatatggttgtaattacccttgcatacttggctgtagcagctagtgggttcggttctctcgacgccgatgaccccctcctgccggcggcctttctgctggtcctcgccgtcgcctgcgactcacaccgcttcaacatcaccctccctcccttcccactgcatgcagcagccagcgacaagggagatggccacggctgtgtagggtagacctgcagtagccggcgtcaagggagacggccacgacgacatatccatgtccgcagtggcgagcaagctggtgtcgaggaagatggcgattggggtcggtcttggcgtcgccggcggcccacagcaattaattggaggcggtggactgaccaacgccgaaactagcgaccgcgagacagggttttcaatttcgaaattggattttatgctgggggtgaccaaaattttggaaatttctggccgaaattatttgaaaatttgactgaatttaaataaaatttgaccaaattcacaaaaaaattgtaaaaaacctaaaatttcgggcgagatttgagcacaccggtgggggacgaaattaccgaaatttcggaaattatgaaccgaaatttcaaaccctaccgcgagatcagtaactaaaaatccgagatcaaaacgatgttgccactaaacgctcttgatttctcaacgaaacccaacaaaacgaggagtttctaaaacagcgattaaaatctctccagcaaccaaagcggaccccattttgaccagcgaagcatgtcaatcaacatggacctcgtcgacgtacgagtgctccggccgccaagtccccacagtagccaggtgcaggcaaagccgagcggagaggagaatggataacctcgccgacgagtgcgctaccactgccgcaagaggtgaacggcaactcctcgtggtgggagttcagtggggatttggaagggaatgacgtctgggacccatgtgtcaacgatgtggaaagaagacatgtaacaggggtattttgggcaatacgaaatgccatggcctgcacgtgggtccactagagtctaggtgtagaaaatggcatatctcatactccctccatctctaattatacttagggattatgattggatataacacatgctaatataacgaatttgacatacatgaagtacaacgaatctagacaggatgcttttccagattcatcatattaccatatatcacatccaatcaaaatcccttgtatttagggacggagggaggacactgaaagaattacttggtttcacatagatgatagtagtgatacttttataaatactagaaaaaaatatccgtgcttgtaacgggtgaagtctattttaattttattattgttatatggcttagttaagatgaaattcactatgggaattcgccacgatatatatattttagaaaatcatgaggtgtagttaggagtacgatcgtctcaagttagcatgcgagtttttttaaacaaatttcttatgtgattccttttgtattatcaaaagtaaacgatattaaaaacgactcaaatacggatatgtatttccaaaatcaaactaacttaaaagccgactcatagacggatgacgtaccaaaataccggcaaaaacatcttcaatttttataataatagagatagagatagagatagagatatcaaatttacaatgacatggatcaaatttatcctttctaatatgccatgtttataaaggcatggttcaaattaaccctattttcatcataaataggagttctcaggaccttttcttttactatcgtatcgctcaattatgggaccaacttgtcactgaccatttcttgtcgtttactccctccgtctcattagtaactatgagtttctatgcttaactatgatcttccgtcttatttgaaaaatttttatgattagcatttttctattattagatgataaacataaatattactttatacatgacttctatttttaattttattaaataaaaagtaaataaaacggacgatcgaacttgcaccgaaaattatggctatacttagattgggacgtaggagtatcatttttttcctgtctgtctctctccaccgcttttcgtcgagattcccccgtgagatgcctctgaagccgacgagattgccgccaccggcgccggcgtcggtgcagtccagtgcgcggagaggcaggcccaccggcggcggatgaggcgcaggagatggccgccgagtgggatggagaggggagcgcggcggcctgaggcgctcgctgccggaatttccaagggcgacgggcaaagagggaggaatcttaggtgcgttcatgagactgatctagaatccccaacatttaacctcaaaaattattattattatttttcttttgaaaaaaaaattgtcttgcatacagagattcttgcgactcagaaattaagtttagacttgtagaaattttgggggaacacatatgatgtcgggattgagtggcgataacactgctcatgttgttgtattgttgaacttgatctagaggtcgtatgcaaattcaggagaaatcatattaaattgagttgaaaccagtgactacctcgactcgactgagacagctttgttgatgattatagtgatttaatatgcagaaaattggcaatgtaaatagcaaggactactcatgctgctcatcagactgcattattttgtagtcactaatcttatttcgaacaaactttttgtcgagatgaccgaagaagatcatccaaatattataaagatagagggaaaaaaaggttagaagaaggttttttatcgaagcacaccaaacgttttgtcgagaaatgatgtgcaccaaagcgcatgccccttgactacttgttgaatgaaaacaaaagtgcatgactgactggagaacacaaaatgattatatattttgcaagtggcctgctttgattaaaaagacaggaaattatttgccaaaagctgtctggtaggaactgggcagtttcagtactaccgcatgcatccatagttccatacgttagatcaactgattgcattgaccctccagtggactggaagtagcaatgaaatgaccggtcgccgacatattcctgatgtggacacaagtagcacatatatacattctattctcgccgtatttagtttctaagtttttcttcaaacttccaacttttttatcacattgaaactttcttacacacacaaactttcaactttttctgtcacatcgttccaatttcaaccaaacttccaattttggtatgaactaaatacatcctctttgtttgctggggatcagaagaataactcaaggtttttctatatataaagaaccctttaatatatgcaaatgcattcttgcagccacttgtcatcctcaagtcgatcagcacaagagcaaggtgggaagacagggtagtcggcttgcatgcctgcatgtcgacaattcaggtccccacaggaaatcttctagagaaaggcagcccaacacaaagtattctactcacttcgttccattttaagcatagctataagttttttcgtgtctaactttgatcgttcgacttatttaaattttttttataattaatatattattgttattagatgaaaaaacataaatagtatttatgcatgacatatgtttttaatttttttttaaaaaaaataaagaagacagacgatcaaagctagaaactaaacaagcgagtggagtcagccagtatctattggctagcccactatcagcaagggggagagagacctaatggcgttgtgctatataaggtgggcaggtgtcagagacaaggggcggactgatttgtaatgaaacaactattccttcctataattccaatctctccctgctttcattccaacctactctgttctatcttcttcttcctcaattcttactctgctctatctctttctcccaaaatcctccccaaattcctcaccgtttgcggtgcgattcctgtcaacaccactggcttgatcatcatggcaagagcaacagcattgctctgctcctcactgctgttgctgtcctgtttctacgcccaggtttctccagggagcagcagcagcagcagaagtactgccatggcggatgagcctgcgctcctctcgttcaagtccatgctgctgtctgatggcttcctggcatcatggaacgcttcaagccactactgcagctggccgggagttgtgtgcggcggccggcatcccgagagggttgtggcgttgcaaatgagctcgttcaacctgtctggaaggatctctccgtcattgggcaacctgtccttgctcagggagctggaacttggtgacaaccagttcaccggggacatacctccagagatcgggcaactcaccaggcttaggatgctgaacctaagctcgaactatctccaaggaagcatcccggcttccattggagaatgtgccgagctcatgtcgattgacctaggcaacaaccagctccaaggtgagatcccagccgagctaggtgcgttgaagaatcttgtcaggttgggccttcatgaaaatgctttgtcaggagagatccctcggtctctggcagatttgcaatcgttgggcgccctatctttgttcaagaacaggctgcacggtgagataccgcctggtttgggcaatctcaccaacctctatcatcttcttcttgcacacaacatgctatcaggagccatcccatcatcccttggcatgctctctggattgtcatggcttgagctaggcttcaacaatctaaccgggctgatcccctcttccatctggaatgtttcctctctgacagagcttaatctccagcaaaacatgttgcatgggacgatgcctcctgatgtgttcaactctcttcctcatctgcagcacttgtacattaacgacaaccagtttcatggcaacatccctgtatcaataggtaacgtgtccgctttgtcgcggatacagattggtttcaactctttcggtggaatcattcctccggaggttggaaggttaagaaacctcacttcgctagaagctgagcacacattccttgaagctaaagatcagaaaggatggggattcatatctgcgttaacgaattgctccaagttgcaagctttgttcctgggcaacaataggtttgaaggggtacttcctgtttcaatctcaaacctttcagtttatcttgaatacctctatcttgattttaatgcaatatctggaagcttgcctgaagagattggtaacctcgttaggttagaagctcttctactccataacaactctttcacgggaattcttccgtcatcgttgggcaggcttaaaaatctgcaagttttatatatagacaataataaaataagtggatcaatcccattagccatagggaatcttacagaactaaattatttccgccttgatgtgaatgccttcactggtaggataccaagtgcacttggaaacctgacaaacctagtggaactaggtctttcaagcaataatttcacaggttctattcctgttgaaatatttaagattcacacgttgtcgttaactttggatatatccaataacaacttggaaggatcaataccacaagaaatcgggggcttgaaaaatcttgttcaattctatgcagattccaacaagttatcaggtgaaatccctagcacccttggtgaatgccaacttctccagaatatatctctccaaaataatttcttgagcggtagcgttccatcactcctgagtcaattgaaaggtctacaaattcttgatctttccaataacaacttgtcaggtcaaatacccacattcctgtcaaaccttaccatgctcagttatctcaacctttcattcaatgactttagtggtgaagtaccaacttttggtgtcttttcgaatccttccgcaatttccatccatggaaatggcaaactttgtggtggcataccagatctacatttgcctagatgctcttcacagtcaccacacagaaggcaaaaacttctggtaattcctattgttgtttctcttgctgtaacattactactcctcttattgctctacaagcttctctattggcgtaagaatataaaaacaaacatcccatctaccacatccatggaaggccatcccttgatctctcactcccagctggtaagagcaacagataatttctcagcaaccaatttgttgggatcaggatcatttgggtctgtgtacaaaggagaaataaataatcaagctggtgaaagtaaagatatagctgtgaaagtgctaaaactccaaacccctggcgcactcaaaagtttcatagccgaatgcgaagcactgcgaaacctatggcatcggaaccttgtcaaaataattacagcttgctcaagcattgataacagtggcaatgacttcaaagcaattgtgttcgagttcatgcctaatggcagtttagatggttggctacatcctgacaataatgatcatacagagcaaaggtacttgaatatcctggaaagagtgagcatactccttgatgtggcttatgcattggattatcttcattgccatggccctgcccctgtgatacattgtgatattaagtcaagtaatgttctcttggattctgacatggtggctcgtgttggagactttggacttgcaaggattcttgatgagcaaaactcagttttccaaccctcgacgaactcaatactatttagagggacgattggctatgctgccccaggttagtctgtttcttgttcttcaaatgaagcccacatttatacaataatattagagcaatgctccggtgctttctacttggagtattatactacaagtaaaattaatctcgaccgttcattttaaagggtagattagtaatctcctaatatatattaggggcaattttggcaggatctattttctctgtctcggtcggtcttggcttgatcgcatcaggtccgacgaaaagcaccgcatctcgcccgacgcacgttgcttatcgctactcctcccggcacgccgtggctcggtgcggtgaaaccctcaggcgtcccctcctcccacctctcacctgtctatccgttcctcctcctctcctgtattccacgtcggcatcctggttcgccatcgtggccttctgtccgctgcgagtggccttccgcgcgcgtccgatttcgccggagcccctgcgcaagacctaagattcttggcagcgcccactttggaggattcaatccattccgccggcgggtagtgatctccattccgtgttgctctgattgtgtgggctgcggccacttgggaggcagctgcgatacattccagcgccgtatccccggtccccctccgtgcgtgcccgagtcttgtggcttgcatcggcgagcacctcctcgaccgcgagcacggcatgagatgcagaatatgcaacagtgtcgctcgctgcgtgttgccgtggaaggcgtcgccggcgaacctgatagaccgcaatgctcagaggtttcagcacatccgtgctcgcggcggcgtcaggacactggatcggacgctgaacgatgcatgcggcatgcccgatctgctagctcaggatggtggccggcgactgtccgcacgctctcctgcgggcatgacttccacgaggattgcaacatcgcgaagtggctccgtgacaacaagaaggcctgcccagttcattctgcttgtaatattcagttgtatggtgtgtcgaatacttcattgactaattgacgagctttgagatactgatgtttattggatcttgtgactgtcccaatatattcattgttcagtaatggtttaagtaaaaaagaaaaggtgaatagtgatggactactagtaatgtcaatgtgttgaccatgttagtgtgttgtgcattttttttgtgtgcaactgtgatggggtgagatgaatccaagcaatttgaactgaaatatgtcatcctgctcctggatcagtaaacaagttgttttgctcctgaaagagtgagactgaaaaaatctgataaactgcttaaatgagatttttcactatcagagttttgcccatatgtaaattgcatttcagtcagagctgtaattcaggatttgttttatatttcataccatcgaaacatctaactgcattctgtcatattctggcgctctgaatcatcgctacatgattcctttcttgtgctcatatgggggtagctaagccctcaattgccactaaattgattttttttcagtcataggacaatgtctactaatgggggcttagaacatcttgattcactctttgctgcaaactccctggtctactgtcgtgtttatgcaaaagcatttgcattagctccgcggcagcttgtgaagtcatgcacagtccctattcatgtagcatccaaacacctcattcccaagtcccttagctgctcgtacggtcgccggcggcgaccaaatgccaccgcctcactcgagctccgccactgcacgtcgccggctgccatagctcatttcttggccaatccgagccgtccaccacatccccatactacactcgttcattcccagttgcccattcctcctacctcgccgccgttcgccggaacccgttgaatttcgtccgccgtccaattgcccggcgatctcctgtcttggtcaaagctacatggcaggactagtcgtccgccgtgggcaaggaccttcagcggcttggcgaagaggagaagggccacccttggtcgctggagggggaggagatgtcgatcgcgctggagatgatggaggcggagagggagatggacaagcgacgaagtcaacgatggatggggtcagccgcttgagaatggcgaaggtttagagttactgaataataatttacgataatacccttacatgaattattatctatggacaaatatacccctccacgtttctactaccactatgagtggtggtagtagaattagatctcaaccctacgattatatacgatcaacggctcggattattttctactataagtagaaagcaccggagtgaggctcataatattatgggccatttgcagatgaaattagttttaggggaagcattgaatttttatttttacctaattgtatatcagtacaacttatggtaaatttatagctatacaagttataagaattctaatatttctggggaatgttcgatgcaacagaatatggtgctgggaatactgtgtcgacgcaaggtgatatttacagctacggcattcttgtgttggaaactgtaactgggaagaggcccagtgacagcgaatttacacaaggattgagcctctgcgagtctgtaagtctgggtttacatggtaaagtgatggacattgttgacaacaagctgtgtctgggcattgatcagcatgatcctgagacaaccgatgatttttcaagcaagcaaaagatcgattgcctgatttcattacttagactaggactttcttgctcccaggaaatgccatcgagtagattatcaactggagatatcattaaggaactgcatgcaatcaaggaatctctcttgctggaaatagaggatacagaaaaatgaagacactgcatttcttttttctgctgggttacttttatgttctaataaatctgtcatgcatattcttgagctcctcttaagtatctgcagctgagtcctgtagtggtcattccaactatttgtatcctatgataactggatcactgatgttcactgcagaaatatctgttatgtttcttttgatgcaattactttggatcaaatccaaattgtttacagtgtggccggttgcagtcatgcttctacagtctgcatgatacctttgataatttatacaagagtactatgcaaaatgaatattcccttgttcatttctggttacagtctgcatgatactccctccgttaaggttataagacgttttgactttaatcaaagtcaaactgttttaagtttcaccaggtttgtagagaaaagtagtaatattttcaacccaagataaatttattattaaaatatattcaattattgatttgatgaaactaatttagtattatatatattactatatttatctataaacttagtcaaacttgaaatagtttaactttgaccaaagtcaaaacgtcttataacctgaaacggaaggagtaccaaagtacataacaaagtaatacattgattcgcatgataatttcgacgattttagactgggtaagttattgcttacgttttttttttttggagaatacgcaaggagcgcatctttgtattatgaggaacaaaagttatttactgggaaaattgaaaaaaaaaataagggacgggatacaagcgataaccaaaaacactaagctagacctattctcgcacgagtattgtgcgacctagagaagactaggggctggacattcaacgccggaattgccgcgttggccaaacgccagagttccgcttcagcaatcattgccttcgcaacctctagccacgttctatgctctcttcgtgttgatcacaaatgacgcaacggtctaggtgtgggaggccacggttgtggaggaggtccacgatccagcacctgttgagagcaaccaaccataagaagtagcggcatcgcggggcgccatcaatttccagattggtttggactgaaaccagactcttcctaggaacaatgctcgataggctgaactggaggtgtattcccccgagcagtcccacctccaagagagggagtccggttgatccggcaatagctccatcgagtttagagtggtctaaaggtggaggtactcgagaatcgcttggatccctagagctccatagatgtctctgacccatcttctaccttgaagtgcctcaacgatcgttttgcgacgtttgaaatgctcgaacctcagggacacagttgtagacggctggtgcaaaggagcgaacagagtatccttctagctagttgtcttcccaaaagagcgcagattcaccattgcccaagatacacaccgtggacgccgccacgaagctgcgttccttgggtgagattgggatgttcagaccttgccaaggcttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32735 - DNA, 271 bp, Oryza sativa
ataaatagctaatttttataagcttacgacattggattatttataactaatttgcagttaaagactcatattaactatattccaatacttctaaaagaaatatgttattttgaattatagtatgacattataatatgttatgtgctgatgtttatatattgtattgtataggaaggaatgacatatatatatatatatatatatatatatatatatatatatatatatatatatatatatatatatatatatatatatgaaattttatttt

SEQ ID NO: 32736 - DNA, 448 bp, Oryza sativa
aagcaggaacaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaattggatttattgcgtcagccgaggggaggggcgcgcggaccgggtccatgggagtggggcccacgcggcagcctcatggtccacggtggaccgggtgcacgcggctcacaccgaccggcgccgtgggccccacgcgtcagccgcacccgagggcgcggcggctgacggccgggccccacgcggcagccgctcggtgcgcccgaaggcggccacggcggcgcggccggcgggaggcggtgtcgcgaccgagaaaattgccttttcccgaactctagtgtattaat

SEQ ID NO: 32737 - DNA, 489 bp, Oryza sativa
cattcatatgctaattataattgactagagaatttttaaaagttttaaatcattcatgtggcatttacagatgttaattagagtttttcacaatttaatttactatcattcatatgctaattatatatgactattcgaatttttaaaagttttaaatcatgccaggcatttacatatgttaattagagtttttaacatttaatttaatataattcctatgctaagtatatatgatgattacaatttttattaattttaaatcatgcagtatgtacatacatatgttaattagagtttttaccaatttaataatatcattcatatgctaagtatatatgattattggaatttttattaattacaagtcatatatttgcttattaagatttatccacttaatttattacagacaaaaataatttttctaagaaattgtcattaatctttgtactttaaataattgtaatgcattatcttctattttagaaa

SEQ ID NO: 32738 - DNA, 1552 bp, Oryza sativa
gcgaatgaacgtgaacgaacgtgaacgtgaaatgcaatatatatatgttacttcgcgtttatcttaatacatctttttgtatcttgcagaaaagacgtgttgtcgaagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcgatacgaaagttacactgagcatacatgactattttagtcttagcatgtaatattatttgagttttaatatagattattttatttgtaattagacttagtatataattattgactagctagggtcgtataatatacgtcacctagacttagcttatatcatgatttgtaattagacttagcagtaaggttgtgtagggttctaatgtacgacagttacacttagcatacatgacttagattgttaaaacataaatgtctcatgacttagcagatgtttcttgtatcaccagatggctgaccgcgatgagtaccagataaaatacggtacaatcgcgaaggtgaagcaggcaagtactagaaataagaagagttggaacgaggatccaacccagtacttgaatgaggaagggacgtgagaagggatgcggaggggaaccagcaggggcacgtggaaagggatgtggaggggaaccaggaggaggaggctagtggaagtcaaccctccgttgaccagaagagggcacgcgggcaacgaggtgcagcgaagaagcttgagggtcggcacatcataacgaaagtggaagaagatggacgtcctagtgccccggccgaagctgccaagaactatgtacgtcacagcggttgggttgtgcgggataacgtgcctatcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgtatataagacaggtgaacaagggcaggtgatgatggaaagaaacaaagaaaatgc

SEQ ID NO: 32739 - DNA, 1054 bp, Oryza sativa
  unsure (1)..(1054): unsure at all n locations
gtactccgaccgccgctcgtcgttggggacctccgtcgggctgacgtactcggtgaacgccgccaggatgtccacgcccggcgccgcgatgtccggcttcagcacgcacggcagcgtcccgcttggcccccgcgacgagaaggccgccaccgacggcgagttcttcacgccgacctccgtcttggacggcgagatgttcgccacggggttcttggaggagtccatgtacttgtacagcgacatggcctcgctgtaggtgatcatggtggctgggagcacgtgcgggtcggcgacgatgtcgtcgccgtccatctcgccgttcgcgaggatcatcccggtgccgccggcgttgaggacggtcatgcccttcgtcacccttgggatgtcgccgccacgcacgcacaccacgatcttgttcttcaccttctccgggtcaagcgtgcctggtgggcaagtcgacctgaaaaaccatacagatttttttgccatgatttagacgcgaatcagtccagttcgatctcatatcatctcacacacattagaaagaaaatttcacgtgttcaaaggatggtacgtacgagacggcggggtcagagctcgcgagcgcggcgtcgctggctttgatcatcgagtagagctgggtagagtgcaaggtcgtagttaccaagctcatcccctgcgacgcacgcagcattgggagagacaagcttgcaccgtgacccatgtcgtcccaagtgttcgtccatggatatagctatagttaacaatggcgtgggaccaggtgatcattcccttcatgtgcgcgttgttgcccagcgtctcgacgttgggaaagtcccggtcgacggtgctgacggcgtcggtggtgacccacggcgcggcgttgatgacggtgtcctcgaggggcccgtagtagccggcggagcagtcgacggagacgcccactgtactaagcaagtcataccggaataggggtatggtnnnnnnnnnnnnnnnnnnnnnnnnnnnnnnnnnnnnnnnnnnnnnnnnnnnnnnnnnnnnnnnnnnnnnnnnn

SEQ ID NO: 32740 - DNA, 1196 bp, Oryza sativa
aaggcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtcttttctgccttaccttaaccccgctttcacgtggcgattcggtatgaggtttctctgatctgtttacggtattcttgaagctttctttcttggtcaccggacagagtgagaactgctctgctttctttccctagcacacacttagtagatagtaggcacaactcgctaagagctcatcgaacttgagttctagagtaagaccacagctcgatatggctcattcactagtatggtttaccacatgccagtgatagatctctctcaagtgaggtctggtatcggtgaagtcaatcattgaattgaagtggtagagtgcatagcggggcataaggccccatgtatttcttatcagtgtgcttataccttgaattcaattgatgctgttctagcttgttttaaacaagttatagagtttgttttggttccaggtggtcatcccaactcgaattagctatcgaaaagcagtacttacttgagtttcccgctttccataacgaatcccccactgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggatcggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacat

SEQ ID NO: 32741 - DNA, 655 bp, Oryza sativa
  unsure (1)..(655): unsure at all n locations
nnnnnnnnnnnnnnnnnnnnnnnnnnnnnnnnnnnnnnnnnnnnnnnnnnnnnnnnnnnnnnnntgagcacgagtgaccttatttcaagttaagattcttcagaaggaaaaacggcacagacacaacctttaggaaattgaaaccgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgctcgatgttccacgggttcggcagttcagtgccgtcgcccgtggccagccgtacggagcccggccgggggacgccgatcactcgatacgggccctcccacattggtgagagcttgctcagtccagcacgcgtttggacgcggcgtaggacgaggtcgtcaacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcaggggtaccgagctcgaattcgc

SEQ ID NO: 32742 - DNA, 615 bp, Oryza sativa
gggcgaattcgagctcggtacccattttggtgattcgtaattaatattaaattattgagggatttattatcgtatttcggagtagtaagcatataagataagacaagtgccgcagtaacaaacatgtaatacataaccattaattcaattgtaatttacatacaaatatataatacaagtggcacagttttttcatcatatgtataagtagtgtacatgttattgcatatgttctttctcccactctctgagaggtttaaatttgtcgtccattgcgagctcactctggttgtcgtagaagagacctcttgcgttgcagacatcgcgacggatgaatcggcagaggtcagcggacacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctaccatttactctgagcatgtcgcacacgtggtaagcacacaagttggttcctggtggttgtttgtagcactgcgatataattatggggaccga

SEQ ID NO: 32743 - DNA, 1143 bp, Oryza sativa
  unsure (1)..(1143): unsure at all n locations
ccctgaaaaagttgttgcggcaactccaacgagaaagaataagcacaaaaaagtagtaagagatcgtttggggacgagcctcctactcctagaatgtattttccgacgagtttagatatactcttggagagacaataacatgatcacttttggacacaattatgtgtacttctgctctccttggattagagagactgatcccaactggccttggccaggaaaaacgaagaactttttatgcgatctacaaacgaatgagatcagaaagataggcggacgacttgaccataaggtcggatgtttccgtgagcagtaagctgcggatctccccttttttgggggaaagctggtggcccttttggcgtgttaattctttcgacggggcggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggacctggagaacgtgtgacactgggtcggggtttggtgaaccaacaggtcgctcctttagttgaagtatcgggcccctttttcgttgcctaggttacaccttcggaataccccagacggggattgagctctattccccccaatcttcactttacgccacgccgactctctgtcgtggaattagaccaagggtcgaagacccataccataggaccccgtcccccgtatcttatctttcgcgcgtaggagatcgagacacagccttagggctatgaggaaagtagatcgattgccctagaattacaactacatagagggtctctacaagtctataaagaagtttaaaaaaattgatcggtagtagtccggtcgcacctgaacaataattttccagagggaaatgcacctaagatcaaatattttgagccggcttccgtggaaaattcagactttctttttgatgctgcgatnnnnnnnnnnnnnnnnnnnnnnnnnnnnnnnnnnnnnnnnnnnnnnnnnnnnnnnn

SEQ ID NO: 32744 - DNA, 1540 bp, Oryza sativa
agagatagatccggtcaccggttgccgacgcatgccggtccccttaccctccgccggatctgcaagggaggataggagagccgtgtggcaccggcgtctcgtgccacctcccccgaatctgcaaggggaaggaggggagggggcgggcgccgccggatccgcggcccccaagcctcccctccgccgaatctgcacggggagggaggggagggtgcgcgctccgcccccgctgttgcctgtgaccgccgccaccgccgcgtgctctcctcccgccgcgcgccgccccctcccccggatatgcaaggggaaggaggggagggggcaggcgccgccagatccgccacccccaagcccccccccttcgccggatctgcacgggaacggaggggagggggcgcgcgccgccgccgctgtcacccgtggccgccgcgtgctctcctcccgccatgtgccgcccgatccaccgccccctcccccggatctgcaaggggaaggaggggagggggcgagcgccgccggatccactgcccccaacccccctccgctggatctgcacgtatgggcgacagcctggagcctgtcccctatttttccttgcggtttcacttacgatccgtatgggaaaaggggggggggcgtccaggaaaatctattctgtagtagtgacaacccaatggttgggtcgggcctgcacaggactgacccagttaagccgtgttgtactagggctgggccgtccggccccaggccttttggcattctatggatgtgtacattgtccgattggggcagtatcggatgtacgggagcaatgagccgggaggggagtacaatctgagcatacaggatccggactcccgaacggacgcgcccgcgaggagcgacacgctgtagcagtcgacggataaattttggcaatttgaccttttaaaaaacttatttgaagaatagaccatgtcaaaaatttattacaaaaatatatcaaaacctcagcgctaatgggtttagcgctgagttataatatctcagcgccacatattttggcgctaaaaacctatccgagtagccactatacatcatatcattggatctgagcgccaataccacaggcgctaaggttttggtctatttttgcaatatgtttttgacatggcctattcttgaaataaattttctaaaaggatcaaatcactactggagaactaatttttgttgggtcaaccaaaaatcacaatagtcccggttacaaaaagaaccaggactaaaaatcatctttaccctggttgaaaagcccataaccattttatgatctttagtcccggttgataacatcaactgggactacatatcattttcagtcccggttgaaaaagtgtccgccctcctacccgttttattcccgtttggaaacaccaaccgggacttaaaattgcgataatatataatcccgagcacttatcctccaaccacctctacccttatcctcgtccactcttttcttatcttctccctttcctctcgctcttttcctctaacttat

SEQ ID NO: 32745 - DNA, 678 bp, Oryza sativa
gtcacctttcttcaaaataataaagatatctttgcgtggaaaccatctgatatgcctggtattcctagagaggggattgagcactccttacatgtcaaagaagacgctaaacctattaaacaacgactccgccgcttcgcacaagacaggaaagacgcgatcaaggaggaattaaccaagctgttagcagcaggcttcatcaaagaagtccttcatcccgactggctggctaacccgggtctagttcggaagaaaactgggcaatggcgcatgtgtgtcgattataccgacctcaacaagtcttgccctaaagatccttttgggttgcctcgcattaaccaggtagtcgactcgaccgccggctgtagctactcagttttttggattgctactcagggtatcatcagatccgactgaaggaatccgactgcttgaagacttcattcatcacgccctttggggcctattgctacatcaccatgccattcggactaaaaaatgcaggagcaacttatcaacgtatgattcagagatgcttctcgatgcaaattggccgcaatgtcgaagcttacgtggatgatgtagtcgttaagactaagcagaaggatgatttaatctcagatctagaagaaacctttgcaagcatccgcgctttcaggatgaaactaaaccctgaaa

SEQ ID NO: 32746 - DNA, 1837 bp, Oryza sativa
atgctttctttaaggagtctctctcctatgaaatttggtgaactctctatgcaaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccagaagattatcatgtctttctcaatgagagggcaaatgtgactgattatagtaaggtagttttcgtggaaacgaaggatcttactccagtagtgctgtctgcctttcaaaatgattatccatttaatgaaatgtttggtcctataccggaaacagagagtcctcataaaagaaaatggttactatccatgggtttaggtataatgatcactttccgcttatcggtaggtgtgctacctgacataaacgaaattctactaaattgaaaaaatgaagatgaaaccaaatactatgataggattgattggattaaatagataggaatgattggattgaatagaacaactatgaaacataatagttgattgaatagaatgttggtctcacaagtcggtacggtgtgcatatccatccttggaagaagtagctccgtcccagtctttgtcggaacttgaatcgaggtaggcaaaagaatccttactcggaacgagcccaagataaaaggtctagtccaattttagtcttggttgtacatcggtactacgcacggtaggcatttcttcccgttatcgggacttgcacttgcccggccttagtggtattttaatgattttcttccccagcaaatcaagtaaatagaagtaataattcaagtcccaccgtggatttgaacatacttcgcttcgtggagccgaggattagatcgatctgaactttcatttcttccattcgcagtaatcgttggttttgtccaattccttcaatcatcactgttttgttctgtaattccatttcattttatctattttcttcaagaaattccattgatgtgcttttctattgctctcattcattcctattcaatctattcaaaactacgggtactggtctcaatgggaaagagccctaattcaatatgtcgtttctagagtatcagcaagtggtaagcggattacaagcaagcggaaggtttgaattgactagcttgatccctactattaacaaggaagaagtaagcaagcaagaaagaaagtaagttcagtctcttatttcgaagttcgctgtgctcttgtcaatagacattctgctggaactcacctttatctttagagatgatgataaatattctttagagactcctctaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttcctttgataccttggcttctt

SEQ ID NO: 32747 - DNA, 2221 bp, Oryza sativa
ttcggaacacattgatatccaggaggacctaacatatgtggagaagccggttcgtatacttgataccagcgaaaggagaaccagaaacaaggtcacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaaattgtaatttttataaatgaccctaagaaaatgcaggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctccttttttttcgaatgggccgccggcccattccctccttcctcccctcctccttgctgggccggccgcaggccgaggcccagccaggccgccctgccgcctcctctctcggggtcgccgacaggtggggcccacctgtcggtccttcccccacctcccgccgatctcgctcgcgccgtcgcgcccgcaaccgccgccgcgccctcgtctccgcctcctccgggccacgtcgaccacgcccgcgcgtgcgccgcgtctcccgcgcccactcctctccctctcccgctcgcgcctgcgcccgagatcgccgggattcgattttcgaatcccgcctctctctcctcccccactccccacgtcggccggcgattcccgcctctctcggccagtccggttccctctccccctttttaagcatcgccgtcgtcccctctcactttttccccatttcgccacactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagcctcgttccctcgcattcgggtgagcaccacctccaccgccgccttcggccatggtttccggtcgccgtggtccatctccctctctctaatccctctcttctccttccttagggcaccccgaagctcgtccgcccgccgacgtcgtcctcccgtggcttgccgtcgccgttcgccatcgtcttcctccgcgccggccaccctcggtgaggcaccccctccctttttttttcccctccctctccctcctagccgccgctttagcgccgccgcccgttagtcgtcgctttagcatcaccgcccttcggcgccttgcgccgccgtctccgccggcggttgccgtcgtcggcaacgcgcgtgcgcgtgcgcgcaccgtcgccatgaccgctcggccggctttgtgccgagccgagcctagcctggccgccgccgcaccgtccgatcggccccgggccgatccgggccgtcgatcccgtggaccggcggtggatcacccgcgtggtcccggtccacggtagaccggccacccgtgcgccgctgacatgcgggccccgcttgtcggcgccgcaccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcaccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcttgctcctttgttagcttggggttatagcatgatta

SEQ ID NO: 32748 - DNA, 609 bp, Oryza sativa
gcctaaaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacaaccgtgattagtcttacccctagttagctatcgaactggtgtagttcaagtggttggttgggcctgttgcaacgtggtgtagcgttagacaatgattggttaatattgattaatactacaactgttttactgctttcaactactgcttttaaatgctagctttatgcaaaaggacctttagcctcccttggatatatcctgcatcata

SEQ ID NO: 32749 - DNA, 2067 bp, Oryza sativa
tcaagggtattacccaggtaattcaatttgatatatatcaaggttttctcaccattttatgtcttgggaagtaaaattttgtgcattccttctattttgtaacttctattttgtaataagttaatctaatacatgatacgatatatctcgagaatacttataattggccactcgattcacgggataagaatcggacgctctctggcagaacagacaacagctagctaatttatctccttcctttcttctctcttttaagaacttttttcttctaaattacttatccgatctataatccaatcgctctgttgtattcgtagaaattaaatctttaagatatcataaattatattctgataaaagaaaaacttgtgtttgaaaccattagaacttaatgttccatacgtgatagagacatggctcaacgtgtgttcactgtgttaaataatattcacgcagctaactgtatgtactctctccgctccatccatgcaagcgcttgcatgcatttagtgacattcaaaacgatttttctactaaactagttatctaatctacgatccgatcccaacattttattccttgcaattaaatttttacaacaagatatcgcatgtttatattctaatagaaaaatatgtttcaatatgttaacatggaatgtttcatacgcgatagcatcatatttcaacgtgtctgcattgtttttcacaaaaaagttaaatgttttagtggctgaaattttttcaccattataactccatgtttccatggtaaactgaaagtctgaaacgcttggctgtcaaattttttaagaatcaatcgggcgcccgatttgaattttttcgatatatctcagcactactaatctggataaggattctatagattcaactaatgcgtagaaaaacaattgaaacgaaaaaaaaacatagtcgtgttcacaggtatattttttttgttcatgtgcatgtcgaatttgacttttctttctgataaatatagtaaatttagattgtctaatttttattctattttttcatataagtattaggacgacattttcatacagtgcaccatttggcatatgccttgcgcaggaccttgtcactggtggtgcggacaccagtacggtgaccgtggaatgggccatgtcggaggtcctgaagaatccggcgatcctcgccaaggccaccgaggagctagacaccatcgtcggcgtcggccgcttggtgacggagggtgacataccacacctcccctacatccacgccatcatgaaggagacgatgcgtatgcacccggtggtgccgctgctggtaccccggatgtcccgtgaggatgcctccgtcgccggctacgacgtccccgccggcacgcgcgtgctcgtcaacacgtggaccatcagccgcgacccgtcgctgtgggactcgccggagagttccggccggagcggttcgtggaagcgagatcgacgtcaaggggcgagacttcgagcttctgccgttcggcacgggccggcggatgtgccccgggtacagcctcggtctcaaggtcatccagctcgccctcgccaacctgctgcacgccttctcctggaacctccccgacggcatcgctgccggcgagctgagcatggaagagatcttcgggctcaccatgccgcggaagatccctctcctcgccgttgtcaagcccaggctgccggaccatctctatgccgagccatgatgcatgacgcaccatgcgtcgatgcgtgcgtgcatgcatgcgcgtcttctgcattcgacgaagctataggctccagttcaaggatataaaactccctagtgcgtcgaataatagaactagggtggtttaaataatcgtacagtagctctgcaagatatgcaagctcaaaatgttatcacctgcactatagatgtatgatggtaagtcatttgttgagacggatatgtccagtccatcaatggctccatcctaaataaaggaattttatgtttgccacaagtcgatgatcaaatttatttttatgtttattttattctttatctttatctttacgga

SEQ ID NO: 32750 - DNA, 607 bp, Oryza sativa
atccgtcatccctccttttaactatcattacaattttatttagggttttgttaatagtttttagatgtgccatcaattattaccactctactctttttcaggcatgttgcttggaagtcccgtgaaatgctaccactataatcctctacaacccatccactgcctcatctctttattgtcatcaggaatttaaaaatcaaacataattatcatttggattcatcttttactttctagaagttccgccaaaccatcatcggctttgcaattgtacttctccatggctcgtccgctgcctcccctatttattgttattgagattttaaaattgaatgcgactatcatcggggataattttttaccttttggaagtcctgccaaccgatgagatcgtattgcttaacagtctgtccgtcgtccctccaattaatcgttattggaattctattagttattttgttaatagttttttgatatctcgtcatccatcaccactctactccttagaggtatgttgctacttccatatgtgttccaaatgaatattttttttccaaaattccatattttttattctgatatattttttttataaattatattccta

SEQ ID NO: 32751 - DNA, 572 bp, Oryza sativa
  unsure (1)..(572): unsure at all n locations
ggatattccccattccatggcatctttcgcttatccattcagcccgcccgcccagacgcggcgccctttcgcattatcatctaccgccctttctttcctcccgtcccttcacgcatgaagatcgtcgtatgtatgtttgacttcggttgccggtgcaatagaattggcgggagtatattatggcaggatcagtcacctgggcaaaccaaccctcgtccaagaagaattgtgctatgcccccccgatatccctatagagcgaaagagctgcctggtgatccctaggttgcagcacgtccggtcgttaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32752 - DNA, 661 bp, Oryza sativa
  unsure (1)..(661): unsure at all n locations
aatccacttggagaatttggcaatggccacaaagagatgcctgtaaccgcccactgtctttttgaacgggccaaccatgtcgagcccccaaaccgcaacggcaaaaacgtgggaatggttggcactcttgaactggtaaaaggatntggctgggcgaaaatgggcaaccttcgcacgtgcgcacaatnttgtcggcgtcggacactgcagtaggccagaaaaaaccctgccggtaagctttgccgacaatggtgcgtgcggcggcatggtttccgcatattccagaatgtatgtctttcaacaattgtctcccttcctctagagatacgcacggttgcagaattcctgaagggcttttcttgtatagctcggcttcatgaataacataaagtctgcttcgccttgaaatccgctcggcttcatctttatctttggggagttcttgagaagtcaaaaatcatatgaggggctctctccagtcggcttcaatcatagctatgttatgagtgtccgcaacttgagttgtttctttctgaggtacggcggctcataaaggtgttcgacgaatacatcggagggcgccgactcgcgcttggatccaaagtggcaagtctgtctgcggcttcattgctgtgtctgagaacgtgactaacctcaagtc

SEQ ID NO: 32753 - DNA, 41133 bp, Oryza sativa
  unsure (1)..(41133): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtactatggctgattgcaccaccctctactatggtggctcatgcaatgctattggggagaagggcaccatctcatatgctttcaacagctactatcagctgcggtaacaggacgcccagagctgtgatttcgatggacttggcatgatcacttaccttgacccatccatcggtgactgccgctttcttgttggtatagatgacagtagaacatctacaatctattcttcaggtgactgttctcggaggcgctttggattgtggatcttggcgttcttggtaattgggttccttcagattggggtttatttgtgattttggttgtcgagagtcgactttaaacagctcccttgggcacacttcccatgtccttgtgaagtagcttcgtcaattggtggcttctagatgtaggaaaggggggacactgttagatgtacatgatcactagcttgttcttgggattgtgctgtccaattctgcaacttccgatcttcatgctaaggtggccaaaagctttctctagattgaaatgaagatggtagatgttgttgcaacctgattctgccattctttggtaccaccattttgatttggggcgaatatatttcttttgtagggggtatatgaggctatggtattgctgtggtcttaaagatacctcatgaaaccgctgaaattcatactggtggaatcacgagaaattgttttgtttgactagctttgtccactggatatacattagggtttttgtgcaatctcaatgcctgacatccattatattgtgctatatgagaatgtcataaaaacgccatgttttgctgttccctcgttcacaaaaatacaggtacaagaaatggcagccatgtgcccatgtcaattcggagttgcatcaggcctcttttattactcctagcttaatgccaggtcaaacgttggttgcgttcctcaaatcagatcaaggaattacatcaaaggcctcacagtcaagttcctcttccacagcaactagaggtgcttaaagggtagagtatttctaaataataaagcatctttataagcttccttttctccaatgcaagcaccttttcatgagtgctcaactggttgcaagaacaattaatcagggatggttataagcttaagcagctgctaagcaccaatgcagtaatcttccaatccaattttaaaaatattcaatatgaagtcttcaaagtttttaatcgaagttttcaatttgaaatataaaacctttatgttcagtaactttcaagttgatactttctattcaaactttcaatttgaatagcaaaaactttatgatctaaaactttcaacggcaatctcaaaaactttatcgtcaaaacgtttgaatcataattcatccaattttaacccattcaaaacttttacttataacttttcactctcaactcaagtctcctaaagtttcactcatgacatcaaacattttgcccaaatgaacaaacttttatctcaaataataaaaaactttcaatccagggatgaggtcagcttgtggccaggtctgaggaagaaagaggtgcaaggcctcatcgatgtcacggggattaggcctaggggcttgttagtaaggaggaagaaaggtactttgagctcataggggagtagggagaggggtatgggcggcatgccaaggaggaagaatgtgactcgaggctcacttacactaagacaaggaggatgaaagagtggtacaacatgatgatttgacaacaacatatttatgtgtaagtaagttcgcgtgtcaatacaattgggtgactgttggaataagtcttttcgccatgttgacaggcgaaacgattttgtgcaccaacaagttatgagtactactttgtgtaagggtatgataaccaatggcacaactttcctcatatgatcaccaaaacaaagtacaagagtgctagggcaaggttaggaatacaaaattagagagcatgaaaagacatagcattaacaaaccaaatctgatatggtacatgtgtgtgaggtgggcacaaaatgatctttttgctatgcatgactaggaaatccattggaacaaacaatattttcaacaaaacccaataggattcctagtaggctcttcgagacgtagggtggagaaaatggaggaatggtaagaatatatgatgactttgataggaatgtaagtgtaaaacagtggatgacatgaatgcaagtgcaaaaaaaaagattgcaaaagaaaaaaaaaatctatgagtgattgtttgattagatttcatgaaaaatgcaaaaatcaaatgagagaggtggactagaagtgaaaattttcaaaaggttagagctcttgctaacttttcttcaaaatttatatgcactaaaccatcccttaggaattttggagccccattgaattggaggattcaatttccaaagaaaattttcccatggaaagcttttgattcataggaaaaggattaaaaaaatttcataagaccttcatatggctcaatttcatagggaaataagccaagaaatccaacctctcgggaactataatttgctttgtttatttcctatgatggtattaaagggaccttcttgagctttcccgtgttttctattcatgtaggattagagaaacatgttactttaatttctacggttttcctatcacacgtttcaaaggagtcactttaattttttcctacaagttgtttggcaccaacaaaaatgttataatcttttagaatggttcccattcctccaatttcacaaccaacaaaagctgaaggaaaacaaaatccttcacaccgtttttttctaatatacttaattaatcatgtttcaaaatttgtatgttttcaattccatagtcatttattttgtgctctcgtattttttttctgtttatgtatttttagtcctttgttccaaataatgagactatggaattttgaaacaatttggaatgcagattctgagaaaacgaaccaacaagagagagacgtgtcgcagacgctccatatctcaaccgcttccatcctgggtcccacctgtcagctagccacacccttgataaatacccgtgaaacccaggatcccgtgggtaactccccaccttaaaccccagacaccctcaaaaaccctaatcccctccctcccgccgccgccgccgccgccgccgccatgggctccgcctccgcttcctcgctcccggcctccgccggcttcggcgagaacctggtcctcatcctcgacttcggctcgcagtacacccacctcatcacccgccgcgtccgccagctgggggtcctctccctctgcgtctccggcacggcgccgctcgcctcgctcgcgggcctccgcccccgcgccgtcgtcctctccggggggccccactccgtacacgcctcgggggcgcccacgttccccgaggggttcctcgagttcgccgccggcgcgggcgcccacgtcctcggcgtctgctacgggatgcagctcctcgtgcagtccctcggcggcgccgtcgaggccggcgagaagcaggagtacgggaagatggaggtggaggtaaccgcccgctcctcggcgctgtacggggagggggaggtcgggaagcgccagacggtgtggatgagccacggggatgaggtggtgaggctgccggaggggttcgaggtggtggcgcgcagcgtgcagggtgccgtcgctgccgtcgagaaccgtgagaagcgcttctatgggcttcagtatcaccctgaggtagcgaccgttacgattcttacacacatttttcaattggtgttatctaaatcaatcaacaaattcaattgcatttattagtcgttcttggaatatcatctctttgttgaaatgtgcattttgtatttggattgatgttatctaaattaaccagcaaattcaattgcatttatcactctttctcggaaaattatctttgttgaaatgtgcattttgtatttcggtcgatgttgtctagattaaccaacaaattcaattgcaattattagttctctttgttgaaatgtgcattttgtggagcatataagatgtaaattttgtgggaaactgattggttattgacgattgattattatttagttttgaaggtcaatttttgttttgaccttttggatagtgggtcttcttttcctgaaatagctgggtatcctttggggaaggaaaatagtcagttatatctaaacttccacaatatgaaaaggtgaaatagctgggtatcttttggggccataatatgaaaaagtgaaatagctgggtatcctttggtgtaaggaaggttgttagttccacaatatgaaaaactgcaactttagaacgactgtgattgcgctacaactttaaattttgctttgtttcgtatttcctgaattaacctggatgctttctgcttatctagatcttgtgctaagttttataatgcaactgctgtatatggtgctgatgttttctgcacagagtaaaataaatttgtgtttggggcttagcatactgttgattgtgtgttcacttgattgggatttattattatgcactcaatttggttcttttgtagttggcatgcatgcatggcaaacatgttgttaaactgtttacaccaaagcatggttatgacgaagtattaatttaaactgtttacaccgaagcatggttatgacgaactattcattcttttcattatacaaggtgacacattcaccccaaggaatggaaacactgcggcgcttcctttttgatgtttgtgggataaaagctgattggaagatgcaagatgtgctggatgaagaaattaggacaatccaaagcatggttgggcctgatgaacatgtgatttgtgctttatctggtggagttgattcaactgttgctgccactctggttcacaaggcaataggggatagacttcactgtgtttttgttgacaatggcctattaaggtagtccttgtttcattatgttatttagtgataacattttcagaatcagtatgcaatggaactgacataagaccccttgtacagatacaatgagagggaacgggtaatgttaacctttgaaagtgacttgcaccttcccgtcacatgtgttgatgcatctgagcaatttcttagcaagctaaagggtgtcaaagatccagaaatgaagagaaagataattggaagggaattcatagcagtttttgatgattttgctcacaaattagaacagaagataggaaaaagacctggatatttagttcaagggacactgtaccctgatgtgattgaatcatgcccacctcctggaagcggaaggacacattctcataccatcaaaagccatcacaatgttggtggtcttccaaaagatatgaagttaaagctaattgaaccactcaagctcttatttaaggatgaggtctcattgaaatttatttacataatatctctccatttttatcctttgcatgatcttgtgcaataaaatttacataaattacattttgatggaaagattctgataagtaaatttcaaacatatttttctattccaaaaggtacggaagttggggagtattttaaatgtcccagagtcattcttgaagcgacacccatttcctgggcctggtcttgctgtacgtgtcctaggtgatgttacagaaggcaatgctttggaggttcttcgtcaggtttgaagcctttcaaactgttgaaaaatcactacatcagctttggtatatgatgttaattcgcattgtcatttatttgtcaggttgatgaaatatttgttcaagccattaaagatgcaggtctctatgatataatttggcaagcatttgctgtgtttttgcctgtacaaacagtgggagttcagggtgaccagagaactcactccaatgcagttgctttgagggcaattactagtgaggatggcatgactgcagattggtatgtaacactgacgttctggctcttacacccacttgcaatttgttgattgtcgcagccttcgttgtgccattttgcagcagtttcttgtggttcgacagatatgttatatacattgcacagttcacaataggatacttgtgaattgaatcatgcccaccttccagtagtttgaatgatgagatgatagttcagcattcacctttatacccttgcctattgccttcttgatcattatgttaataatttgctgattcatttttcatcggtttatcagccgtagagcaaacaacgagagtcttggtttatcagccgtatagcaaacaagaagtcttggttatctttgaaatatttttaaattatttgacaaatacaaatttagggtgttcattaattttatatttgtctctggtgcttgtcctgtatgcctatttcttggtgtgcaattattgcttaggtctgctgatagttcgaacctacagaaatacatttgttttgtgttgtgtgtgtgaatcttttgaaatcttgcatgttttcttatgtgataactttgccctgtgaactcttttctcaggtattattttgagcgtgagttcctggtagatgtggtcaacaagatctgcaacaatgtgcgaggtgttaaccgtgttgtccaggacatcacgcaaaagccacctgcgacagtggaatgggaataggaacttcgtgctctgaattctgatgccgtggagtggcctacttttatgctgcaatggagtgggaatatcaacatattcccatattatacatatagctgtttattactagattgtttgtttacatcctttgacaaatccctatttgtcaacctgtgatagattttgaactgagaaaagctttgaactgcacttattaactgtgctttctattcttgaatagatatcttcacctttgaagaccttttatcttttggagtaaatctttgttgctacaaaattttcattatcccttgtgccccccatcttttagacaaagagatgtgccatctacaggatttggattttttttttcaattgttcttttaggacagaatcttttagacaaaagggatgtgccatctatggatatggattttttttttcatattgattctttaggatagattattggtgttgaaaactgacgttggagtcattgggccttctggttttagcggacgttggctaattgactgctcgattatggcattgcattctgaagattgagcatctttttcctttttatggccccatcgtgaaacgatatatttacaaataaaaagtaatttgtgaataaaatatttatataaggtcttcttagtgatctaaaagcaaaagctgaaaaataaactttgatgaaaaaactgtaaaatcagatttaaggttgaaaatttaaattttggatgataagtatgagcataagcgaaaaaacaaagctcttaattgcaaagcgtcgaaatatattaacactaactggcaacctttactgtggcaacctttactgctgcggtgcaggatgtgtctgatccattgttaggtttttttttagataatggataaaatccagcctctatatctaaagtggatatacacagccaaaggttgtttacacaagtgcatacactctaaaacccatgattgagaaacatgaaaaagaacaaccgaaaagaaaacactagaaagtagatgcggagctagcccgcccttccacacccccctgctgtcactgcaaccaccataaaagcttcttcattctagtctaatcaccttgtagttgccaagcaagggtctcatgctgcctgaacaacctactcatctgcggtgctaactactatcgctaccatgccgtcgtcgctgtagagaaccatcttcgtcgagctgccatagtgccatagcttatctcgccaaaagtcgtcgttgctacactgacaccacatcacacgacaaccaacaccccaaaatgcaaacgacaccctgttgccccatcgcccactccgccgagcggccaaagcttatctcatcagaggacctccgctgccaagttttcgtcattacagaccaaaactttcgccaagccgttgtagcttatctcaccgaagagttgtcgctgcaatgccgatatcaccgcagaacaatgattcatcttgttaggtttactactgattcttcttgtttacaatttttcttgaacaatgacctctctaattattttaattctctctattttttcttattttatcattattttgaatggagttcaatggttaaaacggatcttaaaaatatatgtttgaaatatataagccatcaaaaaaatttaaatagacagtatacatgtattactcacattgtcggaggctattgtatgcgtctcgccgtaagattaattcgtgcgtgcgcgccggttagattttatcaatttggacatatatccaatgttgttttcacttgccttaactagtaattaataaatattgttagacaaaagtgataggaaaaaagtcaacatgttatttatttatattaaaaaaacagaggaagtaaaaaatgtgaaaaaccaacaggaaaaaaaatcgaggaaagtactctgcccggccagatgctcagccgggcccggtgttgaagcgttcctccggtgatctggactatttttcgcggtcaaggttagccaaatttaggacttgagaaaccgtccctgcaagcaaaacgaaacgaacaaaaaaaaaaaatcctggatcaccaagcttatttataccactcagtcacactcactggagatcgatcaagacgacgacgagtgatcatcctcatcatccatggcgagcagtaggctgttcctcgccgccgccctcctgtgcctcgcctcctccgcccaagcattcaagaaggcaagcacaaaaccacacagaattcattcatctactctataatttctgatgaatttcttgtgtcatttcgattcagtgaaacaaactgggtgtgatcctttctgatgcttttttttcttttttttttctttttttttgttgttgttgttgttgttgttgttattatggccacaatgtttgggcgcagccctacatcgtgtatctgggatcacacccgtacggcccagatgcgtcggcggaggagcacgcccgtgcgacgcagtctcaccacgaccttctaggatcagttcttggcaggtaataaactcactcacctagattggtgataatcgctattacagactgtgtttctatgattcttctttctgttcttgattgatggaaacaaaaataaaatgttggactaatgcacggacgcacgcagtaagcaaaaataaaatgttggactaatgcacggacgcacgcagtaagcaattggccaaggacgcgatactctactcctacaccaagaacatcaacggcttcgcggcgcatctggaggaggaggtagcaacccagatcgcgagtaagaagagaacatctaaattgatcaagaaccgatgagtagaatacataggacaaattcgatggcacatcaacgaaaatgtttggagttgcagggcaccctgacgtggtgacggtgatggcgagcacgatgctgaagctgcacacgacgaggtcatgggacttcatggacatggagagggacggccagatcctcccggactccatctggaagcacggcaggttcggccaggacgtcatcatcgccaacctcgacagcggtacgcatcgctatctttatttatttatttattttttaaataatagaataaaactttcgacctttgcttcaaataaactacagtcacctattacaaaattctctcaaagagagcaaatacacaggcttattgccatcttaattttgatgcgtttttgggttcctcgagctcccatggttgattactaattaatctctgccgttaatggtgatcgaatcaaggtgtgtggccggagtccaacagcttcaccgacgaggaagtggtcggcgaggtgcccaagcgctggaagggctcctgctctgacaccgccaagtacggtgtctcctgcaacaagtgagtggctccatttctcggccgtctttgaattgcagaatttttttttctttacccacctcattaatagttcatcatatacaataaagacagatttggagtttcaaatcttacagaattttcaaccaataaatacaacctgtttaaaatgaaaataaaaaagagagagagaggaagaagcatgtcaaaatatcttaaatctaggggaaaaacagttgtaaaatctttttcttttgcattgtaaccgagtattattgttctataatcaagtgtaggtgctctataactgagtgtaactacaagtttagtctacaggaacccgaatcttgatcaaagattctatggatgaaaaatcgagctaaaaaatgtatcgtaagtgaaatattaaaacccgatagattatattaaagagagcatttttgactataagcagttagtcataccgatcaggggatagtgtttttacaataaacacttgtcgaatttaaatttatcatgacactataaaattcctgcatccgccggtggattcgttcatgtgagattttgcaggaagctgatcggcgccaggtacttcaacaaggacatgctgttgagcaacccgggcgcggtggacggcaactggtcgcgcgacacggaggggcacggcacgcacacgctgtccaccgccggcggccgcttcgtgcccagggccagcctcttcggctacgccaacggcacggccaagggcggcgcgccgcgggcgcgcgtcgcggcctacaaggtgtgctggtccggcgagtgcgccgccgccgacgtgctggcggggttcgaggccgccatccacgacggcgccgacgtcatctccgtctccttcggccaggacgcgccggtcgccaccgtcgcctccttcctccaggagcccgtcacgctcggctccctccacgccgccatgaatggcgtctccgtcgtctgctccgccggcaactccgggcccctcgaggacaccgtcgtcaacgccgcgccgtgggtcaccaccgtcgccgccagcaccgtcgaccgggacttccccaacgtcgtcacgctcggcaacaacgcgcacatgacggtaatgatcacctcgtcccacgccattgttaactatagctatatccatggacgaacacttgggacgacatggctcacggtgcaagcttgtctctcccaatgctgcgtgcgtcgcaggggatgagcttggagacgacgaccttgcactctacccagctctactcgatgatcaaagccagcgacgccgcgctcgcgagctctgaccccgccgtcgcgtacgtaccatcctttgaacacgtgaaattttctttctaatttgtgtgagatgatatgagatcgaattgaactgattcgtgtcaaaatcatggcaaaaaaatctgtatggtttttcaggtcgacttgcccaccaggcacgcttgacccggagaaggtgaagaacaagatcgtggtgtgcgtgcgtggcggcgacatcccaagggtgacgaagggcatgaccgtcctcaacgccggcggcaccgggatgatcctcgcgaacggcgagatggacggcgacgacatcgtcgccgacccgcacgtgctcccagccaccatgatcacctacagcgaggccatgtcgctgtacaagtacatggactcctccaagaaccccgtggcgaacatctcgccgtccaagacggaggtcggcgtgaagaactcgccgtcggtggcggccttctcgtcgcgggggccaagcgggacgctgccgtgcgtgctgaagccggacatcgcggcgccgggcgtggacatcctggcggcgttcaccgagtacgtcagcccgacggaggtccccaacgacgagcggcggtcggagtacgccatcctgtccggcacgtccatggcgtgcccgcacatctccggcgtgatcgggctcctcaaggcggcgcgcccggagtggagccccgccgcgatgcgctccgcgatcatgaccacggcgcgcacccaggacaacaccggcgcgccgatgcgcgaccacgacgggagggaggcgacggcgttcgcgttcggcgccggcaacatccacccgaaccgcgccgtcgacccgggcctcgtctacgacctctccaaggaggactacttcgtcttcctctgctccatggggttcaactccagcgacctcgccaagctgagtgccggcaacttcacctgcccggagaaggtcccgccgatggaggacctcaactacccgtccatcgtggtgccggcgctgcggcacacgtcgacggtggcgcggcggctcaagtgcgtcggccggccggcgacgtaccgcgcgacgtggcgcgccccgtacggggtcaacatgacggtggagccggcggcgctggagttcggcaaggacggcgaggtgaaggagttcaaggtgacgttcaagtcggagaaggacaagctcggcaagggctacgtcttcgggaggctcgtctggtcggatgggacccaccatgtcaggagccccgtcgtggtcaacgccttggactgaggcgccgagattcgtgcgcgcgctatcgatccaagacgggcgcagatcagggtttaggtgttcttttattatttattttttgattgagagggataatattatagtccattatagagtgagaggctagatctcttggttgttaataaggttggatattttttcggaattgctgtaaagttgtcgacggttttttctccaaaagattttcactttgtggacctttagattattgttgagatttgtgatacttggcgttcaatatatagttatgtgataaatctttatctttactacttaaaaattctgtagtggtggtggtgactccaaccctgacagacacgcgaaacatgagctgtcagatcgccaaatccaactgctaagatcgatccccagtcccataccacgatcgcgcttctccccctcgatccgcctgtgaccccacccacaaacagcgcatcgcactccccactattcgtgcacctacctccgtcgcccgctcttccgctccccccactgccttcgtccaaccgccgctgccgcacagaggagtcctcggtgagaccaagtgctgccagcgcccgtcgcacctgccgccaggtaatcgtcgtgtcattgccgcataccgcccctccggcgacatcgcatcccccttcaatttgctgtcgccgtcaccatcgattcctccagatcgggcgtcgtccatcttgcctcccgttgcccttgcccgttaccgctgcggtcccctcgctctcggcgccgcatcgctcccctccgctgtcatcgcggtccgtgcctcgtcgctgcgccccttgaatcgttgttgctgtccatcgttcctccctgtgcccacgccaacggccgcccccgacgacatcctcgcagccccctctgcccaccccaatcgcccccaatgccgccgacgcatcacgcccgcccccgatgttgccaacgcatcgcgccgccgtccttctaccccaacccccaactgcaatctcctcagccttgccacgattgcgattccttgcctctcccattctgctaccgccaccgacgcggcccttctgcctcgccaaatcctcacctgaatttgacgcgcccttctgatcatgtgcctatcagtccaccggccacgggagtcatcttatcctaatgccatcagcctacccacatcatcaacgccatatatatccatctcgccgcgtacctcgccatcgtcgcaagcctattcgcccacgggggccttggatcctgccgcgtgcggaactctgtcgatgaagccaagcgcaagcgggctctcccttccacaatatgcactcgcaggtggagcttgattcggagtgcaccgcagccagaggtttgaccggtcattagcgtcgggcatcccaattcaccgatggcctaggtcatccgctagacaatggagctcaaggatctatctgatagatccattagagcaggtacaatagcgggctattagccagctatacacgtattttaatgaaataaaagatgagagagaagagcagcgggctacagatttgtagccagctgcagcacggactccaagacgcgatgtgtgtattacatgtgagaccatatattaatagtatagtaagcaactattatatgaattggctattagattagctataggtaaattagagccaacagtgggctatactattgaacttatagccatcgtgctgctgctgaggcgtgtgataacaggagaggagtcccgagattctcagtagctggcgacggcatgcagtggcgcctgtgcatgctagaaggaggattctttgtacaggtgagagcaatattaagggcccaatatgtgttcaaaatagattgagatagaaaatttgctctgcaaaatatatgaatttgtgtaccatactaccatctgcagtgtagatggaagttctaaaaaaaaaaatcagttgcaggggatgtcaaatttgcactttgtaccgtttgcaggggaccttcacccttctacttatactaaggtaaaccttccgagcatggtttttcagttttgtccgccagaaagatttctttgctaacgctgatctgatccgtccagccaagacagatgcacatgctgcgctgggtggttgtaggcaccatccgttgctggattttctaaggtattgtttagtagtactgccttcagcattgcgtcctaatctgttaggattcaatgttcgctcttttctgctattgttgggttttggtcttgtaatattgtttgtgatcttttctgctgtttacttgtgaatccggagattgcttagtgcataaaccgagatcatacatcatggaatttctgttcttccatacatcacgaaattttcatttactatgattcctcaactattaattattcttttgcaccctatgtttgcccttattgtctcaaaatttggacagtggttagtgtttagtgaacaacatgtaatttgatgattctatgtactccttctgtttcaggttataagatgttttgactttggtcaaagtcaaactgcttcaagtttaaccaagtttatagaaaaaaataataatattttcaacccaagataaatttattataaaaatatatttaattattaatttaataaaactaatttgataatgtaaatattactatatttgtctataaacttagttaaatttgaagcagttggactttaaccaaagtcaaaacatcttataaccctgaaatggagggaatactaaggtgttgtcatgacattatatgtcatctattgctcagtatagcagaattccttacttagattccactgttgcttttgtttagatttgcaatagctgaatcatgcatttgttgtgccttttgcttttctgttgtgcaaaaatgtaaaccttttattctggcaagctaaggtcaggaaaaagctggaaaataccatatgcaactagctgatttgtgtcttgtggggcgagttgcagtacggttggttgtgtcagaagattcacagggccagactcaacaacgatcgtcgagaaataggattgttatgttactttagagaagtcttgttagtggtactttagatataagtcttgttaaatcaggttaagttcagatatatattgagttaaatcaagattaagttaacttgagtttgttaaggggtcaagtctatataggagatgtaatcgtactgttatggcaactaataaactaatcaatctccaagctcatataattatcgttccccttttctcttcttcctcctacgttccctcttccctatgcatattctttctttcttgtatacagagccatcaccaccgttgtatatttctttacttggtctcagaatgcactgaacgtttctactttttatgtttactaaaatagaaagcacaaattgtttatttgacaatggtattagttgtatggagtattgtgtttttaaatttgaagaaatgaggaggttaacggtttaagatgctttgcatgaacattactttgacatttagaccttgagctcaaagttgtcttattgtccagggactcaacttttgggatgtgtttattggcatggagaaaaaaaatacaaatatatgaagcctctgacttattaagtcgttgtatgtgttagttgatggcaatgcagagctggcactataaggaaatgagggtgttgaagcaagtgtagagcaccaaacttcttctgcaacaaccctatcttccatgggaaccattgtgttatttgttttgctatagaatgagaaccattgtgtagaatttcgcaaagaactttaaccattgtgtagaattttgtaaaggattatgtttcatttgatgcattaggaatgagaagcagatgaaactatagacaatctttccaaagtattgcgtgaaaatatgaagtgtatcaatatgtaggttcttaatgttccgttccattaatcaattttgttatatggggtactaaaatgtgaatactataaacatgtgaaaattataaatatgtgacataattattattagttctatattaaatattttgttacagttgatttacactcattgattatttaccatcatttcactcagtgtgatttttccccgttgcaacgcacgggcacgctgctagtttatggttaaatttgtaggtttaattgactgttttttctactccctccatttaaaaacaaattctgattacgaatatagaaataatattgaaactgagaaattgtttatatttttatggaaggtgtaggtcggaaagtttagggttaaatattgtctagtttcaaagtttatcatcgttttatagttttgcaaatattttggtatgtaaaatgatttttttaaaaaaatactcctccgtttcttaatagatgacgccgttgactttttttttcatttttgaccattcggtttattcacaaattttatgcatatgtataagatataagtcacacttaaaatactataagtgataaaacaactgataactaaataaattataattacgtaaattttttgaataagacgaatggtcaaacatgtgagaaaaagtcaacagcgtcatatattaaaaaacggaggtagtaacaattatatcgtttaacatcataatttgtaggttttgttgataacaacaaaaaattagacacaacaataaatcaagtgctgttttattacgtttaggaaaatgtttcgttactagctcagaaatgtttcaaacatgtatgcaataccgtctaaccctagccaaaacattttctctatcgcgtgtgaaatatcgaaatacattagacggagacattgaaaaatcacaaaatgtacatcattaccagtaacacgattagccccgagtgccaaaatttttctgacgtgtatctattagcttgtcaagagcaaacaaatttttctgaagtgtgtgtaaaactgtcagaaaaaaattattttcctaacgtgcttttaacaccgtcacgatatcacaaatttctctgaagatgagaatgtgtatttagtatatgaattttgtacgtaccagaaaaattggtggcctagtgggtatcatttattgagtggcaactcaaattttaacactaacgatataaatagtgaaatatagtttaatttttatgacgtgactttattgttagtgagattctaatgaacctaacggcgttgacaacgtcggaaaaattcattgtgacgatcaaacctgtgaggattaatattcgtcctcatggagactagtcatgcaaactaaaattttcctgacaagcaagttgtaacgaaattttccagatggtttctggctgtcagggctagttgagtttgtggtagtgcatgtttagatcttgcttctttcttctctcccgtcgttggatctccagcctcttcttcatgggcaaccatccgatgaagacagcgaactagtcggcctcctccctcctccgccgaagcatagtggcacgctggtgcaggagctccagcgaggagggctcctcccgacgcacgcgtataccgtcgatggatatgtctcgctgtgctcgtgttgttcgcacaatgccagcattcaggcacccttcaccataaaccaaaattcctcgaaaattaaacctttttgtcacaaaagaaatagccgataatgataattagtgcctatattagttataggctatagttgttaagaaagatgaaagatacgccaatgggaggtgcactagatctaacgtaatcagctactagaagttagtaaaattcttaaccttagtttttttttttttggttgttgtttgtcatggcgagggtcttaaaaattgctagaggtttaaaatttacccattcgacatatatccaagattgaacataagctgtcgaaagggcaaatttcaaaccaagattgaacataagctgtcgaaagggcaaatttcaaaccttgagtaatttttaagacaccacggtattatcatgtatcatttaatttttgctgttaattctttcattatttagaatatatacgtacaatcatgtacaccactatgcatatgcacactcatataacagtgagagctagtgcaccctctttttttaacacacgataaagaggccgattccaataacaaatccataaatatagctaaactctcattaaaaagagcatccatgtgtatagttgtgaacatcatttattgtatctccaggtgttatactaaagtaatactgggcctgttcggctgcactacagggggctacgatgctgcagcctcgcacagtattttatgtagcgcacactactagaaaaatagtttttagaggcagtcaaaaacagttatcgcaggcgggggagacaaccgccgctatccaattgcctgtgaaaataggtgatttttgcaggcgggtccgcgacccacctgcgaaaataattttagggaacaaaaaaaaaatccggcgctacccgcaggtgacgccgccggcgccagcatccccctctgaccgacggctctccacctctgtccggcgccgctgcccgagggcgaggggagcgccgcctttgccgccactgccggctggctcccttctcagatctgggaggggagcggctggtgctgtctgtgcccccgcggccgtcggctcctcttccgccgccggcgtctagggggaacgaaaggagaggattagtgcccagagccgccgcctcctcctccttgcgtgcgccgagacgccgacggctgccggttgctcctctccttgcgcgcgccgaccaggccatcggttcctcctcctttgacgtcgccgcggtgtcacgccctgaagttccacctcccttgctttaaattcataaaataaatcgcctaaagaagttgcttcaaattaacctagagttgaatccttaattaataaatacatttaataatcgaattcggcgtggtggaattttttttgagttccccatgctcaaatatattaacagaatttttagtggaatttttaaagccttggaaataattttaaccaattaaaaatgagcatgtgcaatatttaatcctaggaaatccgttttctttttctctttttcttttcctcctttttccctcttcttgggctgtcggcccatcctttctcccgcacctctccctccttgctgggccggcccaactcccctcccctttctctagggtgccgacaggtggggcccacctgtcggtcatcccctacctccagccgcccgcgcccaagctggcaaccgccgcccacaccgccgctttccccgcttcccgtgccccactccgcccatgctccgcgcccacgtcgccacccaccttccccacgccttaccgcctccgcgcgcgcgcccgagagggcgggattcgattttgaatccgcccctctctctctctctccaccccacgtcgccggcgccactcctccaaatccggccacctcccggcctcgcccgcttctcactcggctataaaacgccttccccgagctccctctctcgtttcccctactcgccgccttctcccgtgctctccaccgcgcccgcgccgctcgccccttgcgccgccgcctgccactgcactccggccgcgcgccgtcgccacgccacctgccgccgcctctagctccgccgacacaagggctacctcggccgccactcagttgccgcctactgccgcctccaaccgccactagccgtcgatagtgccattgccgcgccgctttgttgccgccgttggcctcgtgggtccgagggccgcctcgtccatcccgcgcaccccgccgtccgccgcttgccgccggtgttcgccgtcgtctttccccactccggccaactcacggtgaggcgctccctcctgctcgtttctcctccctctcccccctagcgccgggccgcgccgctgcttcgcccgtgcgccgtcgccttcggccgacgccgctgccacccgcgccgccggttgccatcgccggcgaccgctcgccgccgccgccctcgccataaccggccagtcggccttgaggccgagccgagcccggccggcacctccctcccctcccctttgagccaccgcctggtgggacccacccgccaggcgcctcctcccctcttttggagccgctgccagtgggacccaccagccaccccccccccgctgacgtcagccctaggcaatattgcacaataaataattaatgacttttttcttttatagtaaaaacacaaataatcttcttaaattcataactaactagccacatggttgcgctttgcgcaactctaaatacatgtttaagaacctgtgtcaatggcatccacccatacacaaacacaatcatctacgtggccaagacccctgagtaacaacttgatcctaagcatttatattgtgatgcgtagtagtacattataatgtacatgcccacaaaaaatttgatcccaaatctaataaaataacaaaaacaaatgtagtagctttgtgttcttccaccaaatgcatggtggtaccgtggtattcacctggaaacataaaaaatataatctttttaagagcaaatcatagattagcaggaccagttgatttatgttcttccaccaaatgcacgttggtattcacccacaaaaacaaaaagtatgaaattcttatgagctaatctcatatgagaaggaccagtaaggacatagtctcatgtaaaaatgatagaaagatatgctcctcaatttgtacaatgattaatgagtatggagtactacagtattacagatatagataggtgtcatatgataatccaatatctaaagctctgccaaatattccaatagcagtatgcatggtattgcctttggattgataagaaatgcacctaggcctattaggacagtaaagaatctacgggttcgtggaaattaccataataccgttaattaaacttctaagcaagatttatgggtggtgcataatcacaaagctagcaattaacgtattataattctttcttgtaaatatgccttgtttaattttaaacgagaacccattcttcctgtcgacacatcattcacacttctacacacacacaaaatatcattgaaactcattgctcttatagctcaattctatgcttgatcaagtagtctaagacattttactggcacttggaaaaataaggataggtgtaaatattacttaccgatggtctgtacagataatttatttctccctcctccgctgcgtacccaagcataaggccccaccactgatgtcgatgatttaattacaacgctgcagccgtgcagtgcctgctgatgcaaaataaaataggatcagaatgaagcatcctaatacgggccgatgttggccaaaactacatcttgtgtgagttaaccttttttgtttaaacagttagggttatccctaaatcaacatgtgctactgaactttctactgttgcaggcgcagggaaaaataatttcagtcgagatgtcttcagtagcagcgatataaataacttctagaaaaaaattaaataataggaatcaggaaggctataccaactaaagctggtacccgaataattatcctttttaatagtagtgcacacaatttagcaagatagaagtgtatacattattgcagcccttatgtaaactgctgaaatcctttccatgagcaaatatttttctaagtcagtcataaatgaagatagtaatccactctccatgaatagattattagtgtaattaagcattggtgacttgagctgtacagtatatgcatctgtaaattaatactaactataatcgatttacatgagtctctaatttgtctggtccctctgaagctaaagctgggatttttcttttggtgtatttgtttgtgattcatgaaacatttagatacacttcatcatctgttgtgcgataccttagagaatcatttactttgagtataggtaaacagatctacattctacaaaatatttttatttgctgatacttgcagttctactcagttgtcccaaacttgattttctcaattgtaattatagccaatcatggagcctaaattgatacgatttttgggcttatgaaataaagcctaataaagataattaatattggaattcataaggtgcatacatataatacaaatcaatatagtagtatttgaaaggctaacatccaatcaacagtcaagaaaggaagatagagaaggaaacagagaatgaggaatagaaagagagtgaccttggttgttctgccctggataccgatttggtgaataggtgtggacgcagctcctgcggataccctcctcctcgccatcgctattcatctgtcaaccctttccccccttcttcagggtagcgggagattagaggtggatgtgatgcgccggtgccggtggggtatacggcggcggcaggggtgggatggagccgcggtgatgaggggatgagtaacgccggcaatggagacagagaggactagagggggaggtagcggcggcttgggagaagaggcggcgcgcggcggctgggcctcaggagcggaggcggcgtgaagacgagaagagtcgcgttctttcttcttctttttttaccgcagggacgtggaaggacctcgttgtgaaagaaatttctagaaggaataagaagatatttcgccgatctaggatctaacggcctgaaactttctgaataggaatcggacggtccatattttgttgatgacgtggctcaatgttgttttgagaaactttaataatttcactacttttgattcatccgagctccgtttaagtccattcaagtctcagtaaattcataaaaaatgcatagaatccattaaaaatggtgttgtttcctgtttcagtagtcttatagcatgttttgcttgtgtgctttggttgtcgcgtagatttcggttgttttgtcgatccgcggtttctcgaagacgttgctgagacctcatcagtgcaagagcaaggtaaatcatgcattacaattgatcatattgtacccaccttacaaatgtcccgcatttctattaaatgttgcattgttttacaatatcatatgggatgggtcctactactcagccatatattgtttacctgatgccattgataacttgggtattaaaatgattagatgttggtttagggaatgcttagccatgcttagttcaactagtacacaaagggggaatcacattaatgcatagactttgattattggtatagctttggaatagtaccaccgcaatggtgttagctaattaaaatacactacatggtgggctgtgggtgcatggttttgctaatcgtgcccatgacgattaaggaccggttcgcgagatgccctggaagaacttatcgtacttaccataagccagcgtgggcaacggctgggcttgtagtgtagctttcctctagccgacatacccaggttagggtgggtatgatggagttgggtcggccggggtgttcggttgatcggcttccggattcactgtggcacgagaggggggctgcccgttgcctgctggggacgggggcgaaccttgaggtgtggtgcgatcggttagagggggttatgcgaagggtcctatcacgacctctttccggtatgtcgtggtggcatgtcggcgcacagatacatgtcgtggggctgtgtcttgtgggtacagttgtatacctctgattagagtaaaactgttcgaatagatgtgcccgcggttataggcggtcgaccagattcaccgttgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacatcccacacctacccccacctcccccgaagacagagatgacgcgggaccgtagctgtctgtcgatgacgcgaccagtgccagaccggtcgagctcggtaccccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacagtagcccccggcgttatgccagagcaatttcccttctcaagggaagcggtcaggtgtgacgccacccctaaagcctggtgacaggtgggaccggtctccgtagttgggcacaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaacgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccgttgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccaccattttcttctttcttcatggatgtcctggagttctacgatctccagatggcgcacctcacccccaatgcggtgatgacattggccatcttcgcgcacctgtgcgagatgttcattggggtgcgcccttctcttcagctgttccggtggttcttcaccgtgcagtcggtgtcaccgccgtcggtggttggcggctgctacttccagccgcgggggccggtgttgaaccgctacatcccttgcgtcctccgcaagaagtgggacgactggaagagcgactggttctacacccccctcgccaacgaagcgcgcctccgacttccaagccaggccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccctgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccttcgcaggttcgtctcactctcattgcaaccatctttctcccaaaaggaagttttttcttactcattttgttcgttttctggttttttcttctgcttcagcgatgtcccgtcgcattcctcccgccaccccaagtccggccagtccgaggccgaagatcctgcggccgcagaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggttcgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctacgccgaggaggagtgcgcgctccgtctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgctgacctcgaggagcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgggtcggggatgctgccgaccacatcgtcaacggcttcgagggctcggcccctcggctcgcgttcgcccccgactccgacgaggaggggaacgccagcagtggaagcgacggtggcaacgaggccggcgacctgggcgcgtcagaatgagcccccaggcccccgccaatctccaattttttctttttgtatagatcaacttaatctgcaatcaaaaatgatgaaaaatttctatgttaactttattttgctatacatatgagttgaggatgatttgtgccgtggttcttttgcattttagcttgatttaagggctcgtgctcaagtccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaaccgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgctcgatgttccacgggttcggcagttcagtgccgtcgcccgtggccagccgtacggagcccggccgggggacgccgatcactcgatacgggccctcccacattggtgagagcttgctcagtccagcacgcgtttggacgcggcgtaggacgaggtcgtcaacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaagcgggccgtgatgcccttaatgaatttaagagcagagtgtttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggaatgatctgcagggcctgggccggctggtggatttgcttggcgtggaactgacacgctctgcatcgccggaccatgtcgactgcatcattgagagctgttggccaatagaacccttgacgaaaggccttgccaaccaaggtgcgcgaggcggaatgggctccgcattcgccttcatggatatcggcaagaagctcaacgcctcgttcctgaggaatgcatttcaggaggattccgttagccgcacgccgatagagggtcccttctatcagcacatagcgtttggaaatgcgttggacgcgttcactcccttcgcggtcctcaggtagagtcttatctgtgaggtatgcttggatctcagagatccaagcaatcaatctaagggagcttggagcgctcccttcgggtcccgagacctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcatcggcaatcatattatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagtccggccgccactctgagtccggcaaggagtccctcatactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtgtgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcgttcttcgtccaagtggcctctcggggcgcactcgtcttctgtgccgatgtcctcggggtcggaggatgacaggagcggtcttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcgcccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacgcacacttatcggggttcagctttatgcgggcggagcggaggttctcaaaagtttccgctagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcgtctagaaaacacaaaaggtcgcaccccgcagtggagtcgacggtctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgtgactttaaggtcgccacggacagagatggggccaccagggcccggcatcttcatctggaggtaggcgtagtggaccgccgccataaacttcaccaacgcgggcctccccaggaccgcgttgtagggcagactgaggtccaccacatcgaagttcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgccttctgtcctcctcccacttcctcgttcgctcagccaggtttttgactgcacgacagtccgcgagatcgtggagggaggtattgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagcggcggatccgggggcggccgaagctgtcactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcagaaccgctgaatgtacgagcgaagcgactcatcatcgcctcgctgtactgcatgcaagtccgcttcttcgcctgggcgcggatatgtgccttggaaattcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcacggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcaacggcgtggattcggctccccgtcgtcgccgctcacactcggagagaggtcgtgcgcttttccttgctcggccattaggctgaacaagaaaaacttggcgcacacggaagagtctgagagctcagaaaacacacactgagccccctacctggcgcgccagatgacggagctcgtggcccctcaccgggagaccgcgcaggcccccctttgccagttcggccgggggcttagggtgagatctcaagctctctctctctctctgtatgtggaaagatcacccccccgcaagacacacgagacacggcgatgtatacaggttcgggccgctgccaagcgtaataccctactcctgtgtttttgtggatttgtgtatggacaagttacaaaggattcacttcctttcccctccgccttccaaaagggaaaaaagtcccctctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcaaacttccttaaggggtcggggtgcctcggccctcggggccggggcaagcgcaacctcgggggaaatcaggaggagggcggacacctcaccctcgggcccgacgttcccgaaggtgccaggccacgtgggcgattgcgtctgcctcaagcctctggtcatgatactcccggtcccatatcaccgacaaccgtgattagtcttacccctagttagctatcgaactggtgtagttcaggtggttggttgggcctgttgcaacgtggtgtagcgttagacaatgattggttaatattgattaattactacaactgttttactgctttcaactactgcttttaaatgctagctttatgcaaaaggacctttagcctcccttggatatatcctgcatcatacctcctcttccggtatgacttgctgagtatagtgggtagtactcagtcttgctctcttttcccccataacagagctgaagatcttcctagttggagctgtctcgttgaggttggttttgtcgctgccgtcaagtattgcctgtggaatggagtcgcccgctgcaggagtcaagtcttcaggcttagctcgcttttatcttttccgctgcatctgtaatcttttatatttttgtaagacgtggagctgtatgtcaacaattgtcgtttgtgtaccctggctggtcctggacaggggtttaatgcacattcagcttagaaattatggttcgtgagtttctggcgtgacacgcggcccccttcctcccgctgccgccaacctcccgccgccgccaccgccgcacgagtggtcaccgccctccccccgccccctcaggccagatctgggagggagcgagggaggggagcgccgcgggccaccacccccctcgggccagatctggaagttagggaggagccaggagccgccaccgcctccaccggtagccactgccctccgccgccaacctcccgccgctgccgtcgctgccgccgcacgcgtggccaccaccctccccccgcccccctcaggccagatctgggagggagcaagggaggggagcgccgccggcccccgccctccgccgccgcctccaccggtagctgccgccctccgccgccgtcagcgtcggggagaggaggagaggtgaggggagaggaaagagctgagagctgaggaagagaggtgaggtgaggtgcgggagagagctgagaggtgagggaaagaggacttagaaaaaatctagcgtatgtagcctctatttatattccctatgtattttcgcaggcggaccataaggtatttttgcagccgaccgtttaagtggtccgcctgtaaaaatggattttcactggtgggcagcgggtttcaccctaatttacatttttgtaggtggctatttggctccgaagatcatgtccgcctacgaaaataaatacccaacgtcggcaaaactgtttttctagtagtggcagctgcctaactggttgtgttacagccgctgtaagatgctgccgaacatagccacgggtacctaggtggatttaaataaatgttttttaagaaaaaatttgcagatgtttattcatgccgtttgttgtttacaacattttcaatatgattgagtcatgttcgcagttctacccctccagggtaaaataacaaaaagaaaatctgacagcgctcggcttcagttttccattacaaaatcgcatctaatttacgatggtaggagcttttcaggttaattgcaattgtataatattattgtagaacacaaattgtatacgtaaagttgagaacgatcaatcactcatattgtcatcttagaaaaggaagaatcctacttaccccataccaagtgtcattattaaacgtctaatccaattcagatctgcaacattccacaagattttcccacaaagctatgccatcagatactacctgcccctgtactttcggcaatacgtttaccttatccactgggcatgccgacgccattagtgtcactgtcatgccagcctcacactcattccagctcaagctaagcaaagctaaccaacacattctttctagcattatccaaatccggcactgcgagcacttgccacatctgatcacatcaagagattaaagctaatcccaactcagatgtgatgcatcaaattttatatttttgggtcacactcgaacacactactcccaaacacttgaaaccgacatagtattgggtggtgacaagagattgctacaggcccagccattcattgtccttgctgtctggtctcccactgctgaagttagctggctgtttcatggataagattggggggaaaggaacatagccaaaaaagggaactggaaagggagaaaattgcattttgtgtgtactatgtgagatgctgtgatctgtggttgtccaaatatttgtttggcttatcctttgtaacggtttttgtgggtatgatgaacttgaggcatgaaagggcgatatctagaggttgtttgattctttgtaattgtttgtgtcgccaatttgggaatggtaaagatttgcccattgccaaaaaaaaaagaagcaaatgtgcttgtttggattgctttataagtatttcataccaaataatttgtcaatgacaaaagtttggttacaaattaaatgagtgacaactttgccatgtttccctaatttttacttcccctttctcgttgaatcgtctgataaatttaactgtttcatattataggtcgtttgacttttttttcttagtcaaagttctttaggtttgatcaagtttattgaaaaaattagcaacatctacaacaccaaattagtttcattaaatttaatatataatatattgtgataatatatttatttttcatgttcttgtactagatcgcacctatctacgatgtttctataatgtagacacaatttactctttttacttctttgattacaacaaatgaaagaattactgatatgtagggttgaaagtgattcggatagtctccgtccgaccagacctttttttcggattcggatagtttctattggatatatccggaaattttcaaattcggaaatgaaaacgaatatgatataggtgatatccctcggaatcatataatggtcaaatactatccgatatttccatcggattcttatgcaaaaacatgtttttcttttctttacttaggtggaacaaaacaaaccatatgaaaaagaaccaaggaataacaatcaacatacaaacaaatggaaaaattcaattctgaaaaataaccactcgaattttcaaaaactttaaattcaattctgaaaattttaaaaagagtaaattgcaccgactgtacaacaacttgacaggtggtgtgtgatacaatgtaagaacttgagaa

SEQ ID NO: 32754 - DNA, 20375 bp, Oryza sativa
cttgagaattgaacgtctgagtgcaacaacttgtactatatcgcacccacttgtcaagttgttgcactcagacattcaattctcaagttcttgcattatatcgcacaaacctatcaagttgttgtacagtcggtgcaattgaattttggtatatcaacttggctaagcatatggtaggcgagttttttttcacgatgttaatatgccattacatagtaatcatacggatattaccttataatattgaatttaatctttaagaattatactgcatattgtagtacaatttacatccaattaccttatcaaatatcaaccaaaatataataatttctacatccagtttaattgactttttgttattagttattaggataaaaatataaatatacttatataaatatacttatataaaaacttcataagtgatcgtataaattcaaaataaatatttaaaaattgaatttataaaaaaagtactccaaataattaagttgtcgcataactttttaatttattgtatcaaaatcgtagcaaccttgcaaattgttgcatttatacgatcacttatgaagtttttatactaaattgtacatacctgccaagttgttgcactagaacgctcatttctcaaattattgtaccaatttgcacccacctgccaagttgataaaccgtagatacaatttactctttaaaaaacttttaattcaaaaattgaaaagtttcagtttgaattcaaaactctcaacccatctttaaaaaattcaactcaaattctagaatgtttaattcaatttcgaaattctcaactccaattgaaatgttcaacccaaaatttaaaatattcaaccaattttcaaaaatttcaatgtgcctgcgaaaatttcagtgatacaattaatttatttgtttcaggataacataaatttgtatagaaaataaacacaacattttctatctcccccttgcccttgcaaatagagataaaatttgaaaatgttgatgttttgttttttaaaactaatggctacatctcttcctcgatttaagaagcttactttgaggggtcttgatattttgataattattcgtcaccgtattcgtttcgattcgtattcactccatatctgtattcgacaatatttgattatgttttcgtatccgggtttctgattccgatttcgattccaagaaaaaatatgaaaacaaatatgatagagctagtttccgaccgtattcgatccgttttcattcctactgttatgtttgtttaaaatatacttcaacaatattaaataaataattttagcttctgcaaaattactaaataaaaagtactccctccatcatgtactcatttttagctcattccatttgtcccaaaataaggttatttttagagtaatcattgtattagaatttgtgaaaaatagataattcttatattgggagtcgataaattgaaaaataattgtattgagatttgataaagtaatggtattatagtgttttggttttgtattggtatgtattggatggatgaaaaaaataaacttagggcctgttcaggtttctgccaaaataaacctttctaaaatttggcaatgtcaaaattttaataagttgataacattgccaaattttggtagaatcggttaactatgttattgctaaaattctttagacattaccaatgtttggtaacgaactgaatacatctacatgtttattaatttttttaaaagtaatatagttcgaaatggtattaatctgaacaagcttttaatttgggagggaggatgagggagtagtcaaaatgtaaacagcaagtcagcaacagcgaacaatcttatctatcgtgaaacagaggtgtaccagcacatgcatcatccacccagacccagagtgtcccagttaactttagaaaccagaattaattacgccagctaattcgtggctcaacagcaaataaatgaccaattagtctggaagggtagcaagtggcaacggtggcgaggtttagaaaagactgaaaatgcacgtacgtacgccagtattacatgatctgcaactgccacttaaactacgaatttgtaccatgccagatttactgacagcgaatcactttttttttctctatggagtagtgctaatataattaacgttaattaatgttgggtggagagtaattaagcatgtctgcttttgtgtactgtactagctgattccagagcattggcgtccctttttccgtcacagggcattggcggcacatgtggtttaggtaacctcacaccgtcacacgtactaatgacatggtcctaacacatggtagaatgataggctagtctactggtcattccaaaactacactttttggctttgtttagaaaaacaaaatattttctctgaccaaatatatgtgacaagagcattaaaaaattaaatttaaactcgtgtcatatccaaataaaatttaagaatattttttcacgattttgcatttacatacgaagggcatcatcttttcgcttatgtttatccatatcagcaaaaatttaaattttaacattaaatttggaactgattttgtggttttttcatcgaagtttatttttcagtcttttaattagctaagacacatatataaaatttttatttacttttcatttgcaaatatgttgggctagaattttgaaaaaactagcggaaatatctgcgggttgggatcgcgccacccaacatatgaccaaaacttcttgtttttttttttactcacaataccatgcgaccaaaacaccatattaacaccgaataaaaaaacaccatattaacacgagaaggttagtttaggcaatgtgaacgatgcagtcacgcggataagctatttgtggtaagcattcactgctggttggtgaactatgttaaatactcaatctatttcaggttataagatgtttaaactttgatcaaattaaactgttttaagtttggccaagtttatatatataaaaaatattttcaacctaagctaaatttattataaaaatatatttaattattaatttaataaaactaatttggtaatgtaaatattactatatttgactatacacttagtcaaacttaaagcaatacatgttataacttgaaacggagggagtagttcatttgacgagttaataaattcattcttatccaacatatattaaatcaaaagagaaatacgagaactaatagtgtgtaacaaatgataaacaccatgtgttacattttgttttgtcccttttcacacaaaacagcacagaattgtcctaggtacatatagctgtatagggcgtgctgtacctaaaattgtaaattggcaactggcacgtttaattttttttgaactttggcatgtttaattttagtacaacacgtccagtaggattctcacgtgatgtacactccatgaggaataaaaaaggtgaaaggtcaattataccaatcaaattttaaaaaatatgaaaccaaataaaaaaagaaatggataacctccagcacagatattctcatctcaccgaccaaattccccaaaccccaaatcaaatccaaaccgaaacctctttcctaattaaacgaaaaacacagggaccaaactgtaaatgcccaccactccctcccctaaacttcagccatgacatgagtgctcctcgcattttcatcagtggagaggaaggaagagaggaaaccccattgaggaggaggaggagatggtgaggcggcggcggcggtccgtgctgctgctcctcctcgccctcacggtgctctcgccgctcgtgctctacacgcgccgtctctcggcggcgctgaaccccaaccgtgagcgcatcttctttttctcttgttccttttcttttctttctttttcggtgtaattttggtgtagagattgccttctgtcgggcggtttcttgggcattggggtttatggtgttaccgtgtgatttcttgcagagaggagggatttgcctggcgaaatcgtgaatcaggtgcgtgtttctcggggttcttgcgagggattcgggagatttgtttggattttgatgagaacatttttttatggatttttttttgttttgctagggccgtggtgttaaggctagcaagctaaatgcacttcctctggtaaattttgttattgctcttcgtttcttcattttttgtttattttttcttggcgagggcgacgaataaaactggaggtttttttcttttggggttcaggaaactgtgggttctttgaaagaacccgttggcatcgtcttctcggaggagtcacgcgaatctgcaagcaaatcgaccgaacccgatagccaaggtctgggattttattttcttggtcctgtttgcatcttgtgttcctaggtccatggtatcgctctgtgaaattaaactatgatattttgagtttgtgctctgagttcgtttgcacgccaactgttcctagaatttctattgaggaaggcaggggagcacaagaaccgggtgctctctgaggccacggctgctgatagtgccagatcggaagacgatgacttgatcgagcaagtgacaagcaaggatggagaagatgatggcttggcgacggtgtcagttgatcagcagcagataaccacggcatcccaacagcgatctgcttctgaggttgatagtttattattgtcaagtttttatgtgcatcttaccaaatttagttatgttgtcacctgtggattagtcatctggacctttgggacctccgcatgtgctttagcttctatttgggattgcattattagtgttggggccaaactctgaatttgtggtaggtagggaaagtcttttttgtgcctattatacctaacttatcaatatctggtaatgttcctttcttgtgaaaagacagtggctactcatatcttgacgtatctttcttttcttgtcgtagtaggtcaaagtacctaagatgcaatgatgcattattttcaacattaaagaatgtgttggtaaattgttctgctcatgtcgttagaggaaaccatattttttagttgaacatgaattaatttatgcaatgtagctccgtacaaagtaactcagttgttttgttttcaaatgtgtgggtaaaatgctgtaagggtgtccttcagaaaagatgatgatcatagtttatctgacaatgttaatgcacagtttactgtaacaagatttatgctgttaaacaactagactaatgattaatcatggagtatgtcaagattcaaagcatttatgtttatcaattttgagaatgtgtgtatttggttcagttacggtcttctgcttcaggctaaagttaagtttctttgttatggaatgttctttgtgcacgcttttgttaatatgcttgcctctttcagccattccttaactttcctgtaagttaacttgactcccaatattcttgcctttcatgtttgtccacccaaaccgtttcttaagttgagattcttgtaccaactttgcaaggcatccctaaagtgtagaatcttggcacctgatgtgaagtccatttcacattatattccctcaacctttacaaatacaaggcacatagcaacctagacaaagtttcgttttgggaaatgaaactaccagacatttaaaaggctactcacatgagcacgtgcacacacattttcataattccttttgttgagttgactagaaatttctagatttggtagatctgttcacatgtttgtgcatccatatgctggggtcacctaaactgtagcactcatgcagaatttgtgccattttattatcaagtaatggtatcataattctgttcttgaatttcctttttaacaaaattcatttgccatatgttgagataatgatttcttgctaaatggtttcttttttattgcatggtcttctatttacaggcaagttcattggagaatgtgcctgaacagacatccatggaaaactctctggaaggaaacaaagatggtgctttgcttgatactagaatccgcaatatcagggatctgttaatcaaggcaaaggtctaccttggtcttggagccattcgagcaaatccccagtacctcaaagacttgaggcagcggattcgggaagttcaaaaggttcttggtgatgcatccaaggactccgatctacccaagaagtaagggtttcctatcctgtccgattgatgtatttaacattgtagctagttattatgttcaggatagcagcctcatcaattgttctgtaaccttttcatctgtcttgatttgatcagtgccaatgagaaggtgaaaacacttgcacaaacactgatcaagggaaaactgatgcaggatgattgttctgttgttgtcaaaaagcttcgagctatgcttcactcagctgaggagcaactgcatgcacacaagaagcaaactgttttcctaacacaacttgcagccaaaacccttcccaagggtcttcactgcctccccttgaggctagctaatgaatattttttattggatcctagccatcagcaattcccaaacaaggaaaaacttgatgaccccaaactatatcactatgcattgttctctgacaatatattggcagcagctgtagttgttaattcaacagtgttaaatgccaaggtatgtaatattctgtcctagtttgaattacgctggaagatgatagcaagcatcatactgagtagattttattttatttgcagcatccttctcatcatgtcttccacatagtaactgacagactaaactatgctccaatgagaatgtggttcctctctaaccctcctgggaaagcaacgattgaagtacggaatattgaagagttcacatggctaaatgccagctacagcccagtgctgaaacagctcgaatcacaatcaatgattgattactacttcaggacacatcgtgcaaactcagattcaaacttgaagtacagaaacccaaaatatctttctattctcaatcatttgcgattttatctacctgagatttacccaaatctccacaagattgtctttcttgatgatgatgtagtgataaagaaggacctaaccagcctctggtcaattgatatgaaggggaaagtaattggtgttgtagagacttgtggagagagcttccatcgttttgatcgttaccttaatttctcaaatcctgtcattgtgaagaattttgacccccatgcatgtggatgggcttttggaatgaatgtctttgatctggctgaatggaggcggcagaacataactgaaatctatcactcctggcaaaagcttgtaagattcacatattctttacttccttgcataaataaaagtacttgctagaaatatttctatctattgaagccaagatacttcttaacattcaagaaatcgtgttgtttgtagtgagtagttagtattgaaccaatactagcttgagggctgtatgcctttatccctgtacgtaaagaatgtgacagcgtactaaattttttttgaactgctacatggctggtttttatgtacaatgaacatacctatttttccgcttaaaccatgtatcaaggcttaggcccactttgattcaaaggaaattcataggagttttagaggatttcgttcctataggaatctttcctatatagctctttgaatcaaaggaatgaatcctatggaatcctatgaaattcctatggaatacctaataccatgctagttttggaggaattctaacatgaggttttacctcatggaaactttcctttgagtctttatctctcctctaattcctgcgtttttcttgtgattcaatcaaatgaccattcctgtgttttgcaatcctcagttttacacttacattcgtatgaaaatcctgtgtttttcctattcctacattttctcaatcttgtgtttttcctattcctacgttttctcaatcctgtgtaatcacttgtaatctatgaaattacctttttagaaaggtttgtaattagtgtagaaattatttatggaaatgataactaaaatatagtgtgtatcataagtgtcaggtggctttgagtgcttttagtactaacgttgagttgtgtactttcatgttcattttggttcacatatgtactgaaatatatcaatctttgcttgcagaatcaggacagattactatggaaacttggcactctgcctccaggtttgattacattctggaataagacgcttcccctcaatcgttcatggcatgtccttggtcttggttacaacccgcatgtgagcagcagagatattgaacgtgccgcggtcatacattacaatggcaatatgaagccttggctggagattggtctgcccaaattccgaaactactggtcggcatacctcgattatgaccagcccttcctgcgggagtgtaacatcaatccttgaagaaagatggcaccttcaatgatccacactgacataaccaatagttttccccattcgtgggtcttgtgctctttagtttagtttttctagtatttgattgatttttttttaattgtagatgtcagttgttaactagatttccttgccacctgtcctttgtatccctacttctgcataactgcagatatggttgtagatgttttgatattacattctctcctggggcaggaaaatgttaaatagtgtgattctcctgtgtatggctttttaatccctacttctgcataactgcagataagttgtagatgttttgagactgcattctttcctggggcggaaaaatgttatatggtgtgattctcctgtgtatggcctttttatctacctgaaagtttgttgcattgtcacttgaaacttatggaagtgtattccagtccccaaaaaaaaaaaatgaaaactggatattacaccaaacacgacaggttacccaactgtttccaccatatggtttgccggacgtgagcacatcgtgagtaaagtctagctcagctatttaacggtgcatttggatgtagtacactacttgcttgggctctggacacatctttgatcagatttagcaagttctccctatgatgtcaaatgaccgtatctaatccttgcagattattgggatattgatttaacttcactgccgatccaaagggattgtgtacatcttttctttatccaaaattatgcagccgaagtaaccgatggtgagatgaatagttcacggttaaatgaagggagatgaagccactgttttctaaaccgagccggattttcctggaccatttttatataatcttcttcgtgttcttattagtgcatatttgagacagtttagtatttttggggaatttccaatagaattgtgcatctgtttattaagactttcagaaagaaataaagaattaataggttttcaatttcaaaattggatatcatgccgggggtgaccgaaatttcgaaaatttctggctgaaattttttgaaatttgattgaatttgaataaaatgtgaccaaattcacaataatttgcaaaaaaccgaaaatttcgagcgatatttgagcatgccggtggggggggcgaaattaccgagatttcggaactttcaaatcctgcgtcacaccacaccaccaccacaatataaggaaacacggccacaccgagaaccttcaaaacaacgtctccaaaaagattacaacattaaaaacgccaccatcgctcatcccgaaacgatattgttttctcctagaggataacattaaagagggggaggaaggcacctcgacaaccttctcaagagggttacggcggcaaaagacgtcactgctgtcggataagaattgggctaaggttttgtcccgagccaccggcgcggggacgacgcgacacacgaaggggtatccgacagcagcaactctaatgagatggaatgatggatcgaaccagacggcttttgagacagtttagtctttgttccaattaattaagcatgacattggggtattcacaagttgagtgattcagaaactaatgccagtaatcggcagctcacttataccacgtacagaatccactataattaagcgtcaagggagaggggaaaaaaaaatcaaagcaacaaaatcgtctaagaaacgtacatgaaggagaaaagaaaagaaaatcgtctaagtagcataaagggaaaagaaaagaatcacaaattaattaagctcagtgcacgacacattaatcggagctagctaagctagtgtctttgttgcttgctaggtgcatgcttgccaagacagcatgcaaaaaattaacgatctcgtcacagatcgtcgtcatggggctacgggcacggcttggggttctggaagccggcgtacttggccctgacgttctcgcacttggacgacgagacgccgttccccttgtaccgcaggtcgacgtcctgcagcacgacgccctggcacggcaccccgcacttgagcagcaccgccacctgcgtcgtcgccgtccccttgatgttcttgaactgcacgtccttgatcgtcaccccggacacgaactgcacagttcgacgacggtcaggccgatcgatcgacggcaatggcgaatgaattaggaagatgaagatgcaccttgtgctcgcagttgtagtaggggcagtacttctggtcgatgatgatggggttctggacgtcgttcatgacgaggttctcgaacagcatgtgggcggcgttgctcttggtgggggagttctcccacgtcttgatgcggacgccgttcatggtgccgtggaaggtcatgtcgcggacgtggatccgcgtgacgtccccctcgccgacgtaccggccgaggctgcccacgctcatgccgtgccccggcccgcagtggacgcgcgccacgtcgatgttgtcgttcccctgcccgatggagatgcagtcgtcgcccgtcgcgatggtggtgtccgcgatggacaccccgttgctccgctcgatgtggatgccgtccgtgttcgggctgctctccggcgcgctgatcttcaccccgctgatcttcgccccgctgcactgcagcagcgccatgtggaagaacttgctgttcaccgacgccacgttctgcaccaccatgtttttgttgttcacgaacagcacgctctgcatactcgccattataatgtaagcttaattagctgcacactctgctaatggcgatgatgatggattgacgaaaggaagaagcaagatgctcacggtggggaggactttgcagtccttgcggatggggcacttgttgaagggccaggaggcggcgccctggccgtcgaaggcggcgccgttctggccggagacgatgaggtggttcacccacccgaactcgacccagtcgttgccgaacctcttcaggtcggtcgccgccttgagcgtcccctgcaaaacgcacccacccaccacacaccaccacggatcgttcgatcgatggatcaatcggtcagcccagccccacgtacttgctcgatcgagatggatggatgcaaaatgcaactgcatccatgtcacgtagtggccggccatggccacgggaccaaactgcctgctggttggttggtatacagtatacttgcctgcatgaggaaggtcatggtggtggccttgctgcaggggccatggaactgcaccggcccgatgtagtaggtccccggcgggagcaccagcgtcaccgccccggtcgccgcgcacgccgccttccacgccgtcatcagcgcctgcatgtcgcggacgaacacctcgcagttagccaagaagctaggggataattcaaccaaggagctagcttgatcgatcgattgttcctcagctaccttgctgtcgtcggtttggccgttccccttagcgccgtagttcctgacgttgaacgtcgggtccccgtggtaccccaccaccgacgagttaccggcggcggacgcgacggcggcgcagtgcccggcaacaacgacgacgacgacgagcagccgcagccgcgcctccatctccacagctagatagcgcacaggcacaggcacaggcacagcactgcggcgcggggaccgagcacacgcagagctagagagctagctatacagctttacaccgccggccgccgtctccttcgtcttcttcctcggtcacttgatctcagccacagtgagaggcatacactagttgatttcactcggcggcggcggcagggagatgatcctgatgatgagatcttgatgggggcatcggggatggaggcacagatcgatcgatcgatcgatagagagagttgaggggggtgcggagtgatcaacgagagtggtttttgtggaggaaaatctggtcttatagcggtcggaagggggctaagtttagagcagcatggagctcttcgcgcggcggttgtgccgtgcgggcggtggaggccgagcatattccactcgttctcactagtgtgtagcgatctgcatgagtaagggaggggagtagtagtagcccgaggtgccaagtgtaacctcccactacttgatcgatcgatcgctcgcgcgcgcgctgtggatttttgatttcattctggtcaaaacacgatctcaaccgaccactaactttagaccacggcccaattacccttgcacggtcttttctctcttttttttttaaaaaaataatttttttgtgtgtgtgagagaaagagggagagagagggggaccgatgtctgtgcatgttagatttatttcttgtgtcagatcaagttgacacttgcatttgtgtacgctagctagtgtcaaccgttgcataattgttaatttccaatatgaaaaagaagagggtgaattggtgacattgcaaatatggctatttaggtaaatgatactacagttcgtctattcgtaactgtgttattgaaatctattaatttattaaagtaatagaaaaagaagactccacgttctctctcatggtctagaaaatcccacattaattgaaggaaaataagaaaaaaaataaaagtcaaatcctagacggtaccgcattaactgctgaaaaaaaaagaaaaacaaaaaaaaaatcaatcggacaccctatactatagattgcttatctggattctttttcaatttagaaatagtattttcttttggaaaataacagtcatacatggttatcaaagtgaaacaaatcagaaacaaaaatagagtaatgcatatgtttctattccaaattgtactctctacatacatgtcaaaaaaaaaacatagacttaccacctcgttcgctcttacggcctagaaattaccacgttaatcgaagaaaaaaggatggttatcaaagtgaaaccaatcagaaacaaaagcagagtaatgcatatgtatctatttcaaattgtactctctacgtacatgtaaaaaaacatagacttgcacgttcgcttcacggcctagaaattactacgttaatcgaagaaaaaaagaaaaaaaacaaacgggcatgtattcttttggaaacgtgacaaccagagacatactcatgcattgtataggtttaggaaactaatcacaactcttaatcggatgaaaattagaagagaaaacaaacggacaggattgttttttggaaatgtgatataacaataaatattcgtgtatggttatggtgtaggaaacggacaacagtaacaaaccaatcataattagattcgtacatggaattagcatccatgtcggtatttatttatacgctttcgaattgtacacgatttatcccgtagtaataaatagatcgatactcctagcaatgaaagcaaatacacaaaacacccataaatcttctagccgcaatcagctttgccaacaaattagcaagacggaagttttgcagccggaatccacttcattaacaaattggcacccaagaatgccagaaatcttatagcaaaggatcgtccaacaaataaatttgtgtgctgcaaattaacatattaggttggtaatagaaggaaccttcatgttggttcaaattgtctaggaaaacaaacattaattacaaaataaaaatataaatatatctattgatttatctattaacttattagaggaatagaaaaaagagcctccacattcgctctcacggtctagaaattctcatattaatcggagaaaaagaaaaatagagttcatatagaaatacaatttaaaaatagttgaaattcgaaattaaaaaaataaggaatattggaagaggagactagacaattaagaaataatagaaattcggaattaaaaataaggaatattagaaatagagtatagagtccatatagaatttaaaactaacgaaagttcggaataaacataataaaattaaaactagagtttagagttcgtataaaagtacaatttacaaataactaaaattcaaaatttaaaaaaaacatgggaagaacaatcaaaagtcaatataagaatacaatttagaagtaactaaaattcaaaattaaaaattaaagaagagtaaattgcatccacggtgcatcaacttggtaggtaggtgcaatttagtgcaataacatgaggaatgagtgttccagtgcaacaaattggcaggtagatgtaatttaatataagaactttataagtgatcgtataactacaacatcttgcaaggtaggtatgattttgatacaataaattaaaaggttatgtgacaacttaattacttggaacattttttttatataagtctatttttaagaacttattttgacaatatactagtgcggatttgtataagcatatttatatttttatcctaataaataataactgaaagtcaattaaactggatatagaaattactatatttcgattgatatttgagaaggtgaagaaaaccaaaaaaaaataatcttaaaggcaattggatgtaaattgtactactatgtgcagtataattcataattattaaattcaatataaggtaatatccgtatgattactatgtaatggcatgttgacatagtaaaaaaactcacctaagatatgcttagccaagttaatacaccaaaatactaaattgttaagtttttgtactagaacgcacccacttgtcaagttgttgcactcggacattcaattcttaaattcttatactatatcgcacccacctgtcaagttgttgtaccgtgggtgcaatttactcattaaagaatattgaaagatgagtttagagtccacataaaaatacaattagaaataacaaaaaattcagaattaaaaataaataatattagaagaagagcctagagtctatatagaaatacaatttacagataacgaaaattcagaattaaaaaaagaaatattgaaagacgagtctggagtccatataggaatataatttacaaataactaaaatttaatattaaaaataattaataactaacacgtagagtatataaaatacaatatgaatattacacattagtagtttcgcaatgttagtacaaaatttaaaattatgttgtcattttaatatatatgaataatacattgagaaacatatatgctattatatgagagaaaatataataatgctagccgcgcaatctgcgcgggccaccatgctagttctataaaattaggacagtgccaccaccatgcatcaagttttccatctatctcttttttttccgttttcttccttctttctcccgtcttcttcccttaagtgatgttctcagcaagtgaaagatgacaatgatgatatggcaacatgggaggagtagcagcacagtggcgtcaccctcacctcatgacttgaacgactacttgggtgtggtcagcaaggtggaggcatcatcgacaggcgccgccacggtgcacgccttcatctcgaagcagtaggactaggtatcattgacctcggcggcgaggggggcggagttgctaaagcccttggcggcttgggcggggggcggggggcgaggaggtggtcgagggtggcgtcaagctcgacctccttctcccgcagtcgtcgcgctgctgaagccacacgcaccagcgcctggcactgtcgcttctgcacctacttcagcccggcgcgcatccactcgcactccatccgcaccaccgcgtcaatcttcgctctatgtggtcacaactccgacagtagtgcatctcccaccgccatagccgaggccacgaaccacccactcattgacgtcattgccgactccaccaatcggctcatcggtgcagccaccacaaccagctgcatcatccccgggatcggcagcagcgccgcggacaccactaaccccactgctgttgttgcatgacagcttgctctgtgccgcattgctcaccacagtggcacggtcatgccgtgttgctcaccacagtggcacggtcatacccatcgccctattgttgtagcaaccacccgccgcagggaatatcgctcaagggaagaagacgggaaaaagaaggaagaaaatgaaacaaaaaaggagatggatggaaaacgtgacgacagtggcatggtcctattttgtaaaattttagtggaacgactacgaatagatgaattgtaatgacatttatttgaatacgcacatttgcaaggcatggatccaatttacccttaatattatagtgctttagaatatgaaataatgaggataattaaaataatgatgatggacaaatttagaaactttagaagctttaggaaaccaaaagagtaaattgcaccaatgatacaacaacttggcaagtgggtgcgatatagtgcaacaagttgagaattaaatgtccaagtgcaataacttgacaagtgagtgcgttctagtacaagaacttgacaatttagtatttttgcgcatcaacttggctaagcatatgctaggtgatttttttcacgatgtcaatatgccattacatagtaatcctacggatattaccttataatattgaatttaatctttaataattatactgcacatataatttacatccaattaccttttaagaattttttgttttcttcaccttctcaaatatcaatcaaatataataatttctacattcagtttaattgattttcagttactagttattatgataacaatataaatatgcaccaaataataaagttgccgcataacttcttaatttattatatcaaaatcgtacctaccttacaagttgttgcatttatgtgatcacttataaagttcttaaactaaattgcacctacctgccaagttgttgcactagattactcatttctcaagttcttgcaccatattacatccacctaccaagttgatgcaccggcggtgcaattttctcaaatgaaaatttagggataataagatttatattgctcggtgattgtaaatgaattgaactattagcatattaaacttaactctaccaacattagagactttagagttaggaaagcaagcgaaatatctctaacataataaaatagatcatttagcaaagtatgagttgttcttccatgtcttgcgcttaacatccttaggggctacgagcatcttggtggtggcaacaaggtgatggtccaagtggtgatgaagactgctggagtcggtggtggtagatcgttgaaggtgccagtgacatccagggtggattgacccaacctaatggccagatcactcccgggtgtcaaaaaggttgttgtagtgagaatgcaaggtgtctacaacgaggagcggcattgacataatgagatggtggataggttggcatagctgacgaaagatggggcacaacgttggatctagggtctaaatgccgctagatctgcgatgctcgttcctgaatctttttatatagcaggctagcagcaagctaaggggtttcttcttttcgacctccactggttggcattgcaagcgaagccactaggggccataaattgtttgatcgaatcgaatgggtccgactgacgacaagggaagagtagtggaaggagctgatctaatgtgattgaaatatggatgagggttttaggagttcgggttgcatatcaagattgacccagtaaggttttttgtgcggtaggtctcgccagacaatagaaggccaaagcttagtcttatagtaatttctttttcttttctgttttgtcggttatgagacttgtaacttttggctgtgttgcggatatacagccatatacagcaggatatttctatccactacgtaaaaaaaatattgagtaacatattgatggcctgattcggacgtggtctcctcaaatgctttaattttacgtgatggatagtatcagtgtgcaatggagttattggtgcagatgaagtcctaaaggctggtgatttgtgtcgactaatccacaggttcatgatcaaagcctatgcagattcagacgaccatataggtgcttgttttgtggatatgtgtatgcgaagcactgttgcaataagcctttttcgtttaatcctcaaaaggaaggaattggagtgcatcgagggaaaagggattatccgaacaagaccttaaggatttgattatgcagaaaaactagtgaacggaatcccatgagataggatactacttaataatgaacaccccaacatccttccgtttcttcttccctagaactatttctcctcctttctctcaaactcattctctccatcctccaccttgctccctcccccaactcctccactccaatcaatccaacctcccttcgccagaggaccgaccgccatcatccctaacactgatggcatgtcccattctcttcgccttccctacaccgcatttattgggcatgtggagtccaacgaggttatatggttgatggaatcgatcaagttggcaaggaggaaggtaactgcggtggtgaggttgccatttgccgtggctggggagggagaaaagggaggaggtcagggaaagggggatgaggtcaggggcaccaacggacaatggtaatgcatagttggtcattctcagcgtgaggtcaacctcggagtttatgcgggtcttgaggttgtggtactcctcgctagctcgttgtgctgctcctcttcattataggtaggtaagttactagactagtatcagatatcagctgtgaaacgtcgaggatatcacagctgataccaagtatcaggcatagtacctcggggaatcacgactgatacccacaagtatcagccctggtagccagataccaagatctgatacctaggtaccagccggtacccacaggtatcaggtactaagtaccaggtgaaaggagggaacgcacgccatcgtcgctaggccagctagtgagctccctgctgccatatcctatcatctcctctcttcctctcctcaacgtgcccctcttcccttctgttgatgtggctagcgagacaaaaaaaaacaataagtacagttgctatttgcttgcatgcgaaagctcagctatacataggaaaagaagagggaggattcagtgatagcactgattggtctgggtgatatggcctattctgattgggtgtggttggtttgattttctgttaagcaagctccaaatgattttttctcctaaaccgtttatctaatttatgatttgattacactattatatttgttacaattaaatctttaaaacaagatctcggatgattatatttttgataaaaaaatatatatgacaaatgggtcccactaacttatggcttttcccatccgtgctatatccctccaaccaaacaagaaattggatcgccatatctatacaaaccaaacaaaaatttggatagccatatccatcaaaatatgtatggacatatcccatccatgcatgaccgtgaaccaaacacacccttaagtatcctatcctctagtctctctcttgattatgtggaatgcactgttctcaagcagtaggtgccacaagcgatgggcttctcagctcatcatgttcaccactcagggccgaatgaaaagcccaccgacgcagcagaaaggcccaaaaaaaacccttcctagtagtaacaaacaagcagccacgcttcccttggtttctcagcgactcgactccgcccgtccggccaactccgcggagtcgccaacacgaacccccctcctctcttcctccctccctcggtctcatcgaaaacccccactattactaccactccccctcgccttctccgcctccacagcgaccagcagccgcgccgagctcccagatccctcgtgcattccaccttctcccgaggtgagccacccgcttcctcctccctcgtccccgatccgtgccgcccacctcctcgctcgctgtgcgtg

SEQ ID NO: 32755 - DNA, 17930 bp, Oryza sativa
  unsure (1)..(17930): unsure at all n locations
ggttgaacagttgaggctgagttagtagaaggacagatcattcgtgtaatgtgtgctgtgatgatcttttgatgcagcaggacgatgggcgcttctgcagctaccggtatgcagatggtggctgcacgcccctgcatctcagcctcccagggaatgcttacttccagggcggcggtctcccggattggccgcgcactcagcaccaccactggctttgcaacctgtcccagaatctgctactccagccctcttggttcttccaagcgcagcggtgtcgccatcagagcaatgtcaagcgaaagtggcccccaaggcctaccaattgatcttagaggtaactctttagctgcatatctgtagtaatcatgcacctagcaatgctatgtgatcatgttcttttcctttacgcattcatgtttccgtgcaacattttgattgcttagcttctattttctcaatttttcttttgcatctaacaagcatagatgctcatggcatacgttggtttttggttaactatatggttgaagccaaatattattaaccccgtcagctgtggtgaatgtttgaatggtgtgtgcttatttagttcaaaccatctaattgtaaaaactgcgtgctttatggaatctagtattttacattctggtcctcgggaaaaaggttactgctgttttggttatcttttatggacgatctaatggtgattcagtagtaatattgcgtttactactctttgataatgctgtaagagccagcctcatacatcaccgtgtagactaacatatgagcaattaccagtataccagggagcatatcctgtgcaaatgaaagtgttttaaattccatttttacttgatgtagatgctttaaatattctaaagaaaagcaaaagttgggtttgacatactgtatattcatgctaaggtagggtcttgaaaattttgatgagaaatatcaagctaaatttcttttaattatttgagaattttttttttagaacttatgtgccttttgaaggcctcattcatgaactctacatattaaggaagtatcaactttatgtgcttgctcattaaaaaaaggtcaaatataaatgctttcgtcagctgtaatgaagtttagtggcccatagcattatccaattattaacagatggtcacaattatacagaattttgcatagtaattacaagtattttgatttgttgtcatattgcttttgttattggtttgattgaaaaactaaaggagagatttttttttcaaaaaaacagagaactcgagcatattagtagtacaaatccttctcaattgctgccactcttctaatgtttgtatgatctctcaggtaaaagggcgttcattgctggagttgctgatgacaatggctatggctgggcaattgcaaaggctcttgctgctgctggtgctgaaattcttgttggtacatgggtgcctgtaagtggatccaactcttgcagtgttcaatagggatcatttttttttttcctctttgtcattcacttaatggagagttctacctgcacaggcactaaacatatttgagacaagcctaaggcgtggaaagtttgatgaatcacgaaagtttgtattatatttctatttttcttgttttatctagctttgctctgaaaataacatttaactcttatctaactatctcttgatacaggctgcctgatggatctcttatggaaattgttaaagtctatccacttgatgctgtctatgattcccctgaagatgttcctgaagatgtaattttcttatctattattttcttctgtttagctcccaatgcggctttatgacaatcatttttatttttaattttaggtcaaaggaaacaaaaggtatgctgggtcatcaaattggactgttaaggtgtgtagatgcaatccatttcattccatatgtctacccagttgatatacttgggtgtgcaaaaacaacattaggcgcgttatacaatttctataattggattgttttttaagcttttgagctttgactaaactactcctatttttatttgataggaagttgctgagtcagtcaagaatgactttggcagcattgacattttggtgcattctctagctaatggtccagaggtatagtgcctctgcctatattcctctgtgcttactgctagtgatgaaattattgtccatacgtgttacgctttcaactaatgatcacctacctctgtttgaaggtaacaaaaccactattggagacatcaagaagagggtatcttgctgcactgtcagcatcgagttactccttcgtctctttgcttcagcacttccttcctataatgaatccaggtagtgcttactccgcagttctaactctccacgcctgcacttgaaccgctatcttatacactcctagataaatcaagccgttactgcctttcatatctttgcagttttatttgtccagtgaatcatagtaatgctgctgtttacttatgtgtaacttgtctcctgctctgatctggatcaagcttttctgactgaacagcaatgctgaaatttatccaattgcattaagaaataacttgttatgacgctcaacctatactaacctatactattttcattggcactgcctcatatatgtttaatatttccaggtggtgcttccatctctctaacatacattgcatctgaaagggcaattcctgggtaactacattatttgagatttaaaatacaaagcattttgtatcattacttaccggtggtaattctgattatatatatttttagatatggtggtggcatgagttcagctaaagcagctcttgagagtgacacaaaagtatggtcttctagaatatatatgttattttcaacactccctccatcccaaaataagtgcaaccctctagttcaaatttgaactacaaggctgcacttattttgggacggagggagtatgtaccatgaatgtacttttttaatctttttctgcaaatctttgtaggtacttgcttttgaagctggaaggaaagggaaaatcagagttaacaccatatctgcaggtattttcttctgtaggaatattctcttggaataaagctagcattgtaaatcttggaactaggtgattgcctatgcgataccatttggaaattaatgacaaatgatgcaacatttctttctaattttacatgtgaatttcggtttgtcagcacatgcatatgatgtgctatttcccttggatatgatttgcataattatttaggatctcttactttaacgatgtaggaataattgtgagttcattctgatttattaaatttactcataggtcctttgggaagccgagctgccaaggcaattggattcattgagaagatgatagaatactcttatgttaatgcaccgttgcagaaagaactgttggcaggtccaaaaccgccttatttctctgttacatatgcttcttgttttatttaaaagaacaacttttcatccagatatactctaacgaaagcattttgtatgtcgaacagacgaagtggggaacacagcagcattcctggtgtctccattggcttccgctatcactggctcgactgtttacgttgacaatggactcaatacaatggggcttgcagttgacagccctacaatatcatcataggtgtggtatggtagatagatgggttttcctgcttcattgcggcttgtttcttgaataaagagcttagttaggtagtataagagctaagggcaggaagaaaaaatagagcatgaatccaatttggtccttgacatttgagtaattcctgcactggggtactcgagcaatactactaggtggttcggaatgattcaagccccagttaccaatgttctgtgctgtatcttgaaatttttaatcattgatactgtgtttcttcgtataaactttgtcaatacagtgaaaatcatgtgcaataataagaatggataatgtttggtagtctcttctgtataccttgctgttatgttgtgcaaaatgtcggtggtgtatactacaatccactcttttcattaaaaagttaagagtaaatcgcagtttgggatagatgttcttatcagatttttatattggacaacccttcagcacatcttttcacttaacaccaactagctttatcttttgtttcaacttagatcacccccccatccaatcaatcctactactcggacgactgccaccgcggctcccattgcaacaccggccacatcttaacctattctctcacgaacactatctcacctctttcgttcttccctcgtgacgaaggtgaggtgataacctctttcttcacttatgcccgatgcaacaaggaggagccctatctagcgtcactgatgtccaccatggttggatccgagttccctctggcccatgctgttggccttgacctccacagctccactaggacatcaccatgcatgatgacggggaggaaggagagacgattggcgggtgcttctatatgcgagaggtgaggagtggcggcgtgcactgtggcaaaagagcaagctctacactcgaaagtggtaaaagtagtaaaggagaagagctgtcgaaggtggagagagaggagcagtggtgttcatcatggtggaggaagagaggacgactgcggacgagggagaagctgcggtggaagtgcgtggaggaggataggagggaagggtggctaatgcttccatggcagaggagcttgccatcgccatccccaccgagcaggtgagaacctttcccttttttctccttttctctcataagcctattgacaggtgggccactagcctaaattaaaatgattggtagcaatatttgattttaagtgaaaagattcagttaaaggtggctgaaagtgacataagttggtcactagcccaaattgtaaaggattagtaacaatatctagctaagtgaaaatattgagttagaggtggcttaaagtgacattttggtaataatagctcgaccaatatgtaattcatatactcatatgtactactttgcatttaaatacatgataactttatttatttaaactagcatattactcatgagttgcaatgtgattttaaataaagaaaattattagtaacatgttagtaccctctctttctaatatagactaaccacgtcagaatgatgctactagattatttatcaaaaaatagcttctttttatggtggtatttatagtttatttctaattaagatgatactagagtaataaagaaaatcattagggtttaattaaataaatttttattattacaaacttgaaaatgaattttatctcatattttaaaacattttctgtataagaagttttcacacgaaatatactatttaactgtttgaaaaacacgctaatgaaaatcgagataaaatgtatgtatgttaataaataaattaaaagaacggccgcttgtttcgtacaacgtcgtcctggcttcagcttgagcgtgcatgttcatcacaaaggttattgtctttttattttaataacttaattttatagatattaaaggttaaagcggtattgaagaccgcatcaatcataaaatggattagttggagggagtcaatataaatcactaagactgcgttggagtgagtggttgtcttgagcttttcccttgcatgcataaaaaatataaatcattagatgaaaccctcgtgttactgcggaagtttagtatgatagcagtaagtagaaataatatgtaagatagatgatataagctcgtataagttgatatagtttgtgataatttaaatagtatatagaataacgatccaaatataaaagtaaggtgacgaggtttcatgagaaaagaaaaggagggggtaatttggactataaattaatcatctaaggattaaaagcaattgatgtgatatgacttaatgtgagaagaaaatgaggaaaataatttggaccatagattaatcatctaagtgctaaaaacaattgatgtgatatagtttaatgagagaagaaagaaataacattaatcaaagtgaggataaactgtataggtatatagcatattataaaaatgatggagagatatattaaaatattatttgaattaattgggatgatgatttaacatgcttgcattctaaagttctaaaatttaataaattatataattatagataatatagcatgtttatatgatttttaagatataataattgttagtagatgacggcgttgcgtctttgcatgctgaattttaggatttagtgggttataactttatagtcgatgtttaaaataataattgttagtggatgatgacgtgtggcatttctgtatgctgagttttaggatttagtgggctgtaactttataataagataggatcagtgtaagattaattaagtattagagtaactactgtaaatttataaactttatttgattttttttaaaaaaacttttaccgttaaatattttagagaacagacaccggacgcttagtaatttgaaaaattaaacgtgcttagttaaaattgagaaaacagataatccattaatgtgattagaacttagcctaagggcttgttctgatgggtggtttggcagaaattttggtggcatgccaagcgagataacctattaaggcaagttctaagcacaaactctaaagtgacatgtatgtttaaatgatgatgtagagaagagaagagaagagagaggggatgagccacctctcatgtaaggggcaaaacttaaagaaacatgagaaaatgagatggctgattggtgggactagtgtataaaatgcaatgcatttatataagttaattttaattttttagatggatgatgtggataaaattggaggtgactaccacatctattgtaaaacttgccctaatcaagtactccatccgtctcattttaggtgcagccatgatttccctgtacagctttgaccgtccatcttatctgaatttgtttttaaaaaaaaataaaaaacataagtcacgtataaagtactattcatgttttatcatctcatgacaataaaaatactaattataaaaattttcaaataagacagatggtcaaagttgggcacggaaacttacggttgcacttaaaatgagacggaggaggtattaattattaaaaacttgaaaacaatatttatttgatttttgaagaactttgatatagaaaacttgtatatacaacacacgatttagctatataaaaaatgtggcaataaaatcgagtaagctataccgatatgtgagatggcgaaaaatactgagccgtatacgttgaccaagaacagcgatgcatgtcgccgtattattatcatgtcttcgtatatgttgtcaaatatatatatatatatactagtgctctcttccttctataatatagcaatataaagtccaatgatatgctataacgaatctagatatgtcatatgattctatgctactgtattatgggacgaagggattagcaaattatggtttagttggccatatatagcttgacaccctgctcagcgatttgatcaatctggacatcgcgcttaaaaatcgaaaggaaaagagaaaataagcggtcctgggcgttgtgctggtttggtacggtggcaccaagctgggccgtacaaagccactggtgtgggcctgatcgttcgcccatcatgcagatcgctctggtgtttgcgttgcctagtaatcgtacacgtgtaatacgttttccatatatggtaaatcgcaagaaacatatgaataccctgaaagtttattgtgttttccacaataaatgtcgcatgaaacatacaaatacacaagtttaagaacaatatgttctaacatgatctagcctactttggtaaccccctcttggacacttgttgtggaggtgcaaagtagacaacattacaaaatggacacactttttcacaacttaacaaacacttgaaaggctcaaagcaaaagagttgtcttcaggtgcattcaagagaactcccctaagtaagagaaaagaacacaagtatctacacaattgattcgtgtcatccacaataacttcaaatgtaaccctcacaatctgcaatccacaataacttcaagttgacatggatattttgagctgcattaaaaaaaaacaaaattaaccaaagaatatcactacttggagaaaaaaatgaaaactaaaccaggaacattgaaatactctcaaactgaataagtatttgtacaatttttggaaaagagtatcacatgtgttgttagacatacatttttgaatgagcataaccgatttttccaaactccagaaatttctttcagtctaaataaagttgcaatagtgaaataagttatatggtagagcaaaatgttagggtatcaaccaaaatggttcagtttgagtctagcagaaagcgagtttcatgccctcattgtaaaatcaaatacaaatgttatacttccaatacctgaagaacatttttttcctaaggatggtaaaaagcctcaacttatgcaagatataaggtggcaggcagatacgattttacaatttttatttttgaactttgaagaaagatatgtaaaactaaaaccaagtcataaaacttaattctgtaactaaaatataagtgttaattttaaagggctacagttcaagaatatccaaatcagataacataatgcaatatgctatatatcctaagtgtgaggtaataaaaataaatcagataaaaccatggaaacttttgcttgctgagaaaaccaataatttaaaatagcatccttaagcactcatatcatcaatgatcctgtaaaatgtgaggcacatgatcttctagtagcagattagaatagaaaagactgttgcactgaagaaaatgttgatacctggcctcacacatgatgtaagactgcttctttgttaaaaaaattgcaaatgttagtttgcacgtggtaaaaaaaggttctagcagttttttatagggatacaaaaaaaatgaaaaaaaactacatttggcagtttttaataaatattttgcactgaaggaaatcatgaagttctacataatttagatcaattaagtagaccaaatacaaattcttcttgttcttcatgaacaacagtgcagtataaatgacaaaaccaataaacatttgaactaaaattgacacagctacagtcaagaggtatactaagcccctctctcaccttttccttttgttttccttattgcaacctttgcttctgtctagaccagatcaagagagcaacctagattaatttaacagaaaaacatcccacaactgatgtaacagaaagaataggcaagcagataatccatcattgataaatgtatgaaatcaccatgttcaacctacaaaagaaattttgtcaacaagaatcggagatttctgaaattaattaccacactggccatcaaagccaagtagagattgctaaataaaccagccaccgccaagttgtgtttctgcttctacaaagtatatatgccaagtaacgcttctgcttctgcaaagtagaggattctttcacaagtgattggtcagctttagggtcattccaaaagactggaatggtgtgtttgagaaagaaaacaaagcactgcaacggttacattttgcctaaattttcagattaaactgcaggttcatcataatagttaatagagaaatcgttattgtaatttacatacagctgttgcaatctacagtctgaagtgagggttcacctgggtgggggcagatcctccaccatagccatgtcgcacaccccagctatgttcaaagagaggaagcgagtggccgggcgattgctgagagagcatcagggtgcaggcaagccggttgagtggtccgggtggcggaagcggccggatccgctcagcctcgagccctctacggagtagggctttgactccacgctgctcctgccataatatcccaaatgttccggcttgagaaaatggagacaatgagttgcagatcgagattatgtgtcatcacaatcatgcgagcaacagggtgcaggtgcagttgctggtggcctgtggttgatgtcagacggtgtcaggagcagagaacggggaggggccagtaggtggatcagatgctggatcggcttggcctccctggcaggggcaacctcgacggatgaaccaatcggattgactcggactcggcaacaggcgcgaggaaccggcgacgcgatagggtgcgatcggcggggcagaggttgcagcggcggagaaatcgcgatggagcagcggatgggcggagaaatcgtggtggagtgcgcggcggcggcggcggcggatggggaagacctcggctccatggggggctggggaagacctcgcctccggttcagtgcgtggcggcggaagaaagcgacgacctcgagggtagcggtgcattgcggcggcggcggcggcggatggggacgacgtcggctcctgctgcggccggccgcggcggatggggaagaccacggctccggcggtggttgggaagacctcgcctcggttcagtgcgcagcggaggcggtggagtgcacggcggcggcggcggaatgggacgacgacgcgaggaggagcgagtcgcgtgttaagagggtgatgaggcgtattctttgcgcggagaccgcgcgtggagagggtgaaatcatgcgtcggagatgggtggatggtacggattacacctgaggtgcgaatggacggtagggatttaacccgttgatttggcatgtaggggtgaactcttttttatattagtacttcttccgtcctaaaatgtaagtatttttgaggttagcacggatattaagaaaataggtgagaataattaaagaaggtgtgtgattggttgaaaagagaaagtaggtgaaaaagaatggttgtgattggttgagaggagaaggtagttagaaaaatagcttcattttggaacaaagtactgtgctagaaatagctatatttttggacggaggtagtacatatgagtgttgacgcgttgccgtatttgttaatctcatgcacaaagcaagcagaaatacgtggaaaggatacatagaagaaagaaacaagtaaaaataattttgcaaaatctttggatagataaacatagtatgggttcaacttaaaaattgagtcgggtcacatcgatattctatacttatacaaaattaaaacaataattatgaaaagtaaattgtataaataatataaaagttggataaaactttataatcctgaaaaatattatttttacaatatttattttctcctaatactacaatctgtaatgaattatacacaattttttaggttttatgaagtcgctacaattttaagaaaacatacattttctctatttttttcctaatatcgtcaaaattaaatagtatatcctgaatccaaaataattattgacaatcaaatcctatttcagttcatttctacaaacacaattaaaatccactaacatgtccttttaaaaattaaaaggctatgtcctttgaaaggttatgggcattaaagaactcatgtaaagtaactttttatattatatgtagtttgcacgagtataaactagccggcgcgtcaactggcacgttgattttcttgtggagtactaattttcttccatcagtttagaattcttctgttttccaaagaatctgaagatcatttttttttctagaacatgaaatctggaaatacttgcgaaaacaacataggtcacgtcgcttgggcttcctgcaccgatgttcccagcgctagtctcgggccgaacggagtaaaaactaaaacgctgcagaattgtttagtaccacctcgcccagccacggtagaggggagactgaggcgctgtatataatgcgacccgatactgtcttgtaaagcatacctttctcggccttttgactaagatcaagtgtagtatctgttcttattagtttaatatatgatacgtgggccatgtgtccacggatattaaattagtattttgtgagggagggcccaccacggtagctcgctactggggccctcatgtgtcgcctaggctttgcactgctgccttgtctcggtgcaccccaaccaaatctgtactttaaattttttcctaagcttttgctcactaatttggtttaatcattgaccaaattaaactgactaggaatgaagtcattgacgaatttttgacttgacttttcagtgagtgattttaagatttatttgtccaaaccgtgagtgattttggttccaatttatgtagaaaaacaaacgagagtctgtttggtaagcgttatttcgaaatggcgacttgctccgctgcttgcactcgcccagccatcgtcgtcatgtagccggccatggcgcggcggcgcgccgcctcctctgtctacctccctggtcggccgccacgcggcagtgtcgtgtgatgcagtggtcggcctataagcggtgggatctcgaagaagggtaagatatgttcttgtctcgcgtgggattttttttgcttggaaaatctaacggtagccgtggtcgtggcagcggtggtgctgtgggtggcggcgaggagtgcgtcgccggtggtggtgatcgccgtggtggtctacaaggtgaggtccagtctcctcgtgttgccaccaccgcctccgccggcgaggccctaggaggagcccagcgaggaggtcctgccgcctccggagccggtgcaggtgggggagatcatggcggaggagttgttgcagtacgacaggtccaaccctgagaagccgctactcatggcgatcaaggggcggatttatgacgtcttccagagcaggtcgcttccgttaacaatgcttctgttactctcattagtcattacaatgctttttctgttactctggccctgtttagtttccaaaacaaaaatttttacgctgttacatcaaatggtttggacacatgcatggagtattaaatacaaaaaaaaaacaaattacatagattgtgtgtaaattgcgagacgaatcttttaagcctaattacaccatgatttgacaatatggtactacagtacatatttgctaatgatggattaattaggcttaataaattcgtctcgcagtttcttggcagaacttataatttgttttattattagactacgtttaatacttcaaatatcaaatatgtgtctgtatatccgatgtggtaaccaaacctaaatattttccgcaactaaacaaggcctctgtttcgggtatggatttccatccttgtttgcacgtcatctaaatagttataaaaaaatttgaaaaaaaaattaacaacatagattaatatgaaatatatcactccacaaacatgtaagaccaaattcgacttctacaagttgcaataaaagaaacaaattaaactgaaaatagttaacgtacattcgcatatatatttgttatttttattacaactaggaaggtagctcgtgcatttgtgcgggcatgtatcgcgagggcattcacgcggattcgtattttttaagaaacttataataatagaatatatatcaactcgatgacacctaccacgctttaaaagtactatttctctacaaattttcttcatcggcattgcttgcataatttttccaacctatctttagctttaaactatacaatatttattcatgccggtaagaaattaattataatgtttctcattatcttgcaggaaggttgacttaatttgtttaaaacaaatttctaacaaattaagtgtaaattaaaaataaggtgttttccttgcaagttgaatgtttacttgctctatttttgaacaaatcctagaaaattattattactaacaatgagttttatttgtaccataaagctgcccctctttctaattggttcatgctcacacaatttgttacattcttacatatatatgaatgaataaagaaaatatatccacatatcttgtttccatatgatatgtgatctatagaatttatttaaatacgtattcaacataagtgctaaaatttaaattttatagtaacaaatataacttctaaaccaactacttgctgccttagtgcggcttgtatatatgcaataatatattaataaacacctaagtctatggtatacggtacatgatagattgaattacattattagtatataaacacttaagatggttatggcaatagaataggcaatgtttgttccaatttaagtgaaaatatgaagcatttttaatgaatttgagatattttctccaattggttcaatctagtgaactttctttaggagtcatatatattctcccattggtaatatggatcatgaactatttattcacttataaataaaataacagttcaaacaacctgaaaagttagttgtatatttttgttctttttttttgaaaacatcacagcaggggaggcccccgtgttaaaaaaaattattaataatagaaagaaccaaaaagattacaacaacctaatccagtttaaaattacatctttatctctctcgttcaatctaaacaacaaaagaaagagatcacccttaagggaatatatccaagaagccaaggaaggaaaaatattctcaaaaagtatatttttgttcttaataatcttttgtctcaaaatttgctttctaaggtatagcaagaaaatgggatagggaacgtgatttagagagagggagtgaataataagagaggggacagaagatgggagtaagcatgtctgtgtccatgtataggccagggtggggtttaggacatgggtttttcttcattaagcttggttgaaaataatgggtttatcacattaagtaaaaattgatggctagatgttttttttttcatagaattcgtaggaatctttcataatttattggagcgtcacatggtaggttaggaatgctccatggatacgatactatgtaactaaaaagcatgttaattatgttttacaaggttattaatgtttaagtggtggcttagtctactaattttgaattatatagaaaattcttaggagtactctacggctgcgctcttttcccctcttttccaaactcacttcccttattttccgcgcgcacgcttttcaaattactaaatagtgcattttttgcaaaagttttttttatgaaagtttctttaaaaatcatattaatccatttttcaagttttttaggctaatgcttaattaatctcactataatcgtgttctttgttccgtgtcgagcggcaaggttgggaaccttgcctcctgaaacagcctaggtcgctaataataataatatatcaattttaagttaaaatagaagtcaatacgggtcttaaattgataaaattatcaatttagttgtaaatacaatgatgaatagataaaaatgagacatactaccccatctcaaaaaataccaatttttagctttgaacctgtacacacttatccagatacgtagctaaaatatgctatattatatgatggagggagtataattttgaagttttagctgtttaaaattcattatcccaaaattttatctgacactgctatatgtaaaaagaagagagaaataggagggaagcagaggttagagatggagtgtatttattactaaccggcaagcaaatcaatcagtgtatatataaagagaccacaggtacgcgtgcataggcgtgtgaataacaaaattcaaaagccaaaagtgaattaatcatcagcgcttcacatatgctgaaaggtggagtcgaaggaggcaagggcgtatacgaaatacgagcaggagcaggatgaccatggcgatgctctagggaagcttcgctctgtgtgggtaccgagctagcagttcgggcggtgtttgttttaatcttaattaagttggatggctaaaaatattggaccaaccacttacgtaaaaattgagggattgatttttactaataccacgtgataccttgagagcggtttaaggattaccacgtggtagtgtgagagtattttaaggaagtttaatggacttttaatatataatagaagatagatttgtataagttaatttttaacttagatgttcgtggagtgatatattttatattaatctatcttactatttttttaatcttttttatgattatttacgtgatatgcacgaaacaagaggatatacgggatgaaatcaccttccctttgtttaacatacactactggaaaactgatcttcgctcggtcgccccaaaaccataatagtcccggttataaaaagaacctggactaaatatgatctttagtcccagtttaaaaccccatagccattctacgatctttagtcggactaaagatgatctttagtcccgattcatcccctgtcagtcccttgtcagaggggcggggatctttagtcccggttggtgtcacaaaccgggactaaagatcaccactttagtcctggttggtattaataaccgggactaaagatctcctatatctttactcccggttggtaataccaaccgggactaaaatcacgcgtagtatataatccctattccctgtcatctcccccaaaaccggcttcaatctcctcaacaaccggcctctcctctcctcagatccatctccctctcctccccttcctcctcccatcccagccctctcctccccctcctccattcctgtcacaccccgaagttctcctcccaagcctaaatttaatttttaaaacgaccccaagaaaatgcaggtgcaaattaagagaagaccctaagaaagtaatgccaataataatcggatttggcatgtggaatttttcttgagttctacatgtcgaaattcattaacaggatttttagtggaattttcagagctctagaaataatttgaaccaattaaaattgagcaagcaatattttaattccagggaaaatcctttttcctttttctttttctttttcctctctttttcctcctttttttcaaatgggccgttcggcccattttttcccttccttcccccctccctgcagggccggctgcaggccgaggcccagccagggccgccgtcgccctcctcttccggggtcgccgacaggtggggcctacctgtcgggtccttcccccacctccggccgacgccgngccagcaaccgtcgcgcccgaaaccgtcgccgcgtccacgccttcgtcttcttcgggccacgtcgaccacgcccgcgcgtgcgccgcgttccccgcgcccactcccctctctctcccgctcgcacccgcgcccgagatggtcgggattcgattttcgaatcccgcctctctctcctccgtctcattttaagtgcaaccgtaagtttccgtgcccaactttgaccatctgtcttatttgaaaatttttataattagtatttttattgtcatgagatgataaaacatgaatagtactttatacgtgacttatgttttttatttttttttaaaaacaaattcagataagatggacggtcaaagctgtacagggaaatcatggctgcacctaaaatgagacggatggagtacttgattagggcaagttttacaatagatgtggtaaaaactaaaacgctgcagaattgtttagtaccacctcgcccagccacggtataggggagactgaggcgctgtatataatgcgacccgatactgtcttgtaaagcatacctttctcggccttttgactaagatcaagtgtagtatctgttcttattagtttaatatatgatacgtgggccatgtgtccannnnnnnnnnnnnnnnnnnnnnnnnnnnnnnnnnnnnnnnnnnnnnnnnnnnnnnnnn

SEQ ID NO: 32756 - DNA, 13560 bp, Oryza sativa
tattacaactgtttatttctttcaattcctgtctataaatgctcgctttatgcaaatgaaccactttagctcttctttgatgattccctgcaccatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagatgtggatctgaatgtcaacattgtcgtttgtgtaccccggccggtcctggacggggattttaatgcacattctgcttgaaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactgttgaggtttattcgtcagtcagttgggatctgatgggtgaaatgcattaggtcatagctcaggaacatgggttgcaaggtatttatgctttatttgttattattagtatgtatctaatttctcattattttatcgttatgtgagtctgtcttatttattcgctctcatgcaaaatgatctatgcataaaaatttcgctcttattcgattcccttatttgagtcttttattgctttatttaaattctcaaaacgaattagcagaggtcaagaagcaggttgatgagcagctgcagaaagggtacattcgaccaagtacttcatcttggggtgctccggtcatttttgtggagaaaaaggataagacgaagaggatgtgcgttgattatcgcgcactcaacgaggtcactatcaagaacaaatatcccttgccgcgaatcgatgatttgtttgatcaactgaaaggagctaaagtgttttctaagatagacctgcgatcaggctaccaccaattgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtgtttatcgacgacattcttatctactcaaaatccgaagaagaacatgaacaacatctccgtctagtactcgagaagttgaaggagcaccagctatacgccaagttcagcaagtgtgacttctggttgacggaagtcaaatttctgggccatgtcattacagctcagggtgtggcagttgatccatcgaacgtggagttggttaccaaatggaccccgccgaagaccgtgtcgcagattcgaagttttcttggacttgcaggttattaccgccgattcatcgaaaacttctccagaatcgcccgacccatgactcagttacttaagaaagatgagaagtttaaatggacagctgagtgcgataagagttttgaggagctcaagaagaaattagtatccgcaccagttttgattctgcccgaccagatgaaagacttccaagtctattgcgatgcatcccgccacggacttggatgtgtcctaatgcaagagggcagggtggttgcgtatgcctcgcgacagttacgtccacacgaagggaattatccaactcatgacttggaattggcagcagtggttcatgctttgaagatctggaggcactatctgattggcaaccgctgcgaagtatatacggaccataagagtctgaaatacatcttcacccaaccggacctaaatctccgacaatgaagatggttggaactaatcaaagactatgacatgagcattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacacggttttgtagccgctctggaggcacggcctacgctcgtggatcaagtcagagcagctcaagtaaatgattctgaaatagaagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcatcgcactctgcgatgtttgccaacgagtgaaggcagagcaccaaagaccagcaggtttactccaacctctttaaatcccggaatggaaatgggaggagattggaatggactttataacgggactgccccggacatcgtcgggtcatgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgggtcaatcaaatcttggaagatatgttgagagcttgcgctcttgattttggtggagcttgggacaaaagcttgccatatgcggaattctcgtacaacaacagctactaagccagtctacagatggcaccgtttgaagctttatacggccggaagtgccgcacacctctcttctgggatcagacaggcgagcgtcaactgttcggaacagaggtattagcggaagcagaagagaaagtcagaatcatcagggaaaggttgaggattgcccagtctcgacagaagagctacgcggataaccgtcgaagggagctcacttttgaggcaggagattacgtgtatcttcgtgtcactccgctccggggagtacaccgttttcagacaaaaggcaagttggcaccacgcttcgtgggaccatacaaaatcctggaacgaaggggggaagttgcttatcagttagaacttccatccaacatgatcggcatccatgacgtgctccacgtgtcccaattaaagaagtgcttaagggtacctgaagaacaggctgattcggaacacattgatatccaggaggacctaacatacgtggaaaagccggttcgtatacttgataccagtgaaaggagaaccagaaacaaggtcacccgattttgccgagttcagtggagtcatcattcagaagaggaagcaacctgggaaagggaagatgagttgaaagccgcccatccgcacctcttcaccaacttctccgaatctcggggccgagattccgtttaaggggggtaggtttgtcacaccccgaagttctcctcccaagcctaaaatttaatttttaaaacgaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataatttgaaccaattaaaattgagcaagcaatattttaattccagggaaaatcctttttcctttttctttttctttttcctctctttttcctcttttttttcaaatgggccgtcggcccattttttcccttccttccccccctccctgctgggccagctgcaggccgaggcccagccaggccgcccgccgccctcctctcccggggtcgccgacaggttgggcccacctgtcgggtccttcccccacctccggccgacgccgcgccagcaaccgccgcgcccgaaaccgccgccgcgtccacgcctccgcctcctccgggccacgtcgaccacgcccgcgcgtgcgccgcgttcccctcgcccactcccctctctctcccgctcgcacccgcgcccgagatggccgggattcgattttcgaaatcccgctctctctactcccccactcccccacgtcggccggcgattcccgcctcttccggccacgtccggccctctctctccctatttaagctcccccgtcgctccctctcgctttttccccatttcgcctccctctcccgagctccccatcgctcccgcgccgtgcgcccatccgccgctgcctctcccgctactccggtcgcctctagccgccgctacactcgccgccgcaccgcgccgtcgccgctgttgggttcgcgcggccgaggtccacctcgtccacccctcctccgtagagattcgccgccgaagccccatccccgtcgtgcgctggaggttccggagctcgtcccgccgtcgccatcgtcctccgtcgcccgccgtcgtcgaccgttgtcggtgaggcctctcctcctctttctctctctcccgcaccgtttagccgtcgcgccgccgcttagccgcgtagctgccgcttcacctctagccgccgctctccgccgccggtcggtcgccgtcggccgccgtcttgcgccgctgccgcatgtgcgccgctgccgcatgtgcgccgcgccgtcgcgcgccatggtcgccgggccggtttgcgccgtgcccgcgcgcaccggccgcgagctcccgccgcaagggtagatcggggccatcggttcggccgccgcgtggcgcgccgctcctccccggtccgtggacccaatccgccgtggaccgccctccccgagccgctgaccggtggggcccgcttgtcggcgcccttcctccctccccgagccgctgaccggtggggcccgcatgtcggtgccgcgccccgccttgatgacgtcagccctggaatatattgcgcaataaatgatttaaggtttttcttgtatagtaataaacacagcgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatactgcatcgttttataatgttactatgagttgtttacctattgtcatagccatgctattgatgtaccatgtttctttgtcagcttggggttataacatgattagagtttggactagggattgcttagccatgcttagttcaactagttcacaatggggaaaaatcctattaatgtttagactgttggttctaatggtttgttggattagtaacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctaggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacagaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaattcctgtttataaatgctcgctttatgcaaatgaaccactttagctcttctttgatgattccctgcaccatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacacttcccatccgatctcctcctcccccttctcctcttcctcctcccatcccggccctctcctctccactactacagatccggacttcagtgacgggtcaactgtgacgggccaacgcaactcgtcaaagatgacggctaccagagaggacccgtcacagatgtgaggtcatctgtgacggcttgcacttgtaacccgtcacagatcgtctgtgatgggtcacaaccatggctcgtcacagatgacatgtcatgtcatgtcatctgtgacgggtgtagtattatgaaccatcacaaaagagaccactcatctctgacgggtctttaactaacacacgtcacagaaaacgttatctctgacgggtggtagttatgacctgtcagtgatgagtgaaaattcaaatttttaaattttgcaaaaaacctcggattgagacatgtcctatataaaagttatagctctcgatgatatccacaactttataactaacaacatttctattagagatcgtttacatccctgaacatgcattacaagtgatcagatctacttttaaaaacaaaattttgagttttttttttcaaatgacatggatggatacatgctccgtatcaaagtcatagaactcaaccagatctacaatattataattgaaaatattttcatttcacagagtttacatgttcaaaatacatgttataaagtgagatatattttgaaaaatgaaattttgaattcttcaaacaacattggatgaagatattttctatgtaaaagttataaaacacgatgagatctataattatttagttgataatattttcatttgaagtcatttagggtgttaaatatatgttaaatgattcagacaagcatagacaaaataataacattgggtgcatagtcaatatgtgctgagtaggtgagttggtaagggagctctatatggaggttgaggtcttgagttcgaatctcatgtgtagcatacaagttatattgcgggaaaaattgtgaatttgttaggtagtgatgtgtaaccatgaataggatggctagtaaaattcaaaatatttttttgaggtttttttgttgcgtttaaaattcaaaaattatatttcttgctttgtgaatttgtaggtagtgatgtgtaaccatgtataggatggctagtaaaattcaaaatatttttttgaggttttttttgttgcgtttaaaattcaaaaattatatttattgctttatcatcactaacgtgtcgtaagttacaacccgtcagagatgagtcatcagtgacggtcaggtagttgcgacacgtcactgataactcatctgtgacgggtgacaagttttaacccatcaaagatgacttatataccggtcagagatgggttatctgtgacgggtgcccgtcacaggtgattttgtcatcagtgaccactaatcactgaccaagaccaaacccgtcaaaggtgagggtttgggcccgtcagagatgacctggtccggcgtagtgctccctcctcccttcccatccgatgcccagcgagggccgccgcctcctcctcctcctcccttcccgcacgcgtcaggcggggccgcgcccggcggggccacacgctgtaggcggccggcggggccgcacacaggccgcgcacgggccgagtagcgagtggtggcaggcggcgctaccggcatccattctttttttcttttttttacaatttgtgattcagcgagatgtataattttgtgatttgctgtatggatctgagatgtataatatgtgatgtatttggtctgtgtgtaatttttttatgatttgtgatgtatttgatttgtgtgtacaagtagcttaagatttttgatgtgaatgttttgtgatgttactttgatttggggtttgatttgggaatatgcatcccactcgatttgggagaaaatacagggattaaactctggctaaaaaataataaaaaaaagaaaaggagacctaatgggactgccgctaccctctctttagtcccggttatttcacctgggactaaagatagtgatctttagtttcggattcatagtcccggttgaataaccggggctaaagggggttacgaaccgggagtacaaagggcttgtttggttcaataccctaccaaaatgttggtagtgccaaaacctaggcaagttttggtactaccaattttttggtggggtagagttgtatttggtttgaggccaatttagaaccaagcattgagtagaatatagaaaatatcaaattgggcattggcaatgccaatgatttggcttcaaaccaaaattaccagatacactgttcaaactaccaaagtattggtagggcacgtttttggcactaatccaaaacagcccagagggtttctccactagtgataacaagaaacttgtttagagcgtacctgcttcccaagcgtgtcgcccttatccggctgcctcgtgtccagacacctggcacaacacacatcgcccatcttacacgtgcacatgctcccgtgtcacctcctcaacacttgcacgagttcttcgttgcttgccgctctataaatttccagcttcctttcgatcctcttcaacaattacaataatcatcaagcttcttcttatgttcatccaaatccacagccataaaagtagccatacttgagtttaggtagccagcatgcaggccgggaagaacgcgatgcagtcgaccaaggaggccgcggcgaacgtgggcgcgtcggcgcgcgccgggatggacaagtcccgcgccgccgtgcagggccaggtggagaaggcgacggcgcgcaacgcggccgacaaggacgcggcggaggtgaggcggcaggagcgcctgcaggccgccgaggaggagaagcagcacgccatggccgccaacgcagccgccaaggagcgcgccacgggcggcgccggcgcgtaccacccgtcgcagggcgcccccggggtggacccgcgtgcggcgcagccgacgggagggcacgtccaggacggcgtcgccgagagccggccggtcgggacggccaccggcacggcgaggcccagcgccgcccacaacccgcacgtcggcagcgacttctcgcaggcccacggcaccggcggccagtaccagtgatctcattctcatatcaatgtgacaatttatgatctactagtagctgttcatcagttcatgtagagttcacttcgctactatgagttgatggggaataaaattgtacgtgttagaagtggtatcatgttgtgggagatgcttaattatgaaataaaacagagtactctcttcgtttcacaatgtaaataatgtaaatataagtccttatagtattttttatattcatattgatgttaattttctatatttatattgatattaataaatttagattaataaatttagagacatcaatagtacctgaaaatatggttacttcgatatgtgtatgcttgattgtgtttgttcatttctatccaaatatgactacttcgatgtgtatgattgattgcgttcgttcatttccatgcactcagtgacgtctgtgtttaataattactttctgatggataagcagaggtactggatttggtactagatttatcccgtgtgggaagtttttatatgttagtcgtgtgagacgtactccctccgtccttaaaacctaaaaaaagacagcttatttttagtctaaatttagtctaaaaaaaggacaaaccttgttttcgtgcttaacgtttaaccgtccgttttagtccgtcttatttgaaaaaattatgaaaaaaataaaaagacaagtcacatataaaatattaatcatgttttatcatctaataacaataaaaatatgaattatagaaattttaaattttatataagaccgacagttaaaattggacatgaaaacccagttttttttttcatcagacggagcataaaggatgggttttgcatttatttttctttttatttttattttttttgatggagggagcatgaaggattctcgaacgtacgtaaactactacgtcctactaaatgagtagtcaaagtatatattgggtatctgttcatctagacttagatcttgtgttacaaaattgggtgggtatcttaaacacgggtcttgtacattacttaaagccttgagatcatgtagtacgtctctttgactcttgaagatatagatcttttacccgttccttcaacatatatgtacatatctagaataggtacgtatgtatatatttttatctagaatcggtacctttacttcggtttatgtttttatctgttatcggtaccttttagttttttattacagctgtcgattttttattttgatattttttttgtcacgtgaaggtgggaatcttattttatgttgctcataccctgatgattcagggatagggaccccagttcccattccttcaacatatatgaacatgtttttatccaacatatatggatatgtttttatccacaagcggcacctatagatgtttaaaatatttaaaggtgttggttctttattgtttttaccatgtggaggtgggaaacaatgttaataggtgttggttttaaaaccagtatatatgagttgtttcttattagagcttttgttgtagtgatcatgattgttacggctttcataaggcggtaaggcgtgctcagggctcaagacgtctgttccgccttaccaaccgtgcataaagtgtcaccttagggcttgaggcgtcactaaggtgtgtgcaagacgttgcaaggagctaggtaaggcggcatgaggcgacgccctaggcgcgaaagaagagagagatgcatctggagatctaatctcatctggtggcggcatccttcccatctgatggtagcgtctttcccatctagctgcaacggtaccctcgatggccagaaccacccaacggcgaggagcggcggtgttaggggaagagggagccaaggaggagcagaggcgggcaagtggcaggggaagagggagaagtggaggggatgaaagggatggaagcgacagtggagcggaggcgagttggtgggtgcagatgcgattggggactaggatagatcgatagatatttgttagcatcttccattttagtccttggactttgtagatattacggagaagtccttcatttcctatttttgtcttccattttagtccttggactatgtagatattacgaaaaagtccttcatttcctattttcatatttgcataaggcatcgcctcgccttacgccttaccgcctaaggcgtaatgcgtgctgggtccttgccttacgccttaccaccttaacaaccatggtagtgatttgaaaaacgagaagacgttaggtagtccaactacaactaccacatggtcctgcatcttagcaactggtaccatctaccaccgctgcgcgagagagaggaagagacaaagaatagagagggaggaagaggggaagaagagtaatgacaggtgggtcccatattttttaattaaataaaatgctgactggattgccacgcgtgcaccacgttggacaaaaccgctctggattgggtcgagggaggtaatttgtccggtattgaaagtttagggtgaacaatgaccgattttcgggttttggggggtaatttggacgatcgcgatagttcgagggggtaattcgtacttttcctaatactaatatcgactccacagtaattgtctttccatgatagacatgggcaagattacggtgtgctcggttcatcacacccttttttttttctaggggtctgttcactttatggccaaaattaaccataccaagttttggcgtttacaaaatttggaaagctaacaatccaaacattgccaaaaattgtttccactaccaaagtttggtaaatctaaaatcttcctctcacaaaaacttaaaaagaaactaaacatagcctacacttgtcaactttatcaatttttttgtagtgccaaaatttagtaactttaatttaggcatcaaagtgaacaacccctaagtctttatcactcttctagctgcaaggctactcttccggaaaactcaattcatcccggtatatcttcttatttttgcatgttacttaaaatgtcatcaaaaaatttgaaaaaaattagtaggatagattaatttgtgatatgtcacttcacaaatatgcaatttcaaattcaacatatacaagtagaaataaagataacaaatttgacaatgaatagaacgcgtaattcacggttaaatttgttatttttatttcgaattgtataagttaaattttagcttgcatgtttgaaaaaagatactcatatattgatctatttaaaaataataattttttaaacgacatgcacaacaagagaacgtccccgaggaaaaaaatccacttcctatactccgtgacatcagttgctatattatattcctattcctagtcggagttgtagtagcgtttcagttcgtacgtagagtccgagtcagcttccacatcgctcatatatatgccgcgtgtttcgtaaccgtcagtgaaacccttcgcgcgaagcacagcaaagcaaagcaaaaccttttttcccgccaagaaacctcaatggcggcggcgaagatggcggggctgacgccggggttcaagttcgagccgagcgacgagcagctcgtgcagttcttcctcctgccctacctgcgcgaactgccggtgcccctgggcg

SEQ ID NO: 32757 - DNA, 1118 bp, Oryza sativa
  unsure (1)..(1118): unsure at all n locations
ttcgaattgtataagttaaattttagcttgcatgtttgaaaaaagatactcatatattgatctatttaaaaataataattttttaaacgacatgcacaacaagagaacgtccccgaggaaaaaaatccacttcctatactccgtgacatcagttgctatattatattcctattcctagtcggagttgtagtagcgtttcagttcgtacgtagagtccgagtcagcttccacatcgctcatatatatgccgcgtgtttcgtaaccgtcagtgaaacccttcgcgcgaagcaaagcaaagcaaagcaaaaccttttttcccgccaagaaacctcaatggcggcggcgaagatggcggggctgacgccggggttcaagttcgagccgagcgacgagcagctcgtgcagttcttcctcctgccctacctgcgcgagctgccggtgcccctgggcggcctcgtcatccgggacgacccgaggagcgtgccgccatggaagctcttcgcgcgcaacggccggggcgacgaggaggacgcctacttcctcgcgccagccgacggcgagggccggcaggcgcgcacctgcgacggcggccgcggcaggtggatcacccagcggctggagcgcacgggcaacctgcggctcgccggcggcggcggcagcggagaggccgtcgtgttcgagaagcacaggctcaactaccacgccggcgaggggcggtgcggcagcacggggtgggtgatgcacgagtacgccgtcgtcaagcccgcggcgctcggcgcccgccacagggcgtgccacatcgccttcaccggccacggccagaagcggaagcgcgtgcccgacggctacgtcgacgtcgaggacgacggcagcaaggccagcaccaacgcggccgccgccgtccctccttcctcgacggcggcgatgtcggcgtgcccatcgaatgtcacctataaccaagggtgccatatctcgccggagcagagcatcgaacagcacttccccgcggagcataataatatccaaatccaacannnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32758 - DNA, 726 bp, Oryza sativa
  unsure (1)..(726): unsure at all n locations
tnnnnnnnnnnnnnnnnnnnnnnnnnnnnnnnnnnntgaatagtctagagcctccgactgagcattaatgtggatacttatattttggttgttggccatgtttagcatgtttagagcctctatgcaaccaatgccgtgtttcgcccctttgatcctacagctcaggttgcggttgcggtttaacgcatccagcacggtattcaacgtgccagtgcaatcactcgacatgtgagggcgggctagttcatgatcttgccaagtttgcattgatgcgcgtgaactagaataagcatatggtaggtgcttcttttcaccatgttgatctgccgttgataatagtcctactttacattaccttgtaacactcaactcaatacctacactctgtactgacatatgagctacatacaattacctttctagactgatttgtgtttttcaccttagccaatgtctaacacttataatgatgtttacactgaatttacatgagttcgatttcccttttattatggtcacattttttatgtgcaccacctagttcagacgacggataacgttttgaatgatgatactctagacgcgccctccttacatgcaggcgtatttaatttatcacttatcctgaattgatagtaaatagcacgtacctggcatgttgctgcgctagattactcatttctcaagatcttgcaccatattacatccacctacctagtttatgca

SEQ ID NO: 32759 - DNA, 687 bp, Oryza sativa
  unsure (1)..(687): unsure at all n locations
ctatagggcgaattcgagctcggtaccctcagacaggcgagcgtcaactgttcggaacagaggtattagcggaagcacaagagaaagtcagaatcatcagggaaagggtgaggattggccagtctcgacagaagagctacgcggataaccgtcgaagggagctcacttttgagacaggagattacgtgtatcttcctgtcactccgctccggggagtacaccgttttcagacaaaaggcaagttggcaccacgcttggtgggaccatacaaaatcctggaacgaaggggggaagttgcttatcagttagaacttccatccaacatgatcggcatccatgacgtgctccacgtgtcccaattaaagaagtgcttaagggtacctgaagaacaggctgattcggaacacattgatatccaggaggacctaacatacgtggaaaagccggttcgtatacttgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32760 - DNA, 143 bp, Oryza sativa
gggcaaacgctgacagcctcgaaaggaaaccagcgaacacggccaggcaacccagggaggagagcgaacaccgaagcgcggtgggggggggcacaaggccgatacggcaaaaagtgcggggggaggccccaaaacctcaagcc

SEQ ID NO: 32761 - DNA, 982 bp, Oryza sativa
  unsure (1)..(982): unsure at all n locations
cccttgttaactctcttgaggccagtggtggattgagttgaaaacttgagttacttgaggcatacccgctgacattctttcctttttctctgttaaacatctgttacagggattgaggtgagagtggaaacaagccaggaaagaatagaccagaactaaagacaggaccttaaaggaactaactcttctcgttgatgtgctgtttgttttacttattctgcaagttgattaagcaaacaacctagcatggttacatcacaacccaccgatgcaaaccacgcgctacacacacaagcaaaggagcacacgactaacgactctaccctagagggtggcttaggttctgcgacgggttcgctgtaacatgtgattttaatctgacctctgtaaactatcttcgaacatatcacttggttcataactgggaatagctcccatgaacaagcaactcggattcactttctttacattcagtttacttcccactattctcttcatgttgtcctcagtaagcattcaacgtatccttttacacctttgacttttatcaccttttcgacctttgtcaactaagtacttttcactcgaagagttgtgnatgcttttggtgacgatgtggtacttgagcctgcggcctttcaaaaaaaccttcaagtggttcgtcaaaagctagactggcggttgttgcctttgatccaaaaaagacacatctgaaactcttagtccaaacaaatgtctctttggttaatcgcttgattttcttttccatcatcaggttggttattaactcgaggttagaacatagttcctctgaaatgaggccctaggtctcctttgacagtaaacaattatacacataatcccatatcagcatcttccgaaataatcctcatagaacttgtttttattacacatgtctcccttattacatgaatacaaggccttgccttaaacaagaagggaaggtgcttaacatcggtac

SEQ ID NO: 32762 - DNA, 331 bp, Oryza sativa
tcctctgagtaaagaatgaaaaaaagagtaaaggtggttatgagcattccaagaataaatccaataagtttggcacgttcataactaccttttggggaagaagaggttgaggactaggctctcccccctgccttcatctgccactttgtggcatgtcttgttctcggtttttcgacccgaacaaccgctgggattcttggccgttccagaatccctgttttcgtgatcgaatgacgaaaaataaaaaggtctatctaattaatctccttcgcagtttgttttaaagaagcatcaggttcaatctttctttcgttagttaatcccccttttt

SEQ ID NO: 32763 - DNA, 1301 bp, Oryza sativa
gatttttctttttataaaaccattttaactttgtttatttcttaataattattatttgtgctctgaaaattccactaaaatttgagggctccttttagaccaaggagaatttaacaaaaattctccgggccacattcgaatttttcttggacgtattttagtgtttgccaatttcttttcgaattttaattaattctattattccttttagaaaatgatttttatttcgggatgaatttatcaggacgtgacactggcataaccataaaaaagatcattaaaaaagcgtgagctgttattaaaacattataaagttgatgattcccaccaagaatttgatcgccgggtcgggctaattccatacgaatcagtacggagaagcatgtgcccatcactcctgcaatggcaccgaagatgaaatatagagtaccgatatccttgtggttagtggagaagagccatcggaccagatttgtcatttgattttcgttttgaaaactttcaagccttatcagagaggggctcagggctggaagagaagaaccttgatactaaaccaagtttcgataacttcttcagctttcatttcctccatcttcaaaatcgcagagttaattcaaaagtcctgttaggtcacatatgcttgcttttgaaaaaaaaagtggtatacggcatattattcccccccccctctttcgatcttctaattggaagatcagtagagtgtgttggaattcggttctttcgagccttgcttgggctcgttctatctttgaatatagcgaattccgttccacctcaatccacgttcttttcgcgctttgcgcttccaggaaatcatggttgtgggaaaccacatcacggaagaaaaatgatccttcctcatgatcccgcagatcctgataagctgcctggagaatagagaaatcatccgttgctcggatagagtcaagataggaacgaagcgccccctccaaaaggtagggttctaccggaagtacggctccgttcctcgcgtatagagctagaaattcttgaattagatccatcctaacattggatgtcctttcttccattaggaagagcctcagccgcccaggtatgtcctccagaggggtgttgtgattcagctcctgctgaatgaacgcaacccactccggatcctgctcgtaaaggctcagatagaagtttagcccttctaaatgagctagagcctgtgggtcttgaacttttgggggaagagtgataagaaaggagcaacaagttagaagggaaaacatctgtactatggggaggactat

SEQ ID NO: 32764 - DNA, 555 bp, Oryza sativa
aattggtcggcaagttcgggcgtaagcctcccaaaacagtcaaacttatgtttaaaaaagccaacgagtacgccaaggctgaagatgccgtcatcgcatcaaagcagtcgggctccagttggaagccaaaaaaggatacgccggctacgggagggggtggaagtaacaatcataaggaccgcaagcgtaagcctgaggaacttgttgcaaccgctactcactcttctcgacagcattcgcgcgtcaatacattcgacaagatcatgaactcccaatgcccgcatcatcctaactccaaccacgcggccaaagattgtttcgtctacaaacagttcgcggaacaatacaccaagactacacggaagaactccgacgaagaacaaagcacgtcaaagaagaaggacgatggcgaccccccggcaggttttcaaaaccaccgcaaggagcttaaccacatctttggcggccccttggcttatgaatctaaaagaaagcaaaaggtgaccgaacgggagattaacgctgttcagcccgacacaccccaatatcttcgat

SEQ ID NO: 32765 - DNA, 617 bp, Oryza sativa
catgatttttcgtgcccaactttgatcgtccggcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaatgacgtcgatgtataatgggaaagggggtacacgcttggtccatccgtccatggagacgtacgtagggggacacgaagctagggcatcaccatcactggccagctgccagctgccagctgcatgcggcacatcctgaccaacatggcttggccttatatatttcccttgtgttttcctcatgtacacagtacattactagtcattaagccgtgaaacagtactttccattatttggcgtactgg

SEQ ID NO: 32766 - DNA, 653 bp, Oryza sativa
cagtatgaacgtcttgtaatgctgcgcctgaaggagatgaacgagattgtcctctatgtcttgcggatattggtcgagcattgcgacgtttactttccgagggtcgatgaatccagtatcgaaaaccctccgccgtcaggccctttgaatctccattctacaacgataaaagggagtattttattttatatagtctacttatatacaaggacctaattaattaaaggagacgtagtaattaagaaatctaactgaacgatatacttacaaaatccagcaactcataatagagacgtcgagggcgtccagctggtatagttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcgggcttgacaagcggtttgccgagtttgtacatgtatttcacttccgccttttctattggttcgactcctagcaattgatccgtagttagaccggtgtcagtaataaattcttctatcgtcatgtcttccccggtcaccaacggctcgatatcatggtttggttgctctccaagct

SEQ ID NO: 32767 - DNA, 829 bp, Oryza sativa
accgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtctt

SEQ ID NO: 32768 - DNA, 462 bp, Oryza sativa
aagaaaatcctaaaaaaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccgcgcccgtgccctaacgccgccgccgccgcggattgcgccgcatcccgccgtccccgcgcgcattaaagagaggggaattactccccgcgtttccctgtcccgatgccccctcttttccctctttctctccctcggattcgtccggattcatcccgcgaagttcgccggcgtctacaatggcgcccgagatctccgcgcgcggtttcctctctccccggccgcgctctcccgctaccgttgctatatattcaatcccc

SEQ ID NO: 32769 - DNA, 472 bp, Oryza sativa
ggtcctctccctctgcgtctccggcacggcgccgctcgcctcgctcgcgggcctccgcccccgcgccgtcgtcctctccggggggccccactccgtacacgcctcgggggcgcccacgttccccgaggggttcctcgagttcgccgccggcgcgggcgcccacgtcctcggcgtctgctacgggatgcagctcctcgtgcagtccctcggcggcgccgtcgaggccggcgagaagcaggagtacgggaagatggaggtggaggtaaccgcccgctcctcggcgctgtacggggagggggaggtcgggaagcgccagacggtgtggatgagccacggggatgaggtggtgaggctgccggaggggttcgaggtggtggcgcgcagcgtgcagggtgccgtcgctgccgtcgagaaccgtgagaagcgcttctatgggcttcagtatcaccctgaggtagcgaccgttacgatt

SEQ ID NO: 32770 - DNA, 257 bp, Oryza sativa
aatagactttgagaaagcttatgacaaggtgaactgggactttctgatacaggtaatggtgagaatgggttttccaaacaagtggattagctggattaaaacatgtgtgatgggagggaaagtttgcataatattaatgggggaaagaactgacttatttaggacttgggtctctcccctctcatttgtaaccttgttagtgatgccttctgcattggcacttccaggagtgaagagttcaatatgttgatgataca

SEQ ID NO: 32771 - DNA, 127 bp, Oryza sativa
ttgcttctgctcgccgctggcgcacctctcctaactattgcccatttattctggaataatttttttaggagggacaattttacatatttctgccaaatccttctattattaagtacggctggtacca

SEQ ID NO: 32772 - DNA, 1268 bp, Oryza sativa
atcgtgggttctagatggtctcttctttcaatagtctttatttttctattagcaatttatttatttataaattgtattcctagttaaaatgttatttttctttttctaatttcaatttgttttttatttcgaattttacttgatctcgtactgtgttttatacggactattatttttatatttcttattttcttttccactttatgttgtttcaaaatggtattcctacttgaactctacttttaatttttctaatttcagattttattttattttttattctgaattctaattaatctcgtattggtttcttctatggactcttctttcaatgttggttatttataattctgaattaccgttatttttaaattatattcgtacatgaactcttcgttatttttttctaatttcgtattttagttatttttttattccgaattttaattaatttcatattgggttaattattatctggactcttattttaaattccaaatctaagttatttttaaattttatttctactttaacttttttcatttttctaatttcttattttattttatttttattctgaattttaattaatcttgtattgggttcttatatggactcttctttcaatattgcttatttttaattccaaatttcaattatttttaaattgtattcctacttggattcttctttcatttttctctgattaatgtggaaatttctagcccccaagtgaacgtgatacctcctttcaaagctattataataatataatagataaatatcattactattcgcgatatcggttagatgccactgaaatttttcaaaattgaaaccgtgccatcaccgtcacattttaaatccttccgacttcttccttcttccttctcttctcctctcctgccttctcttcgtctcttctcctccctatagttcggtcatgcctgctggtcctcgatgaacggctgccacgcctactgctcctccccccactgccctggtgcgctcaccggccgatgccgtcaccatcttcaactcctcctcatgcgagctccggggaggccgaatccaggcgtgcgtgctccctggccggcatcattgccagtgccatctgcaccacctgctccttgcacgagctctagggaagccatatccaagcgtcaccgtcatattctcttcacctcctcctcctcgtgtgagctcccaggaggccagattcaggcgcgcgtgctccccggccgacatcaccgccatcttcaccacct

SEQ ID NO: 32773 - DNA, 533 bp, Oryza sativa
aatttggatttgagcatgcattgatcctactcacttgtcttctctagatggccggtcacccacccaaccaccgcggagaaggcatgatcgactttgtggcagagttggcacgcatgacactggtggtgggctaccccaacgcgccggagtacacgactattccaccgctcagtggcgagcttcctcaccgtgtcagcttggaggtccatggctacgtggggacttgcctcgctaacatggcagttgaggcgtcaggaggcacagcagatcacgcctgtcaggaggcagcctacttgatgatggccagactgcgggagcgccacaactacatcttccatgacacggcgtaccgcttccacccccgtcgagccaacggtgatgatgtcagttccttccgtccgacagccggcgagaacgacaccacctttggtcacatgtgtgctgtgatgaggggactggataggatgcactcggacctgcacaaggcgaccaaggccttgaacgatgggaagctcatgaggatcgtcgctctg

SEQ ID NO: 32774 - DNA, 615 bp, Oryza sativa
aggtatgggttaaggaaagaagagcttagcacaccaatgagagttcataccccgggaaatagttcaacctcagtcagttttagcccttcagtgctaatagaaatccaaagatcaccatttctagccaacctcattcttcttgaatccaaagacctagacgtcattcttgggatggattggctgaccaagttcaagggagtcatcgattgtgcgaatcgcacagtcaccctgaccaacgagaagggagaaaccgtggcgtacaaatcactagtctcaccaaagcaaggggtctctttgaatcagattgaagcagaaatcccagtggacaccgtggagaagaacttgaggaaaatggaatatatacccatagtctgcgagtatccggaagtgttccccgaagacctcactaccatgccacccaagagagagattgaattccggattgacttggcaccgggaaccgccccaatttacaagagaccgtacaggatggcagccaacgaactagcagaggtcaagaagcaagttgatgagcagctgcagaaagggtacattcgaccaagtacttcaccttggggtgctccggtcatttttgtggagaaaaaggataagacg

SEQ ID NO: 32775 - DNA, 703 bp, Oryza sativa
  unsure (1)..(703): unsure at all n locations
atcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcnagggaataacctggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtct

SEQ ID NO: 32776 - DNA, 661 bp, Oryza sativa
attgacgctgcgatactagatgtcgtagttgcaatggctattaacccatcagatcgcaccctagcaagaagtgccttgtaaaggaatgttttcccagtgccacctggaccatgaacgaagaaaacctagctcttcttcttaatacatgttgtgtgatgtcatcaaaccctgcacgttgctcatcattcagatatttgtatatatctagatgctctgggtctattggcacagactgctcctctttgacttcaatcggtgtgtcattggaaaaaacatctggttgacgaaagcataacatgcgtcacgaattcattgatgataaaaataaagacaattaaggtcaacattatagaacacactcctctaaaatattacctatatcagtcaacttaggaagaccatagtctgagatatcctttcccatgaaatgaagtatatcccgtatgtctctaagcaccatctgctctactaacatcgggttgcgattatctcgggcataatcttcagacattgactccttatgtttgtcgcacaaagcacatttatcagtaacctcacaaaaggcaagtataatcgcaaacaagcgacggagtgcaaatggcatttggaaagatgccgcttcgatcaagcagtcgtcatgtgacctgtctgtctcaacaag

SEQ ID NO: 32777 - DNA, 548 bp, Oryza sativa
cggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactca

SEQ ID NO: 32778 - DNA, 959 bp, Oryza sativa
ccacaagacacaaccccacgacacattcctgtgcgccggcatgccaccacgatttaccggaaagaggtcgtgacagcacccttcgcataagcccctccaaccaaacacaccaaaacttaagtttcacccccactcctcgaaggcagcgggcagtcccctctcgtgcttaggtgaatccggaagcgacaaaggccgttgtagggccaatcccgctccatcacgcccacccttgcatggatgcgtcagctagaggaaagttatactacaagcccagccgttgcccatgctggcttatggtaagtacgaggaattcttccagagtttcccgcgaaccggtccttaattgccatgggtgcgaccatcaaaaccatgcacccactacccaccatttaatatattttaattaactaacacaatagcggtggcactaatccaacatcaatactagagtctggaatctatgcattaatgtaattcccccattgtgtactagttgaactaagcatggctaagcaatccctaatccaacatctagtcatgttacaacccaagctagcaaagaaacaagatatccaataatatggctgagacagtaggtaatcatcccatagtaacattataaaacaatgcattatttaaaggaaaacaatagagcatttgcaatatgggatcaatatgttcaagtgacaaacatgacttgcattgctctgcggctggaggaatctcagcgactatctcaaagaacaccggagcgtcgggagagccggaatctatgcgatatacaaggcaaacaatgcaaacatgctataagactactaaaatagagaacaaaactattttcattggattcttagtatttttcttgatttactgagacttgaatgggcttaaacgaagcacggatgaattttctatgaattttagaagattcactgtatttttacagtaaaagaaaaatc

SEQ ID NO: 32779 - DNA, 994 bp, Oryza sativa
  unsure (1)..(994): unsure at all n locations
tgcacccaaatcaaatcacatcatcaatggcgatcgatcgaccacaaacatgtcagcaatggcgatgcgatcgagcttcgtgtgtgtgtccgtacgggggtagccgaagacggtctcgttgcaaaaggtgcagtgcccggggagctcgtcgggaagggtgaagatgccgaaggcgacgacgacggcgcggagcttggcccagcgagagaccatcttgcggcgggcgaagtggaacagtcggctcgagtcgtcgtcgtcgtcgccggcgacgggcgcgcggtcgtagccgtcggtgatggccttgaggatcttggcggcgcggagctgcgagtccttggagacgccgatggtgttgagctcgatgaacttgctcattttttgcgccaccgccctgtccttcaccagcgcccacttgtgccaaaaaaagccaatcacattgagccaaaatttgttcgaatttcaaaagtattcgtacgatgaaatttgtgtgtacgtacccgaggcgggtgccggcgtggccggtgcacttggagacggtgaagagcatgatgtcatgggcggcggcgctggtgatgggggtgtactgcggccagtagtaggcgaggtcgtggacggcgacgccgtcgccggacttgagcacggcctcgcggatgccgccgtccgggttgctcggcgagcagacgagctcgacgtaggtgtcgccgtcgaacatcttggcgtcgccggcccacctgtacagccccgacttgaggaaatccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32780 - DNA, 662 bp, Oryza sativa
atgaattagatatgaattttagattgttttgagccattttaatgaatttctagaattattcacgaattattgcgcaattattatttattttctcaaaggaaaaggctgtgctgacgtcatcaaaggggaggggcggcgccggcaagcgggccccaccggtcagcggcacaaaggcgccggtccaccgtggaccgggaccaccgaggcggtccaccgccggtccacgggatccgacggcccggatcggcccaaagccgatcggacggccacgaggcggcgcggctggggcacgggcacggcatgaagccggctcggccgagacatggcgcggcggcggcaagggggaggcggcaagggggaggctgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaaagggga

SEQ ID NO: 32781 - DNA, 318 bp, Oryza sativa
atcaagccggccgggcggccatggcaaggcggcggcgcgggcatgcgaccgccagcgacggcgagcggcggcgcgggcggcgggcggcggcgcgagcggcgacgaccgaaagcgacagcgagcgcgcgaagagggcggcggcgcacggggaaaaaaaaagaagggaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaaccccca

SEQ ID NO: 32782 - DNA, 1020 bp, Oryza sativa
catgtgctaaaaagtcaacggtgtcaaacattttgaaacggagggagtactttatgtatttttttatataaaaagagaatatagtattagatgttactcccttcgtcccataatataagagatttagagtttttacttgcaacgttcgaccactcgtttcattcattttttttgaaattattatttattttatttgtgatttgctttattatccacagtattttaagcacaactttttattttttatatttacaaaaaaaatttgaataaaacaagtggtcaaacgttacaagcaaaaactcaaaatcccttatactgtgggacggagggagtacatattttactataatgaataatttagacagaggtatattcagatttattgattttttatagaacagaagaaatatgagttttttttaaatttttttaaataagatggactattaaacattaaacgtaaaatctcgtagctatatttaaaattagagggcgaggcagtagaagaaaccgacgctttgatgggttttgggtttttgtgctgctcctttttcgtaactggctctctcctcctctgctccactgctgctccgcctctgctcgtgtgagcccccagcctccattcctgcctgcctgcctgcctcctgctgctcctccccggatcgaaatcgatctctccttttcctcctcctcctcctcttctccatctctccagattccacaagccacgcgggatatgctgctctgattgatctctctccacgtcggggtaatgatctctctctctctctctctttttctttttctttttttttctttcttcgtgtgtgcgtgtgtgatctccggtttggttcttggtgcctgctgctatagtctactagtctactgctacttacctttttgattgttgggagcggggatgatgggttgtgtgttactgtacctgatctgcgggtttctcgtcccgtttcgccaagattttttttctcgtccccggccgcgagttcgtgcttcttgcgg

SEQ ID NO: 32783 - DNA, 630 bp, Oryza sativa
aatataaaaatatttgagtcatacttaaataacatttgatgataaatcaagtcacattaaaataaatgataattaaataaattatttaaataagacgaatgaacaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatttataagaaacgtcttt

SEQ ID NO: 32784 - DNA, 1018 bp, Oryza sativa
aaccacgattgggccgcacatctgtgagcttcttgggcttagcaagtttaccaacatgggctattttgatccgggttcctgggcaccccccccattgggctccgcccctaacggctcgtcatccaactccgtcaagctcctcgtcgcgctagcggagaaggccagcgccgctctcgtcaaggctgcggcggtggtaccctcccctgccggaggccgtcgccgacggggcgcggtggcgccgctcgtgttcccgctcctcgatgagggagagatggttgtggcagcggaggccgcgcccaagccagcggtggtgtggaagcggcaggtggcgtgccgaggcgggagggcgagcaagcggcctgctcggcgctcgcggaggaggcatgggctccccgacagacctcttttgtcagctctccctcgttttcgtcgtcttctttctccatcgctgccatctctctcttctctcgaatcctctcgctctctctcatgtcgttggatccaccaacctccactacccaagaaatcaccactgtcctccttctcgtcatcgccttgtactccgctgtgaacaccgcgtcggcgccggtcttgataccgtgggagcaaacgccgcaccggctttgcatccaagcagtgaggaagagaagacagagagagaagacatggagagctaacatgtaggtccaaggtatgacatttcaacaatttctctctcctctccaaccgaaaattattattttaatggatgcggtatccaatagtaaatatccaacttttgtgagtgtgttccctaaaattgacttcacgcagtgtcctatagctaaaatcacaaagtcgcgaagttctgtagcaaaatttttctatcaataagtgtatgcatgcatgtaatcaatgaatattaagatggcttctcgggttacaacgaaacatttaatttatctctccatttatgtcatgaattcacagagattataaatagaaacaacttactccctccgttttttaatagatgacg

SEQ ID NO: 32785 - DNA, 1242 bp, Oryza sativa
ggtgtcgccgtcgaacatcttggcgtcgccggcccacctgtacagccccgacttgaggaaatccgtcaccgccgggtacgactgcgccccgccacgccgcatccacacaacacaaaagatatattgtgtcaaacaaaaataaagattaaatcatgtcaagatcaatcgtacttcctccgttttacaatgtaagtcattctaatatttcccacagttcattaacattcatacttccttctagatagatatatgtctagattcattaacatcaatatgaatgtaggaaatgttagaatgacttacattgtgaaacggagggagtatttaactttaccatttctatcatttcgagttggtaatatcagtctatcttgttgatgtatttcttttaaaaaaaatcgcaacaacttagatgatatgcgaactatgagagaatgtcacctctcgagagtttagaatagtttccctatcaagatcaatcagaaaagagtaattttactatatttgagaatgtagttagaggtatcacatttactagcataaaacttatatttgtacttatcaatttttaatgtgaaatttaattaggtacttctcaaaacttttaatgtgaaatttaggtatctcaagacactttctcgaggaagaaattttacggatactgagaaaatacctcgtagtacctaagttttacactagaaataagaattttggtaccaagttttataaaataaaacttggcacctccatgtactttcttaaagatattaaataaatctacctttctcaaggacactaaaatttctaatgagaaaacgaaaaactacctttttcaaggatgaagataccactagaaaacatggcatctccaagtacttttccaaaaatgataaaactacatttttcaagaactgtaaaatttctcatctggaaaaggaaaaaacaaatttgattgcaagtgatgaaatcggattgataaattacggagtagtatggtgcgggggagacgacgttcatgggggcggaggggcccggcggcgagagggcgtagagcgcggcctggaagagctgggtggatccggtgccgacgagcacgtggtagccgtcggcgacggcgttgccgacgaggcggtggaggcggggcacctcccgctccaacccgggctccaggaaccagcacaggctgcccacgtcggagaagtagctcatcgtctgccaccccgggatcacgatcgtcgccct

SEQ ID NO: 32786 - DNA, 5808 bp, Oryza sativa
ttttatgataattaagttactaaacgtgtagttttgtgacacttcatcttaaatgtggagttttgtgataaatttagtgctaaatatgtagttttgtgatacaactcctcaaatctgtagttttatgatagtttggtcatagtatctgtagttttgtgaaatttactcttatatatatatattggaagaagaaattaaaatagctgcatatgcaagaacaatatacagagaaaactctattaatttgatctccctgaaagattatgcatattattgttatagaaacattagttatttttttcttgatgaaatttatatatcgaatcttagacgtcgattgatcatatcaacaacttacatttgcttgggtcattagttttttttttacgaggagcagaggtagagttgcataatatgttgaaaagaaacacgtgagtatatctataaacggtttatagttaaatagatatagtgaaaaccgacaaacggatgtcgccttgcgcattttccataattggaaagaatgatatgttttggttgggtacgcgtttaacgttttgtatattggaaagtaacctatattataaggtggtgtgtgtgatatccttaaactatactaaaatagattgacaacctccatcgaaagcgacaaaaaaaccgttccacaatttcaaatacaacaaaagcgcgggaaagaatagaaagagtgtgcttactcttacatcctgtaattataagacctctacatgtatggtctcatccctatgcaaataaccttgggtggtttttccatcggttcagtgatgctagcaaccatcaatgaaatatttttattttgacaatgcatttagcaatatatatatatatatagtctggcacccaattatctactaagatatatgggataatggttttgtttgttcaaggaataaatatccaatatggagtgataaagcaggtaaagacattgcacattgcgtgacataatttatacaagcttccaaacaaaacaaagtgtaatcatctttcagcataacaccaccacttaaatatacacgtgttatacaaaacatcaaatgtacccaagaagagtctgaaacgaaacgatataaagtactattgtgggataagtccatttgacaattctaaactcttcactttatctaaaactcacccctaaacatcaaaaacacgtatttgacaacaccctcgccccttgtccaaacaaaaaatggttggttaaatattgctaagtgctaacctgttaggtggaaatgactgcatgttttttttataacttttcctaataagctattcgttagattaattagtatggattggttagactcgatatatttgcatggataagtacacttgcttcttttaacttagcctcattggaagaagaaaatagctgcaagagcaatacttaggaaaactattttgatctctcgagcactagaaatatattgttgttaagaaacatgagttaaatttttcttaatgaaacatctagaatcttagatgtctattgatcagattaaataacataaattggcttgggtcattagttgtttttactttttacaaggaagagcagggttagagttgtaaaatatattttaaaaaaatgagcatgtgcatatatctatgagcgggtcatatagttaaagcagatatggtttggcggttcatatagttaaagcaggtatagcgcaaatcgacaaatggcgggtgttgttcatgcactttccgtaattggaaagaatgatgtccttagttggggagttgcacgttcgttgcattatgcgtttttaacattttgtatattagaaagtaacctaaattatgagattgtgtgcgtttgatatcattatattatactagagtcacttgacaaccccgttgaaagcgacaaaaaaaccgtaccacaatttcaaatagaacaaaatcataggaaaagaaaaaaaagaagagtatgcttactcttgcatcttataattataagatctctgtatatatggtttcatccctatgcaaataccccttaagcacttttaccatcggttttcagtgatgctagcaaccacctatgaaataattttatttttaaaatgcaagtagcaacatatgaactgaaatgtctggcaccagattatccaccaagatgggaatttatggtttaatttgtttattcaacgaaaataaatagtaaattgcacattgcacattgcgtggcataatttacataagttgtaacaaaacaagcgtaaagcatctttgagcataacaccactacctaaatgtacacgtgtcatagaaacatcaatctgtacagcagaagagtgtgaaatgataaagtacgtttgtcacacccacaactgtacatatcacactttccctgatcctcggcctttcttttccatcaaatctagctagctaaattctaagcttataatgatcaaaacatggtgttggtggggaagcaccgatgttatgcacatatgcgtcttccatgtaatcgaaaagatcacggtgtttgcgctcttaaaaaatcaaatgaaaacggatctctggttccagattttcagatgttgtgtgcgtatacgtcttccatgtatcaaaaagattattatgtttgtgcttttaaaaaatcaaatgaaaaagtctctttggttccggattttcagtccaaagttcatgaacattatattacatgttgaatgaagtatttaatttatagaaaaaggtctcaatacaccaaaacttaaagttggtcccgtttgtcgatgcttattaactatgcatacaagttaaaataaaattataagtttcacaaaaacaaactactttttatttggacagttttaaagccaaaagccatatatgagagcagcttttttcgctggcgttattatgcgtaaagattgcttatgcttgcagttttgtacttttgcataactcaaaagtcaaaggcatatacttggtgaggttgcttctcgcgtttcaaatttcttaatttttggcagatagcagctggccagatttttgtgttggtaatccaaaatgatgtaataaataactaataaaacaagatgaaggcagggagaaatccctccactacgaatttaaagttacaactaggtcacatccggtgggaaatgactcattcctaagaaatttatacatttcagttaagcttactgatgtagaaaagccaacaaaaaaaagactaacccctaatatgtgcaaaaattacgcctaattcggaatgaaatagcctatgctgattaaccttgctagtgagaaatgttactagagagaacagtacgcattgaacttagtcagaccatctagatataaactgagatgatggtatgacccaccatgaagctcaggtgtttggagttcttcacaaagatttgctggccttcagaaacaggtgatattccttgagcatcatctccccgccatttacagggtcaaagctgtatctgtagaaactgaatgtgccaaaaaattgttgttgtaattagtcgaaaatatttctcagaagacaaacccatgacaatgcaatattcagcaaataattaatacatcatcaaaatctaaataaggtttatgctagtattgcacggactacttcagtccaacctacttaactgatgctatcccctgtctaactacacaatgctatggcattttaaacaataatcccaataaaatataatccaaaagaagtacatataggaaggcagaagttacagatccagattgacttgaacgagcatgattgctcaataaaaaaacaaagaaagaaacagggaactgcttacattgcatatttcttttggtattttaatttgagtagcaaattgccaaaaataaaaagttatggtgtgcacaatcatcgtttgaagaatatgcagactggatcttttcaatcccttttagcaatatgaattaattcccaacatgcttatcagattttaccaaagaatattgacattattttgcttagacatacatttcttgggggacgtttgaatttagtaagcatgtgagtttcaccgacaagaaggccccacatgtcactgatagaggtggtggccatcaccgctactaccttttaaagtagtatagatagtctttgagatgtgacttttatcattacatttttaactttacatcactggaatttatataggttgcaatatgacaaaagtaattcttcgtgacaaaatctagctttgataaaagttattccgagttttcacatatctagctttggcagttttaaatatttttaaaacttggaatgttagaacaaaagtaaaacaccatgtttgtaaactaaacaaaatgtctaaaacccatttcttaattatcctctgttgtcttttgtaaagaaagagtacctgccatcaagaccgatcatcattacagtgtcttgatctccaaatgccataatataccgcgtgatttctggtaaacggaactgagcaaaagaccattctgaactgaagtatttcggcagaatccctgtaaattttcaatgtatataaggaatttgaacaggaaatacagatggaagagcaaaaaatatgtattgtcaacccccatgcagaagataaaattgagtttcttttctctatcggctcgactttaaactctcaaagcccacatgccaatatagttaacaaagaaatagttttgttctttgtgtagtgtatatgaaacaccccctatagtaatggttggcaaactgtagcaaagtatggctagcaaccaaacaccccctaaagtaaacaaatgaaatgggatcgtaatttgtaaagttgtcgcggccatgttaatggtatcatggtattagcacacaagaaggggactgtaccgcattaccaattagaatcacagtaccgagcataaaagaagctatcaactttgttatgagctataagatgctaaatacatacatgtcccagaactgagacaacacaagttttctatgtaaaatgcttttgcaaggaagtttcaccaaaaaaaaaaaaaactagtgaagacaatatttgaataactgacaatactgtattttaaaattgattgaaatattacaaagagataacttactagcccataagattcaaaccttaatcaactaacctttcatgaaagacagggatgagctcgtattggatccaatctttgtttgtgtaactggaaccgtagaaccatagttgcaattgtcattcacctgtgcacctgcagttgcagactcccccttttttgcatcctcctctgcatctttcaccctcagactgaagacatgcaccgttcctttgtcactggagactgctagccactgcacatttggtgacagtgcaatgctatatatctcagctctgtcaagtcctctccgcacctaaatagcaagacgagtacattactgtttttttttttgaaggtaagtacattactggttactgctgaacatttgtaaattacatagactatagcaaggaaacatttatgatatccaaagacataccaatgatataacaaaagaaacaaaagattattttgcagcgcaaacaaaaaaagaaaaaaaaacagcctcacctcctgcacgcaggtgccgtccctagtgttgaatatcctgatcaaagtacccctgacactggcagtagccaagagtgttccatccaaggccattgtcatgcacgaaaggggcgagtcatgagcagcaatgaacctggtctccttcaacccgaaatgctcaatgagaacctgccccttggacgtcccagg

SEQ ID NO: 32787 - DNA, 1145 bp, Oryza sativa
cagaaattgcccccttcttttttcagaattcagagtgaaccaatcgctcctagaacagtagagtagaacggcttgttcagagcacaagaactgagcactgtcgaacaattatgctcctcaagaacctaaatcatatacatacagaaaacatcatcaagatgatagaaagctaaggaaagctatcatgtacatacagaaaacatcatcaagatgatagaaagctaaggaaaacgagcactaaatcaagcagagatggccctgaaatctaagatttgatctctataataaataacatcagttgcctctccaatactccatagtcaatccatacacgctaacaagtaacaagagattagaaccaatggcctcgccgcaagagcgcaaaaggcagggaaaaatcaaacgccgacggccgatcaacaccccgcaaaagaatcagccaaccgccaaacccagaggttaacacgacgggaatcaaacctaaccaagagagagagagagaggaagtaggggcacgtacctacctacctacctacctagctctttcccgcagccgtgggatcgggaatgcgggggcggcggcgcggtcgccggcggagttccggggagctcgagctatcggcggaggcagcgagcgggagtttgggcgggcgcgctcgcggtcgcggccatggtggagcgctagatgacgagcgatgccgttccgcttcggtgttcaactcgggtttgtttggcgtggtttcgtttcgtgttcgggttgtgggagttgtgatgtgatccgggttcacttcacacggctccatggaaatcggttcggatttcgcgaaattcaaaatttccttttatgagatcgaaaacacgaaccactcgatctttctctatccttcgataagtttgacaagaatagactggattttgattttttttttttacaaatttatgcaaatttcatcggtttttattggggttcagatttcgcaaaattcagattgttttcatgagattgaaaacacagaccactcgatttttcgataagttcaacaagattaaaatgaattttaattttttggtaaatttatgcagatttcattgatttttatcagggtttggatttcacgaaattcagttttttttatgagattgaa

SEQ ID NO: 32788 - DNA, 5021 bp, Oryza sativa
  unsure (1)..(5021): unsure at all n locations
ttcatgagtgaattttgatctactatctggattataaaccttggtcgtgaccgtagttctttttttttgcgttgaaaccaagtatgtttacctggttccgtaccacttgttagcagaaacaaacaatttgtagataaatcttttatatacatattcttaataattcaaaactaaatgctgtaaaaattcacaaaatcagatttaaaatttaaattttggtttatacgcgtaaggataggcgaaacaatagcacacaaacaattcggcaggttaattacaggagtacatggcttctgaataagtaagtagaatgaaaaacgggaagatgaacattgctgatcagatatacacgatgcatccgatatttaagagtatgtatgcatagatgaaataagcagcaacggattagcgacacgaaagtcatctgatatatatttcagataaagatgttcaacacaagatagcttcagaccaggcaatatagcaccagacacttggtgattcagggttcaacaaagtgatatatgatcgagtctacaaacaaacaaaaaggtccgatatttcgtttcccacagatgataaggatagatatatctaagcggctgagaggaaggccttcccgggggcacgagcagagaggcgaccatggcaaccaagtagctgcaccatagagacagtattgacaaagattagattatccgcaacgatgcatacgagaacaattacaatagcaattgacaggtcataaaagcaaagcgaaaaaggattttaacaaaataagttactcatcctgataggacccaagataagcattagtttagaaacagcgtgtttaccttagcattgacaccatcaggcatgattctaccctcgctcttaagcctgacgtattcatcgcggctgaacttggtgaaacccctgaacaagaaagtgcaagttaggaacggaacatgagcttatggtactcagagcacatcagaaatttagatgtactcgtatgcatcaccctgtttgatacttaccactttctactctcaatgatcttttggcgaccagggaacttgaacttggcacgacggagggcttcgctggcatggacagcattgttgggcttgcaccgcacagaaaggaggacctggccaatatccaccctagcacaggttccctgtggcttcccaaaagcacccctcattccagtctggagcctatctgccccggcacacgaaagcatcttgttgatacggagcacatggaacgggtgaacccgaaccctgaggtggaaggcatcctttcctgcagacttggtcatgtacttgttgcacgcgatacgcgcagcctcaagagcctcactggtgacattctccttctcccaagagacgagatgcacacagtgggagaactcatccacacccttcttcttcatcccgacatcgtagatcctgatcttggggtcagggacaccacggcagtaccttgacttggggtacggcttgttcttgatctggcgatagcaccttgcaggtcctaaccaaagcaagccacaaagtcaagttagttactcagaaacaccctaaagcacctacagccccatcactgttaatctgaatactattcataactgatcgatgaacacgcaaatagtgaatatacaaagtcatgaaagaaactaaatccattacattaatctaaataatcataattgatcgatgaacaagaaaatagtggatatagaaatagccatgaagtaactaaatccattacagggattcgcttcaaacaacaaaaccaccacaaacaagccatttctagctaggataaatgcatctacatctgctagctacatcagaataaatcatttagattcacagagaaccactaatcatatcatactaccattatctgtgaaaatcaaagatcggtacagttcccccaacaatattcacatcctattaagtccaacatgactccttcaggttgagtaagcaaactaacgagatatgcaacgaaacaactacaaaatctatctacacctaaattcatcaaagcaaaacacagatcaacaccgggaacagcaacaatccagcagcgcccagctactatggatctaaaccaaacgcccaaaacgcgcctgaaatcagggagccgcggcgaccgatccagcgcaaccgtggaacaaacagcaagacaacgagcggtagagcaggaaatggttagacttactcctccccatggcggcgacggcgtgcgcgcggcggacggcggcgggaagaggcggggatgtgcggctagggttcggaggagcgcggcgcagaggcttatatagaggggaggggggctgtggggtttgcgtcacgcgtgaccgatggtggtgattgcgtgttgggcttgaggagcccatggaagcccattgcaattgggccacctcttcctgtcattatttttttttcttttcgttttttatgggagtggatattgctggtcagagtccactcgggtgtgttctcatgtttccaactcatttctgttttttcgtgcctacatttcggtgtgttttaaaatattttatagataaattactttaaaaatctatatgatcatttttagagttttttaatataatatttaattaattatacgctgattcatcctatcattttgaatatcagggtatggttcccaactcataccttctaatacagccaagtcatcagttgacagtaatatgttaattttttaaaaatatatatatgggttattcaagttttatttatttattaatgtgcattatataccttctaatatatgtctgtttagaacatatatatttaattcaaggtttcgatcatcgaagtgttttagttgtcttttaagtcaaagctctctaaggccctgtttgtttcagtttaagattattataatctagattatataactagattactataagctggattataataaaccgacatataataagctactagtttatttctctagattattatctgtttgttagttgttagctacccaataatctaaaaaaagcacctttagaatagcttaccagattatagttatctgacttatagattataataatctatcataataagctatctgtttgtttcagcttactcgtaataatccagattataataatcctaagctgaatcaaacggggcctaaattttgatgaaaaataaactaacacataccacatcaaattagtttctctttttgttagtgtatttatttggtatagtaggtgttaatttatttttataaagttagttaaagttagagagttgtatgcgagtgggccccacctatcaatggcacatgaagtcagaggagcttccttttagtagctaggccctgtttagttcccacacagaaattttacaccctgtcacatcgaacgtttgaacacctgcatgaagtattaaatatatctaaaaaactaattgcacagattgcgactaagagtgtgtttagttcacgctaaaattgaaagtttgattgaaattggaacgatgtgacagaaaagttggaagtttatatgtgtatgaaagttttgatgtgatggaaaagttggaagtttgaataaaaagttgggaactaaaccagtcctaatttacaagacgaatattttaagcttaattgctccatgatttgacaatatggtgctatagtaaacatttgctaattatggattaattaggcttaataaatttgtctcgctgtttactgatggattctttaattagttttttattagtgcctgaacaccctatacgacatcctacataatacccgatgtgattaaaaatttacactcctagatctaaacatggccttagaccggaggatgtattggattaagttactcaaaatctcagacgaatccggaacaagttttgaaaaaaataaaaggagagtaatgttaatgaacaaaattaagtgcagcatagcttcggtttgtacacttatttcgtagcaaaaaatgttgacatctcgatgggaatagaaggttctgacttaaagggactctctggttcgggcgttcaatggtaggaggttaaaatcggacgctgatatcagcataacgtcagcgctcgactcacgtgcaaaactattttaaactgttttttctcttaaattacttatccaaatcatgatccgattgcaccattaaattcgttgcaattaaatcttcaaaacaagaccacacatagatatattccgactgaaaaattttagcttatcattgaattatttttaaatgttacatgatgtttcaccaggtatatcggaattgtttcactaagtagattgaaaatgtttcattcgtttaaatcgggtgttgtttcaccttatattaaaacaatgtttcagcaaacagagaaagaatgtttcagttcactgcaacattagatatgtacatagtgaaacattgtgagtacactaggtgaaacattttttgtggaacaaaaaaataaaacgaattcccttaatagagggttttcaaaatatatgggtgatttgttgcaatggaatatttcagttcactgcaacattagatctatacatagtaaaacattgtgagtgcactagatgatatttttttgtggaacaaaaaaaataaaccaaattcctttaatagagggttttcaaaatatgtgggtgatttattgcaatggagtatatggtgcggctacgcgtcagggaggggagcacctgatccgactcgcccgcgccggtcgcccggcgtataaaaacacgaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32789 - DNA, 630 bp, Oryza sativa
acaagaattactagcagagataatagagcagttctgggcattcctcgtgctcttaagagaggcagaattcgttatctgtcctttctttttttcggtgaattatcaatagggatgatttgccttcctagtctttattctgataggatcatcctatgctagaatgtctgcgagtttgttcacttgaatatatgatatcttgtcctatgcatttggtgtccattatcgcttatgatctattgttatgcctaactcagacttcaaccatgccttcctagattttagttttcttgcagtgctttcgtagttttagttgctctttttctgatagaccatgacatgcttttatcattgtttagaggacattttgctcagtgctgtgctagctttgttggctcaagttcacaatgggaggttgtgtgggcaaggtgagtcttccaaaaccataattgatatttagcggttcatcatggctgttcaatttaccacatatattgatttgtgatgtttcttttatttatgttcatttgttcagggacgacgacatattgaggaagacaagcttgatttcaaaggtggaaatgttcatgtcataacaagcaaagaggactgggataggaagattgaagaagc

SEQ ID NO: 32790 - DNA, 2946 bp, Oryza sativa
acccagaacagactgaaatctgcatgagagtgaaaaaaaaatcagatattccagttataaagtcagaaataattcatgaaaactgcattcagatattctagctagtaccctgtgcaaaaagttgccatttcttagtattccctgatttatatagctttctgcctttagtcaatgcaagatccttgtgtggaataaatcatttctagttatgctgacgtgtagaactgctttttccattgttctagtttgtttctaaaagattcaaacctcatttgtaaattacttaggtctgttttatgttggttttatttctcatccaaaacaagttaaacaacattatgccatactcccagttattctgaatagcacttgcatgctcatccacttggtatttccttttttttttcctcaggatttgttttgcttatttttaggatgcctgcttgttttttggcaatacacacacaacatttacgactcatccactttagatggccattctgttgttggctgaaatctcgtaacaagataaagttatgaaaattcttgatgcaaactagtacctttgacgtactcactgttttgttttgtaggttgtggcaaatttcagtgcttcctggtgtggaccatgtcgtgttattgcacctatttatgctgagatgtcaaagacttatcctcaactcatgttcttgacaatagatgttgatgacctaatggtaattctaaccctttgtttggtcaaatttgctattgaaaaatgattaatttcagttttgtatgaaccaagaaaccccttatacatctgatggcggtcattttatcaatagtatcatttatctgtaatcctgtataactgattgtgcatcctcactaaatgccatcgattaaggtttataatcaagaatagattgtgtactgagttccagatgtgttgaattatttgctgagggatatcatacccaaagcatgacctatcatcctacttatggagtaattgctgtcgacataccatgagaactttgaaaaaaaataagtttgtttggtgtctctgtatttttttggtaaagcttcttatatattggaaattatcatataaaggctaaacacatgttgcgcctgcactgttagcattatagcattataaagagcttctcaacacttctagaattaagtaaacagatgtagtgattgcatgcaaattgtcctaaagttaactgaagtcctgacattagagtagcttctcacttagcatatctataggtcagggtgcatgttgtaatgttcttccgatttaacaactctcttgtattctctgcaggatttcagctcatcatgggatatccgcgcaacgccgacctttttcttcataaaaaacgagaagcaggtcgacaagcttgtgggcgccaacaaacctgagctcgaaaagaaggttcaggcacttgctgatggcagctgaaccttattatagcgcaacggctagaactgaaacgaatttggcatgtctgtccggccaagtttgtgtccgtgtgctcccttgcagcttctagtgtatagttttggtgtctctgttcaaaccatgtttctttttctttctgaattttgcccatgtgtctggccacacacatatgcaatctgtgaactaagaagttgtgatgtgttcagagctgtaacataagagtaatgtactagagtagttttaaaagacagtgatatggttgtattttgagctatgaagttgtgccaataaatgagtgggttttgaaagtgactctttaatgattccttctactagaaccgaactatttgtcataaaattcccatgaatttcagttttttcctgacgaacggacctcgacgttcggacctcggagtgaatgggccttagcccactcgaagattaattctttagaaaatcacaaaagcccaccttatggtatggcatgcatgtgtagtttagtaccatcttgcttattctaggagagggagacctccttaaaagggaggatgcccttctagctacttgaagcatgtgtggtggagagaagaaggggaacacgctcgctcgcctcgcagggcagggcaggcggcgcgtgtgcacgacgtacgcgtcgaatggtccaccaaaattggttcctctggcagatgcagcctccttttgcagttttgttttgctgcaaattcggattcgtttttttggaaacgttccgaaaaatgacagaaaatctttctgattttcaaacgtggagctcaaaggttttaatttctggaattcgatatatatatgctatcttataaaaacatacacctgggaacaaaaattgaagttttaaattggaaagcatttggaaccaaagaaaaaaaaatgaagtttcaaatttaaaaccagatgcctctcctagttgtgtgctactacttggatggcattatccaattggagacttcgaaaaatgagggatccaatgaccggctgccggcctacgccgcaacgcacggccgtttcgccccccactccggcctaccggcgccccaggaaacacgccgcacgcgccacggacattcgggccccaccaccagccatcactaaaccctgtgcttaaatcaattaattagaccttaatcacccagcgttaatcccacctggcactcacagtgcgcttaataaacgggcgtgtccagctcagcaccagccgttccaaaaatgtttcgaaatcccaagccgcgagagaattgtcgtctcgaatcccaaccacgactagggggccatctctgtaaataaaaaaaatcaattaacgagacgaccagtgatactccctctatctcattttaaatacagttatagatctctatgtccaacatttaatcgttcgttttacttaaaatccttttatataaaacataaataaaaaaaatgataaaacataaatagtactccctccgtttcaaaat

SEQ ID NO: 32791 - DNA, 17939 bp, Oryza sativa
taaaaagttactagttgactcttttcaaccatttttctgtataatttatatgatttgaatggcatcgattcattcatctgttgttcttattacgcatgtcacctagtaatgaatgtgatctcagtttcttgaattcaatgtttattttttcggcttgtttagagcagatagatttatttgttcttggattaaaaaatggaaaagaaaagagcaagcaattcagtattcgtatcacgtatatgggtttatatgtatgttgagacttaggaatctctgaacctgaagtgcaaatgagcaatatatgtttgatcaagattttctcttccgccgtagaccatttaatcaattgttgtcccaataaagttggcagataatagggtggtgacacttttcatcactcgtcacctcgtgatgcgtctatctaggtgtaagcactgatcaatgcatgtgttgtggatccccggccttcaataatatagaactggccggtcctgtttatcacttctttggtggatagacatcgacaagaacatttttttggttgcaagcttgtgacatcttgcttgaagcacagagttttgatcgatgtggggcagaatttgtgttgcccattcttcttgtctggagggagttatcctgttgcctgacctacatatcagcaacaggcctgtagttgctgtgtcttttgcagttggacgtgtgatatgtgatagataaccaagtgccagccaattttattgtgcaaataagtttttgacgattttgtagttgcaagatttgaccaactttgactcctccagtttttggagtatgcaaatacaaaccttatattttcttatctatattgacttgagaagactgggttatagaagcacatgatttgtttgttacggatgctgtgttatttttacactccttatgtaaaatgtatttttttttcagaaaatagtcgtacagtacactggcaatttactttactataaatctattattggtcagtttgaaagacgtttcttatatattattcaatttctaatatagtgatattctcgaagtagtatgttctttctatttctaaaagaagaaacatcactatcgttcgctagtacatgttattatgggctttccgacagtgaaactgataagatcatggatgatatgatacttttgcctcctccatagctgtcaatggtctggtccctgcgtttctgcatctgatttgtctaattttgcatattggacatcttcattagtaagttatatgttggccttctttgatagaatttagcattctattttacaaagtgtgcaagacctactcttctgttgtcttagaccattggataattttgttttcccctttgtatgagcaagtcgcttaatgggagctgaatataagaacattgttttattagcagtttacatttctggctttcaagtttcaagatcatttactactgactattgccctttctgtactctctttgttttttaatatatgacaccgtttattttttttagatacgtttgttcattcgtcttatttaaataatttatttaattatcatttattttaatgtgacttgatttatcatcaaatgttatttaagtatgactcaaatatttttatatttgcacaacacttttgaataacacgaatagtcaaatgtttgtcaaaaaaatcaacgacgtcatatattaaaaaaggaggtagtactagattacattttccatgaatgttgagatgaatcaatgattaacttgaaattttgggtcactgaagtctgctttaagtttgtactacagataatgttcctgctgtttctttcttattctcaagtgtattactagtgtatgtgcatttttctcattttctcacttgttcttggaaatgcagtcaggtcttcacccttgagggaattgttttcattatcttatcaaaatggagaaaatgcaaaagacgcaatcaaggaaatccagctcatggtggtgggatagccatattagtccaaaaagttctaagtggctctccgataacttagaaggtaaggaatgagaccataatctttttcttgtcttacatgctggaataagaacatacttcgtttgctagccatgagatttgtaagatcttggtcatgatggtttcaatattagtctccaatttaactagtatgctagttatttattccctgaacataattattcttttaaatgaacagtgatggagacacagataaaagaaacgctggagcttattgaggaaggagaaccctctgcagaaaaggctggggttcttattactcacgtacagaactttcagcagatgtatcgtgttcttgccaagcgatatggcaatgtgactggagaattgcgcaaaaatatcccatcatctctgcaatcatctgtctcctttggcatctcagaatcagattctgaggcacagtctccttcatcaccagagcgtgacttgcaagagaagatgtcacaaaagcaaaaaccgcgatcagattgctttgatgtttctattggctctggtatgagttctgacgtatccaagaaggggagtgatgggtcttcatcatcttcagaatctgatttagagcttgatgaggctaaagaagaaaatggcaatagcattttttatgccctaagtcaaaaaattattgagcttgaggatgagcttcatgaagtaaggggtaaacttgatgcttccgaggaaaagaacatgcgttgccattgtaattttggtgctaactcagaactgtctgaacatgaggaaaagcaacaggtttcagatgtggaaaccagtagccttcagaaggatcttgatgaagtcaaaagtgaaaaggaagcattggaagctgttgtattggtgaacaaagatgaaattgataggctgaaggaatcaatggtatcggcagccaagcagtttgaagttgaacttgcgcatcgtgatactgaaattgataagtgcaaacaggagcttgaggtactttcggagaagtatctgcatgatatatctgctcttgaggctgaaattggaaagctccagggagtcatcaaaacctttgaagacgactttgcaaaaatatcacaggagaaattgatgctcgaatctcgggttgaagagcttgagcagtcagttaacagctcaaattattcggtttctgagatggttaatctgcaagaactaatgaaggatacacaagcagaattagaaaaggtttcacaggagaaagaagtgctcagagaacgtgttcttgaatttgagcaacttttgggggactttgagaattcaggcatggaggttgcaaagctaccagaaaccatcaagaacttgggagcccagatagagggaacactacaggagaaatcagtactccaggacaggattaaggagctggagcaggctgtccatgattcattgcagaaccattcactggagaagtcctctctgagtgctgagctttcaaaattatctgaagccaatgcttctcttgaagccaagttggcatccgtggaggcagagctcaaacaagtttacgacgaaaaggctaatgaatccctcaacagcgagaaggaaatctccaggctgaatcaagaactggccaatgtcaaaaccgatctggaattgctgttatccgagaaatccctggtggacaacaaagtaaccactctactaaccgacatcacaactcgcgatgaaaagatgaagcagatggatgatcaactgaatcagcttcagcttgagcattccaagctaatggcacaggccgatcttgcccgcaagtccctgtcagaactgcatgctcgggtatgcgagctcgagaaagaggtagagatgcagaagcttgtgatctctgagagcgccgaggggaagcgcgaggcgatcaggcaactgtgcttctcactcgagcactaccgcagcggctaccaggagctgcggcagctgctgcatgaccagaagagaccactggtgatggcaacatgaaccaaagctagtgatcctgatgccatccttctcggatgctttgtggatgttttctgtcaatggcaatgcatgctttcctgtgtctctctctctctctcttctaccagtagcttgctgctgctctataacttgtgcactgttgcttctccggctactaagaattctgtgttgtgtcttgcaatgtgatgggataatcaatatcgtttcttgtgtactcttataactgtcgtcaggtaatgggcatagtgatgtctatcaatctatgcttgatctttgaaagatgatatgcatatcagctgtcaactttgtcaaatgtgtggattatccttgtgctttccaatccaatcaatgatgagtttgacagcaggaactttgttctctgatttgcttcttttaacctgtaatttgcttctggtacgttgttcatttgggaatgtttctcttgtatagttgagcaaaatcaactgaaaaggtaggacgtgcccaatggacaattatgtcatcatgggctctaagatatgtgtgtgtatgttgttttttgggatgtgttgtctgtttctttccctgccctcgattttaatctttcacgcactaaattgttgttttagaagataatagtagcatataatccgatgcgaggttaaaaacgatgggaattttcaatttgcacaatcagtaagacaattacaaaaaatgagattttctaacttgcataatcgtttaggccaataccctttcttttttttttcgaaacacagaattcatgtcatgtgggagagctgcagtaccgccgacctcgtcgtaggaacacgacctcgagagcgatcgtggagtaggttgtcttgttatcatcttagagataagccaggtatttaaaattttaataaatcaggattgagttagatcgagtttgttggggaataggaattgagagtggcgacaatataagaagtggtaatcgtactgtcaaagggaattggaatgaagaccttttctctattttgcacgattctttcttgagaaaaccttgtagtgtcgtgcaggaaggtaatgtacgtcgtccgtgttgatttgctcggcgttggtgttggcctttgcggggatgtgatgctgcagagtcaaaggctgaggcccatcgttgtggagtcagagctgctatatcgttttagcaggttgaataacgagataacacacgtttagtaaagatgacatgcattcaccgcgaagtcgaagatgttatgtcattaatgcacaagctcgacaacgacgacatgtgtttgggtcctgttgatggtctgaagttagtggcctcgtggctggtgttgggttgtagttgtgtgtgctatgactttgtctagccagccgtggtggcgtttgttgtctagtatagatggccaaacgggcggcatggcccaggcccggccgtgcctggctcgaggttagtcgggtcgacacggcccgacctacaatacgggccgtgcgtgctagcccacgggccgcacacacggcctaggcacggcccaacatgacttgggctatgccgggccggcccgaaggcacgagggcccatcgtgttattccacagaataagtctatttttcatccctcaactctgtgggctgggtccatatgactgaaaataagtctattttatattcctcttctctttaggccctgtctgatatggttcattaagtctattttgcgtccctctactttttttattcggtcgtgccgtgccgggccggcccaccgtgccgagggtgcaacccaggcacagcccggctgtcgggccaggccggcacgggcacgaccctgagtcgggccgtgccgtgcttgggccgggccaaaatggcatgccttgagccgggcctcgggccatatgaccatctatattgtctagggtttttactcctacttattgaaatataaatttttttgaaaggaaatttctttttttttttggaaaaaaagataacaaaaggttatcagtttgatcactgcaaagtgctaatccaattgttgtaggcaacaatcttagcagcagccagactttggataaacaaaatggcatggtcacaactcacaacgtttggattacagaaacatttatgctattttatagactaacatcattctcataacataaactaaccaatacaattaaataattttgattttgagactttatgctgtgtattgtgtagtagtagtacacaatacgcagcatataaatttgattttgggattttaaatgtcaataaggataaattatcagaaggatggcattggaccttttcactaacaatctgcaccagtctgagggcattctttcactctaataactcatatttgttcttagcagtgcacaggggtgtagtcaaaattttctcaagcctagggctcaattagagtaatttacataattttgcctttatcttatacattttgggggttttaaaatgtaatttgtaatggatatctggcttaggagtaggattgcagccctagttgccctactcctatttccaccactagcggtgcataactcaatcttgtagtaagaaaacatcttttttctttgccatcaagggatgcatttaaatttagggttaattagatccatgtcattataattttcatacttttgaaatatgctactactattaatctatttgaagtcatacagagctcaacgccattgtcattgacgaactcgtgtcaccccggacacgatctccgcgccaacggttttggcgctgagacgttatagctcattgcaatttgggttggcactaaggttgcgattcattttgtaataagtttttttgcacggtttattgttcaaataagtttttcaaaatagtcaaattgtcaaatttttggcagtttcttcctggccctcaattctaatcttgggcaaactagattattgttttagaagataatagtagcatccaatccaatgtgaggttgaccgtgcgattttcaacctgcataatcagtaagattatgacaacaatgcgattttctaacttacatagtcatttacgataataaattgccatcaatgatgtttaggactgtattttatcatacttttaaaagtttgaccatcaatgatttcttagtttagaaaaaaaaagatataagtagatttccttgaaaaatattgtcataataccattaatttagtatattttaaagtcattctgatattaaattaatggccaaactaaagttccaagagtttctccaaatctttttatttgactagaggaagtcctatgtacaccctacatgaagcaagaaggttgatatcgtgcaggtagagaacttctgaacatatgccttgacttgctttccaccctggaaaaatgatcgcttttttcatactctctgccatctatcaaacttactgttgttggcaagtacttgagatctgcccatgtgtcacatgaaacttgtttgcatgctagaattaaaatcagattcagcaaatgcatgactatgttattatttaggaagtgcacaattaggtgcccgtgtcctcatatattaagaataaattacacaaaaccatgggtatagtgattcaagttgtacaaaatcataggagttttgtcacgtagcatatagccccggttactatgatgctttcactaaaccacacaatttgaccaatttaacgaaaatccgacttgtgcggtctacacaagtttctcttatccactgtagttatgtcaacatttaagagttttatgcatgttcagatttaaataaaatttgttaatattgttgttttgtgaaatactaatgccataatacttggggttatatgcaaatatcaaattccctatagttttatgcaagttggatcataataccggagatttatgcaatttactcatatattaattgattaaagtataagagtaacttctacagctgcattcgagggatgaaattctaggttagttttaggggcacacaatatgaaacaggcatcaacgtataattaatcaagtacaagcaattattacaaacttaaaaaaaatatttattttttaaggaaattctatattttcttttttgtaaaaatgcatagtttgtagtttgataattgttctaacggaaaacgaagacaaggaagttgtaatttgaagttagaggatagaacgaagcctaagtagttgcagtccaacttaattatgcgaggacacaaaagaagaaactaacagttgacatctgtggaccattgtcagtatgattgggctagttagttagacactactgcctcaatacctcatgcacaaccattgtttgaccaagaacaaaagaatcggcatatcattttggacctaagctgaagtattatattatttccgctattatggattaatcatattcatgaaatctaatatagaggtctggtttttaccaatccattatctaaaaaacattcatgaaatctaacggaatatgtttcataacgcgttaaaggccacttgttattttcaccaacgaatgaaaaattgtaatttgaactcaattattgaacagatccaaatatatagtcccaaaaactgaagcttttggtatgaaaaaacaatcggaaaaggtaactagcatcaacaagtttttgcttgcagcacatggaaaggtgtcctttttcctagctggacagggtatcaatgcaaaattgctcacatgtcaaagggccaaaaagctagggcttatgagaagacaaccattcacactataccaaaccccaattcttttcctcttgataggccaaaccacttttcttgcataataaaaaggaccaccaaacagcacatttagcaaagcaaaggaatagaattagcaaaataattgatcctttgcatctataaagctttgccatcacattgtggttacaatgctaataatgatggttgtactttgattaactccccaagtataaaaatgaactgcagttacctcaccaaaacattgtttatgaggcacatgatctgctccggtactatcaccaaacaagcctaaaacaaagagtggcattggatctatgcccagaaccccataacttcactagagaagcctctcatttgataagacagtgattatgaaaaactaaactacctcaccatccgatgatatagattatgccgatctaacggtcagaagtgttcttcatgtatggatagccatgtctttttttttaatctagctttaaatgttctaaaatttaggcagggtcaactgatccacatggtcttttgatttcttctagttggctgttcccctgtcttcctcccatggaaatgaccccaagaagaaaaactaaaatgaagtgaactaaccaatgggggctacctaccaacatatttgttgtcttgtgctcctctataattagacccagctttcaagcaaactactctggtcaaagtcccataatagtccagagttgcatcagatgatcatagtttggggctaagcacaattctaaacaatatttgcatgttcatcccaaagaaaagagaattcacaattgatttggccagtgtttatgatagttcactggttttgaattggactattttatttacagggaatactaacaccctgatctgagttcctgcttgttctggtggagattggaacactgcatttttcttttcaaggaagaggctgcacaaactgacatcagggaatccaggctggtttataaactgacactatacatttctttgcatgtgttcatagcccactaaggctctatttttaatttaggccaagataatgacctcacataattttaaggatcctaaaacatgaatagaatatggtttagtattgataataggaccatcccatcgttggcatgtttataaaactgttgctgcctttgatttaaccttttacaacattttatttttccccaggaattttataatattatattgatatatagtaataaaattattatactataatgatttttagtgacagatctagcaacatttaatgtcaacgctaaagccaataaaaagttattagtagaatgagttcaaatactatcaatgaaaaaatgttaaaagaagcaatgctagatctatgtggttgttttgtcaataagggtatgaaataagtccagaatgattctattatagcaaatagacaagacatatttctagtcaaagtaaagtgtaagtaacacataaccataaacgacaaaaatgacacaaactttattaatcatgataaaaccgataaacgagtgaaacagaaaactgttcaagatatattttcgtctcaacggttaactttgatttcgtctcaacggttaactttgaccctcctgttacatattaaaggcaaacaccgcaacacgaaaacaaatcatcaccctataaaaaagtctccaaaatcctataaaattatatattgatatagtaataaaactattatactaatttatttacatatctatcaacaataaatatcaatgccaaaaccataaattcaaataattcaattaaaaattgtcagaagaagtaacgcctagctcaaccaaatatatctcatcacaaatttaccgataagagtatggaataaatctaatataaatatataatgatttaatgtagctatacgttcaaatccataagatgcattatgtcgctagaagctaaaaagaagtcaaagtaccatattgttgtttgtgagtggcacatactttatttaataaaatagacaaatgagtggaatagaaagccatcgagatatatattaccgtttcaacatttaaatgtacccttctgctatatattaaaggacaaacaccgcaacatgaaagcaataaaatgttttcgattggataaattcaaattctataaataaaaaaaatgttaaaagaagtacgcttaactcaaatccacggatctacatcatggttttatcaacgagagtatgaaacaagtcataattaaatgtagcaaatcgacaagatgtatttttggtcaaagtaaagtctaagttacaaatcaccataaatggtatgcactttattaattaatcatgataaaacatcaaataagtgaaacagaaaaccgttcaagaaatatattcatcccgttgattaactttgactctcctgctacatattgaaggcaaacaccacagtaaaaaacaaaccatcaccccaaacattaaagaaaaaacttccaaaattttggagataaaagtctcaaaaggaggggactatttttggtgagaagaagaaataaggttgagcaggtccaccagcccaacccttgaaatgaacctcacaaaaccataagaaaatggcagacatttactctcagagtcaatagctcccacatgtgaaagcccctctatctctcgcacccttctttgttagaagaagcaagcctcaagttatgtcgctagaagctaaaaaggagtcaaagtaacacatcattgtaagcggcaagtactttattaattatgacaaaaccgacaaatgagtatacataaagccgtcgagatgtatattaccgtttcagcggttaactttgacccttctgttacatattaaagaagaaacatcacaacatgaaaacaaaccatcatctgaacataaaaaaaaccctccaaaatttatcttagagagaaaatactcaatggaaggaaaattttttaacgagaagaagaaaagaagctcatcaaatcataagaaaatagcatgaacctcaggccttgtttagttcgcgaaaagaaatattttgggtattacatcgaacgtttgaccagatgttggaaggggttttcggacacgaatgaaaaatctaatctcataactcgcctggaaaccgtgagatgaatttattaagcctaattaatccgtcattagcatatgttggttactgtagcacttatgtctaatcatggactaattaggctcaaaagattcatctcgcgatttccatacaaactgtacaattagttattcattttatctatatttaatactctatgcatgtgtccaaagattcgatgtgatgtttttaggaaaaaaactttaagaactaaagcaggcctcacaaaaccataagaaaatagcatgcatttactctgagtcaatcaatagctcccaaatctgaaagcctctctctatctttctatccatctctccattcattcatctctctccatttccaatccatctcatcaccgacgacgcgagaagagggacgaccttcccccgtataaaaactccacctttgtctcctcccctccccccttccctcccatcccccgattcgccaccgcgaatcccaccaccacccgcagatctccgcctcggcgccattgcccaccctccacgcccccgccagattcgcccagatccacagccgggtaaggcctcgctcgatttcttgggtttcttgggcttcttgcctctccgatgatcgaaatgggatctcttcccgcgtgcaggtgcatccggcggcgtggctggggcgccctcgatcgggaagctttgatcttcgtaccctttttgcggtgggcgggcggcggccggcggaggaggagaagatgggtgtcggcggggagaagttccagctggggacggtgggggcgctgagcctctccgtggtgtcatccgtctccattgtcatctgcaacaaggcgctcatgagctccctcggcttcaactttggtgggtgttgggagatctgggctcttttttttcctttgcttccccccaagcttcttgattggtcgcttgtgattcgcgtagatctgtgatgctctgcgaatttcgtaggggttgttttcagcgaggattgcttattgatttatgtgcttagatcaattgttagatttttttttgtagtgtttgatttttgtgaatttggccgtggtatttaatttagagatggggagagcatcattgtagagatagtggtaggataaaatgtttctcgaactcatgcagttctggtgaagcttttgaacaaaaaaaatttgctaagaggagtagtgaatatgaaactttgatggttttgatggtgtggattagattcacttgtttatactagtgcagtgaacaagctttagtagcacatctaccaggttgcttgacgcaggggagtaatatccttgtttgatctggtgctgcaatttgaattatgaactcatgcactgtatgtggaacttattgtcaagcttgacttgtgccttttttgtgcggaacataggttgacttgtgttgattgtagcctcctttttcacctaccattttctgttacttcttttctcaaatgcattgcaatgtattagtgtttgtagaatttacatgaatataaatgacaccaactgtttttccatacatggaattgtattttgcagccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccaggtacaaggtttgcgatcttctttacgttgattcttgtaccggccagaatttcctagttaattcactgcagtcctgtgcttattgggtgtctggtacagtagtaaactagtagtgatacttatttttgacccttggtacaatgatagctagaggtacaggtaaagtaaatatcttcttgttgatgtgttgcagttttatctattgctgtttgtacaataaacttattacagaaggcttttattacagcacaacattttattgcaagcatttatttcaattgatgtgccctttcttccacactaatcaatccacctaacttatgccgaaatgtcctttatgtctagatgacaaagctggctatcatcccatgcactgttattttggagactcttttcttcaggaagaagttcaggtttgtgttttatacctttgtgcgcccgtgtgatgatgtcttgagctaacccttgtctggattgacactgtagccggagtatccaactgtccctttcagtgctcctctttggtgtcggtgttgcaacagtgactgatctgcaactcaatgctgtgggatccgtattgtccttgctggcaattattacaacctgcatcgcgcaaattgtatccttcaacttcagcccttattttcctcttcccaaaaaatgaaattttatgcataatcaccctgtagtgagaaagtagaattttcatacacggtcaggcttttattatcatctttggtcagtcacacttgattctggtttgagtattcaagtaggcaatacatcttgtttacatttgcaatgttagataactcgatatttgccaacagtatctcttgcgatgtcgctccctttctaaataaacagaagctactagtgtaactatttttttgttttccttttgatcactattatggatcacaattttgtagtactctattttgttgttggtttctgtcatccttaaccagctattagatgacaaacactatccagaagaagttcaaggtttcttcaacccaattattataccaatcttgcccctatcaatcactgaccctcttccttattggtccattccttgatggatttttgactaaccaaaatgtatttgcattcgactacacatcccaagttgtggtaagcagtgaaacaactttcgaagacttactttgaccttggtttatctgattctgattttgcccttgtttcttatgcagtttttcattgtattatcgtgcttgatatctgtctcagtgaacttcagcactttccttgtgatcggaaagacttctcctgtcacttaccaagtcctgggccatcttaaaacatgcctagtactgacctttggttatgttttgcttcatgacccatttagctggagaaacatactcggcatcctaattgcagtagttggaatggtcttatactcatacttctgcacattggagggccagcaaaaaaacgccgaagtctccccacaacaggtagcttccagtctgaattttatgcttgcaaaatggttcaccattagttctggaatcgtttcattgtttcccacatatcttatcagctcttcaaaacgccatatattacagtcgaaagaaggcgatcgggctcctatgatctcagactctgtgagcaaagttagtaatgcaggtggagtggttaataatgagcctctcaaggtaccgatgtggagctcaaagtactcaagggcgtgaaaataccttccttttagaaggcggcattatacaggattcaatttggtaggcggatagtagggttggaagccaacccagattgtaatgaacattccagttacatttttgggtttatttaacattactatctagtatctactagcagtaaaagggttcttgggaggattttaccttcaagatagcagatctgccttgaaacttagacaacagatattgtatgattgtatctggatatgctccacatctttctcactgtaacttcctatgggaacatagatccacagatagacttcattcttttgtaccaaagatccagagaactagagatctgcaaggttcaagtttgtgactgtaagtttatgtttactttggacccagtgatggagcttttgtatatttaggaccaagtgcaaagaggggttcttttccaacaagttttcaatgcaataacatggaacaattgttctcttcaatcatgtaatttcccatgttcaaaacaatatttttggctgagtgaatcgaatgccgcatgaaccgattatcctttatgtctcgcgggttttcatgactggtgtacagacgatggctcaacatttcatatctatcagaggatgtaaccatcagagtaaaatgaagtcctaaaataagtttcttatatttatacacgaatctgaatagaggtaagtatgtaaaaatggttaattggatctataccactacaattttcatggttttgaaatacaccattactatttaactatttaaaatcagggaaatttaactatttgccactcttgtgacatggcaattaacgatttgccacaccctatctataacatgtgggtcctcatgtgtctatgacatgtgggcctagtggcaaatcgttaagcacttaaaatcatgtcactgttgtttcatagttatatgccacttcttgacccttctgtacacttaatagattttttggatcaaattgcccatcttcttattcaccccctctcccatcttttcaccgaagatgttcatccccaccgtcagcgtcgaggacgacgtcggttgtacccgacacctgtgctgcgcgaacatctctagcgacgagcccgagccggcatggctagggcgctagccgcgaggctaccaatgccagggaagacctcgacgaggcggctgcagttctaattcaatattccctccatcccataatataaggcatggtcaaacttggcacaatcttcaaaactaatctttgaattataatttctcatatactataaagtttattgcaacaaaattataaccatcttaaagtaaatttaaatgtcaattcaattatattaattttagcaaataaaatttaacttatattattattattgttggttaaatgtttttaaagttgaattttggaatgtgtgtatgccttatactatagcacagagagagtaatacacttctcctgctcactttagcttgcagttcggacaaacgcatatataaacttttgggactacattttctttttaatgatgcagctgcgcgcttaccagatctatcaaaatagtggaaagagcgacgagagtaagcagagagaagaaaaagaaaaaaaaactatcgatagatgcaaccaccgtaaaagtagagaaagaacgagagcaagttgattgtgtttatgcactgatgatggatttctctggactgatcaagatggcccaaacaaaatgagaggctttattggtaagttcatttggactcttttaactagtgatcgaatcttattcatatccctaaaccataataccggatatctcgacccataaactattaaaatcggtgcaacttgacttcttcgatggttttagagggcggttccgttgacacagcggtgttgatttagtcttcgcttcacgtgacgttggcgtggtattagaattaaaaaaatatatgtgagactcatttgtcattcacacaaaaaaatattatagggcccacatatcattctctctccttcccttcttcctcctccctctctctcccttctctctctttctctccccctttctcttcaccttagcctgcacgtggggaatggaggccggattggtggcggcgggcgacaacccacgcacgccgaggtcgaatcttgccagtgcgtgcgcatggtatcccatttggacaagatgatacctctcgtccgaacggacctaccaggtatcaggcgatatctctgaggtatcgtctcgttcgaatgggataccatcttgtaacatttccctatttcatatgtatatagaaaaaaaaaggaggcccattcatctaaagaaatcccactcaaaaggcctcctccctcattatttcaggcccaacgacccaatagccttaaaaaagggcccaaaatcgaatttaccttaacttctcccctccccattcccaattctgtttcctctcgacaggaggacgcgccgccgccgatccgattagttcttagtagttcagtactctattcgtttcacaacgtaagtaattctagcatttttcatattcatattgatggtaatgaatctagacatatatatctatctagatttattaacatcaatatgcatgtgaaaaatgctagaat

SEQ ID NO: 32792 - DNA, 2815 bp, Oryza sativa
atgaatagtaatttactcgtgacttatgtttttaattttttttcaaaaaaattcaaataagacgaacagtcaaagttgagcgcggaaaaccatggctgcacttattttgggacggagggagtacttccatatgtaggcacgttcaatttatgtcattctaatcgttgctgtaagcctgtaaaccattattaattgcaagtgtttctgcttacttgcgaaaatgacaggttgcaacgctctgcctgtctgcctgcatcttgctaggtgagcgtgtcctttcaaatgctatatcgttgggtagcttgaacaatacttcacacacaattcagtgtccatatgtattgttgatggatctattctctggtgaaatgcattgttaggcaacttgagcattttcgtcattaggaacttctgaacactcctcttattatggcagttggaacttaagttcagatggtgctttattcagtactcagttgtcttcctgagttaatgacataacaaaatccctgaatttttatttcacctttttttttttctggaagcaagtctcattctttgctgttgtggttttctgcattattctgtcccctttggcgttggcctgtttttgtcagtcacaacagtcatgacatacaaaatgcaccagcaaaagggtgatgtcgatatgggttgctttaagtagtttagcgtttacctccccatccactgatccacattgttttctactgttctacagctctactttacctacacaggcttttttttaaagggaggatataaggtttggcctggtttagttcccaactttttcttcagactttcaacttttccatcacatcaaaacttttctacacacataaacttccaacttttccgtcacatcgttttaattttaatcaaacttccagttttagcgtgaactaaacacaccctttgtctcgtatgtacaaaggagtccttaggtaataagtttctcccaaaattccgaactcctagagtctaaatatatactcctactttcacccatgctctcgtttcctccttgatcttagctaggattgatgccaccgttaattgctgctttgtaacagaaaattcttacattacgtccgtaccatacttcccaaataccaggatcactagagttctgagtggttggtgagtgttactgaggagcacaagattccaccagtgttcgacaaacttgttcttctgtgcagcttcaggatacttagaccgtgtttagttcaaaaaattttcttcaaacttccaacttttccatcacatcaaaaatttcctacacacataaatttttaacttttccatcgcatcgtcctaatttcaaccaaactttcaattttgacgtgaactaaacacacccttacagagatgaacctgtacactgcttgttcctttgagtggtctatcatctattgaaggcttgaagcagtattcttgtatggcaaactagcatgtgttttgtttcttgctccagatgcaacaccattttaccccccttttttttctgtgagaattgcgatctgggctacttcaaaactggaaggtactagtatgcacatcacatgcaggtagtgttttcctgaagaaacgtgtccctttccgtgctgatgcaacgcaaactcttttcttccatcagaattctttttaattttttgccttcttggtgttgggctgttcgtctgttcatgtcgcggattctcccaccccaccgaccctcttctccaccaaacacgattgcttgcaatttgcaaatctaacgtgcgggcggcaggtcgatcgatgcaaagcggcagccgcaaaccggtgagacctcggagatgacggggtccatttcgcttatacaaatgtttaccaactaaaaataatttatgaatataacttttatatacaccttgtctattttcgcgacaacggcaccctaggcgtggcgacggcgcggcagccgagcagaagtgcggcagcgcgagggtccgagcagcagcgtggcggccgcgtgacgtggtggccggccaagggcagtggagcggcctcttcgatggaggcgcggccgactgctcggcggcagggcgctgcgacggtgacgctgacggtgtggtggcagaggccgtcgcagtagcgtcgttgcaggcgcggagctcgtcgtggcggtggcggctgtgattgcggtgggagggggcacggtggtgacgaccgttgctgaggtgggaggaggcatgacggcctcgaacggctatccgagggtgtggcagacggctgcatctggccgcgcagcagcgtttggaggaggggtcagagaccggcttggcgcagagaggcgcagccgatggcagcggaggccggctcggcgcgaaaggcgtaggcggcgaatatgaaggccggcttggcacgagaggcgcggccgatggagggaggccggattagcgcgagaggcgcgtccaatggagaaggctggcttggcacgagaggcgcgaccggcggtggagaaggcgacctcggtgcgaggaggagctgtcggcggatgtggtgcggtcttcggcgcacgaaggctggccgcgccggggaggggggaggggggcactgttgcagtggtcccacatgtcggcagaggttgagtgatggtggagcatcggtgcatcaaccgtggattcgcgggtggtgagtagcgggtgaaaacccagtccggccttggccggaccgacatcgatggttaattatccctcctgagggagttgtcgtgctgtctcagcactcaagggtggttgccgggcaaaagccctatcttagctccttt

SEQ ID NO: 32793 - DNA, 6426 bp, Oryza sativa
tcgcttatcttcttgaagacgtcgtttttggtatcctctagccaaagcctctcgactttgggcgatctcgtttgtgctcctttgttagtctagcggcagtcggtcacgcttagcagcggccggtccggtgttagccttctcccggagttgtgtattggcactgtcagtgtgggggtggtggtatattttttttccttttcctggttacgaccctccagggttgtaatcttgtaatttttttcttgctctatcaatagaatctaacaccgtctcgtgcaggtcgttcaaaaaaaattatttatgattcaaaattaaatgttgtaaaataaacttcaataaaatctcacaaagttaactgtataaatttaaaagtttagcttataaaagcataaaacaaatgataggactggacgagtgatcgcgcagctttttctttgaaagggagtgggctaagtaaggctgtgttcgttggttgtggtcttggggatgaaactaatccctccgatacataaaacgaagcgatttattagcgcataattaattaagtattagtttaatttattttaaaaaatagattaatatgatttttttaaaagtaacttccgatttgaaaaacgtacgatttccggaggatatgagttggggaataacacaaccccgatcgctcgttggcatcacggcggcaggttggagatcgccgttgtgtagctggaccacggaggagatgccagatgcgtttcttgaactccatgattgatcattgaaccccacgaccccccctgggcccacatgtcatctgcccactggcaccatggccccacataccatttgtccattgttgccattttgtcatggtcacctgtctcctctctctctccgagtcttcgtgcagcagtaatggcatggcagatctgggccgttgatcgagatgtcaacagccctgcggtggggccggcatgagacaaaaacaattcaaccgacggtgtggatccgaggggagaaggagaagaaaaataatgggaatcaggcgaagctgctgcctgcttgtacctgtagtgtactgttcgtccggtagtgggggggtggcccacatgtcattggcactggttaggctccctaccaacctaccgaacccaccacaccaggtcaaacgatgaccaaaatattagtagtactacacgtgtactagaagcaggacgaaatgggccaataggagagccggatctccgaacgtggaccagcgccaaaataccacccccacaccacacgcgaaccgacgaaatgcaacatgacctaaccccctaaggtgttgtttggttggagggactaaagtggggctaaactttagtccctcctacataaacataagtccctgtagttcacaaacacctcctaaatacggtttagtactcactccgtcccaaaatactgtttggattggatgtatcgtattactacaaatctagacatatcagattcatagtactaggttcgtcacatccaactaaaacttgctatattttaagacggaggaagtaaatcaccactggaacaatagatttctcattgaaaacaagcaccgactacaaacgggaaatctagtttttcctttcaagtcacccctggaaaatttttgataagtttgctaccatcgaatttcatgtaatctctaactcctactgtttgaatatattttttaattaatgacagctgaatcgagggatgacaaaacgttggaatttcgtaaaaatcgaccggttttcataaaaccactatgtcaacgatttatgaaaaccgatctgtattagcctgtttttgtaccatgttgattgaaagtcatcggtttttatcgattttgtgttggatttcggtgaaccggcgagaagcgatttttactttgaaatcgaaagttagaccctggttgaatctcaagattgatttggacataattaccacatcaaatgtttttccagatacactccatctgtcccataaaaaaccaatctagtactggatgtgacacatcctaatactatgaattaagacatatgtatgtgtcacgtccggtcttagattcgttttttatggaacggagggagtataccgtaataaaacagttttttttgtgagctgtgagggggcggccatgtcagggtgcatcagcagattcagcagacggctggcggtgacacgagcaatttaaaccgttgctttgccgattagttgttgtatagtagctctattgctgattttttttttcaactaattgccttgaaaggcacttcattttttttcctacgtgtctcttttttctatttgaccgtgtatacgcactaaatttaactattttatttttcttataaacacattacaatcgtaaacgctcacaatacgcgcgtactcatccatataaatgcacacaccctacctctttgagcatcttccgaagattgagtcggcatatcttaagattaatgaagtcaccacatatacatcgtctatcactaaaagaataattaggcataaatacaattcggatgggttggtttcaccacaggaacctaacgagttaagctatacttactttggtttctactgatactaagtatggacccacctatatttttatgtgaattcgctattggtcttggcataacgtggaccttaacctaaataaattactttaatttaatttaatcgtgcccaagggtggaacagaaaaaagaaaaactaaaaatctcagcgttcatcgaggatcttatatttatccccgtctccgcgctcgtctcggctccttctttgcccacttcctgccgccgattttgcatctcgcgagcagagcagggcgcgcggctgcttccgccacatcctggtatggatccggatcctcttttctcatccatctctctttatctccacccactttcgtctcgaatttgtttgcgttaacccttagcttctcctcctagatctggaagcagccattttctttgaccaagtagtagcagtttgttcttttcccccaaaaaaatatgtttggatccgccccttgttacgcgttttacttcggtttgtgatacgaagattcgattttattttatttttatgtatatgtataagatgagattaggagagtataaatggtttgaggtttcaagaaccaaattgattgatttgagtgttgttggattgatcgtcgcagggggtggaatgcttgccaagatgcagtcgtgccgatggatcttggcttacttgctcgtcgttctcgtgagcctgcacggtggtgccaatggcttctacctcccgggcacattcatgcacacctacaccccaaatgaggtgatctcagccaaggtcaactcgctcacctccattgagactgagttgcccttcagctactacagcttgccctactgtaagcccccggaaggcgtcaagaagagcgccgagaacctcggcgagatcctcatgggtgatcagatcgacaattcgccataccggttccgagtcaacgtgaacgagtccgtgtacctatgcaccacggacccactcaccaaggagcaggccgagctgttgaagaagcgggcgcgagatctgtaccaggtcaacatgatccttgacaatctgccggtcatgcgattcaccgagcagaatggggtgactatccagtggaccggattcccggtcgggtacaacccgatggggagtaacgaggattacatcattaaccatctcaggttcaaggtcttggtccatcagtaccaggcgcagggtgatgttgtgatcaccagtgaggatggcgttgccatggtggagtcggatcgcaagagcggattccagattgttggcttcaaggttgtgccttgcagtgtgaggcgtgatcctgaggcgatgtccaagctgaagatgtatgacaaggttgattctgtcaagtgcccattggagcttgagaaatctcaggctatccgtgagaacgagaggattacattcacctatgacgttgagtatgttaagagcaacattaagtggccatcaaggtgggatgcatacttgaaaatggatggtgccaaggttcactggttctcgatcatgaactcgatgatggttgtcttcttcttggctggtatcgtgtttgtcatattcttgaggactgtccgtagggatctgacacggtatgaggagatggacaaggaggcgcaagctcagatgaatgaggagctctcaggatggaaacttgtggttggtgatgtcttcagagagccttgctgctcaaagctgctatgtgttatggtcgctgatggtatccagatcactggtatggcagtggttacaattgtctttgctgctctgggtttcctctcacctgcttcaaggggaatgctcttgaccggaatgatcatcctgtacctcttccttggaattatcgctggatatgtcggtgtccgtgtttggaggacaatcaaaggaacctcagaagggtggaaatctgttgcttggctgacctcctgcttcttccctggcattgttttcgttatcctgactgtgctgaactccatcctgtggggcaagaagagcactggagctttacctatctcactgtttttcacactcctggccctgtggttctgcatctcagttccactcacacttattggaggtttgctgggtacacgtgctgcaagcatagagtaccctgtccgtaccaaccaaattccacgagagatccctgagcgcaagttcccgtcatggctgcttgttttgggtgctggaacattgccctttggcaccctcttcattgagcttttcttcatcctgtctagcatttggttggggaggttctactacgtctttggcttcctgttcattgtccttttcctgctggtcatagtctgtggtgaggtttctttagtcctaacctacatgcatctttgtgtggaggactggaagtggtggtggaaaagccttctttgcttctggttctgtcgccttctacgtcttcctatactcaatcaactacctcgtgttcgaccttaggagcctaagtggaccggtctcagcaacgctctaccttggctattccctgatcatggcccttgccatcatgctgtctactggtgctattggcttcttgctgtccttctacttcgtccattacctcttctcatctgttaagattgactagaggcacccacactcttgctgcaataggatcacctgagcatggtgatagttatcccttagaaacatatcacacaataatattgaattgaaaagaaaaatgtaaacatggcaacgcccatggcttttggccctgattaattctatcatttagcatagcacagtttctttaagttcatgcttatgttttgtaggcatgtctgcaatgtttcagctatgttttttgactttgtaatactattaatgttttgttttctctgggcatttgtgagcagcctttgttggaacactttgacagatattcaatattaaagagctattcgattacagtccttatgtttcttcccctgatattatactgttgaatgcttggtaactgctacttgttatgctgcttccgcttgctctgaaacttgtaacgagataatgctgttgagcaattttcttgataaacatgtatgtgtctacatgagttgctgtcaaccttgccgctgtgaatactcgttttctgaattctgaaggttgtaataaggtcacagtttttcagttagttgccacatgttctgacgtactatgtgacatgattcactgtttctggtaagctgtaacagtagaacagcatacacagcttcaaacccctccaagccctgtattctgttccctgttcatggtctgcttacagtattctgatgttcgcattatttgcatcctgtgttgtctggtattggatcaaatagattaataaaacatcaaactgctatatctggccttaacgcacggctctcccttatgtgtatttacaaatttaatttgaatttatatgtttatatgcatgatatatcttatcaatttatcttgttaatcttttttcatgatatatcttatgtgtatttacaaatttaatcttttttttagttaatcttccttgtcatgttaggatttcttttatttttggttggtgtgcttgtttaattttggactgcgccttttagtgtgctacttcttataataattggctgtagctctcatgagcaaaggtcgggatgtttcactccattatcttaaaaaaaagacatgaaaaacgagggttgtaaacactttcccctttctatcgttcctttcccttcgtggcaaacgtccaactactgctttattagttgtaatgcagtcgtaagatgcagaaaagatgttaattaattaacaaggttggttagagtttattttggctaggtagtgggcactggatgg

SEQ ID NO: 32794 - DNA, 12302 bp, Oryza sativa
gtcgggatgtttcactccattatcttaaaaaaaagacatgaaaacgaggggtgtaaacactttccccttctatcggtccttttcctttggggcaaacgtccaactactgctttattagttgtaatgcagtcgtagatgcagaaaagatgtttattaattaacaagggtggttagagtttattttgtctaggtagtgggcactggatggtgatgttgtctttgtcctttagtaatcgcagttatcagaaggtagatcactgttcagttaatacagtcgtaaccaatgatactagagtgtgctaatacttagtacaaagatactagaatccttttctcatggatctagcatgtgcccataatttcttggatgcttgggcaatgttgcatttgtagtttctgttttttttttaataagatcaggacacacacaactaaattattaattaaattgtggaccattttattcagtctaattatccatggttcatactatgcatgtcaaactatcaggatgaccaaacttgattaacttgacatagtgattcttacaagcagaaagcaatgcgccatagcagtttaatacatacctcctccatcctagaaaaaccgagaagttgttggttttttcaaggatgaagatttccacaagaagcataaaaacacacacaaaaaaaatgcatcagacaaaatcatcacgcaatacatcaactgaagtgagttagtgacagtcggacaatagtttgctaaaaataccattctgccaagggaaaacctaatgtccatttctctttcctcttttcatgtcataatagctaaatcgtttgcaatgtatgtatttatacaagacaatccactggctcttgtttgaagttgaaagctcgcccatgaaatttgactgacaactcggtatctactgacagttttctgatcaatggacagactagtgtataattttccagctccttgtagaaagatcactcaacctttgcaaaccctccttccggtagactactgtcattaactgcttctcgcacaaatctacaaagcaaaatggtagcgtcaaataacacggatcagttccaattgaattaatccatccaacgccactattattctttaatgttgcgaccaaaatgggagagagcagtacatctccaggtaactaagctagcatgattatgatcaatacagctttaaaagatgatttatagaaattgggtcagtgttcaacctacaaaaccaaaagcatgcaggatgcaaaaaattaatgaattctcattatttttgttctacgtagccgtgaatagttcagtctcagcctatatacagaaaactaactgaaaggtgaaaaacaaaccttgtcaacttttcctgagatgattgcaggacgtagattgcaaggatgaaggatagaacaagccctgcatatataaaaagaagctattttaggacacaaatgtgaaagccattagaactagaaaactatcacactttgctatatcagcatagatggcatcagaacataaatgttccgttcatgatataagggaaatcgcaagagtagtatagcatggcaaacaaatgctatttgagttaaaacgaactcaccagatccaaacaacacatagaaacctccaggaacatctatctccgattgctcctccctgaatgaatcatttcaagtccttgaatcaatttcaccctagtttgttatggtaaagatctttttgaaaggtcatagtaaaattttaaattacaaagtaagtttttaccatgtatatctgaccagaacatattttggccaattctgttgatcccagaaattcttccttatgtcaggatgatgttcaacatctggataacaaaatgagcattggttagcaattagggaaatcgagaaacaaaacaacaaaatcagcctgtgaataaaaataatttactaggtgaaagaaaaaccactctaaaaatgatagctatccttgaaaaagtctagtctattggaaatttacaacatatgctatgtgcccttatacaaggcccgaatattgctgcggtattgagagagagagagagagagagagagagagagagagagagagagagagaagtcatgagcatttgctgataactcccaaaagggctgctctatgagctcaccattagttcactaccgaaaggtaaacaaagttgactacttgactacactaagataaatctttaaagattcccctgaactgaaaaacaatgctcataatgggtttatataaacgaactacgttcaggaaaacagacatgcaaagaacataacttattaatgaagcgctgctacacatgaaatgttttgttactatttggcaaacatatgtgtacatggtactgcttgcatgagaaataataacaatactaaatatgatagaattatataagtttagacatatgcaaaaagatatatcacgaggacaggtgataacaatacatacaaatgtgtacatggtactgcttgcatgagaaataataacaatactaaatatgatagaattatataagtttagacatatgcaaaaagatatatcacgaggacatgtgataacaatacatacaaatgtgaggcatgtccactactttagctgtgacaccaagtaaatcatttccagagtatttctgcgtaatcaaaggtagatcaaattaagcacagagacaagtcttgctggaaaggtatatagaaactattaagcaaggactcaccaaatggaaatcaatcattggaacttcagagcttttgcgatttatgacataaagccaaggaaggtggaacttttcgtgaccaatttgaaatgttctacagtgtcagaatcaggtaagattgcaaaacacatctccagaaacacactcatatacaggttgtaaatctcatatgttcataacatttccaaccttactaccatttactcttttagttctctacaacagtcaattgaactaaaagtcagttcgtcttaaccttacaatgagtattataacctagcacaaactatgcagaacaccataccttctgaattctctctctcaaaaatgaaaaataacaagaaaaagttttaacaatttatgatttcagtcacaagattctggtgtcacaaaatcatcaccgattatgatgataaccttcaaagtcatgccctacagcttactgaactcactgttctactcaaaattgtatagaacagaagtgtaaattttccgtctaaaacatgaacaacagcagaacatcttactcacatcttgtaaggatctgcaccggtgaacccagtcggcttggggatcggcatcataacctgcacaagagagaccaacccaaatcaccaaaaccactcccccacacacatgaaacgaatcagagatctcgacccctctctttccaagaacacacccccatctcacctcatggttgaccgcgaaggacgggcagtggcgtcccaccacatcgaaccacaccgacctcgactgcaaacaaacaaaaaaagaaaaaccccacctcgcagatcagatcgcgccgaagaacaacgcaaatcagcctcagaatccgaaggctaagcggctttgctcacttacgccgtggtactggccggagcggagcatggggacgatgtcgccgggccggtaggcggacgcgaggggggcgaggagggccgaaaagagtagaagaaggaggaaaagccggtggtggcccgcggcggggctccggcgggcggccatggcggcgaggtggtcgccggagttgggggtgaagggtgagattcggggtaaatgggttgggttcgatttggagcgtcagatttggcgatgcctattggacttttggcttcactaattttggcccattattcagcccagtaatggtgcatgtagtagggattttggcccaattaattactgggcctacaaacatatggaaattcggttctgtttgtgtttatattttttcttgttgaggttggaaatgaacctacgaaatttgtatggaataggcagcaggaagttacacaatttcatttagcatagtttttttttttacctctgtatgtatatttctgaaaaaaaaatgtgaggcatgtccactactttagctacatgtatcacactttcataatatttgaaattcattatatttttttttcaaataacagaatagacaatgctgagtgtagattagttggttaggtttcttacgatgaaacatttaaatcataaacttgtcgcagatgctcctatttacgaccaattgttctatcagtggtaggtgatgtacctatcaacaaacaggtcatatgtgatgattttgctaactttaagacatgctgctttaatcttcagaagtataattaaagtagctatagtttacatagggtgtaaatagaaaaccatgcaatacagcttcataaaaccgtcttatactgaactagtatgttccttttacttcatagaatattctatatttgactgcattgagattgtggatgcggttgaaaagtgttctggtgcactggtgctaaagatagatgagggcatacttgacgttgacatcccccagttccataattcactggtggatagaatgacataagaattagacctataatagtcccgcttttcatttagtttatgagaagatgaggttatcgaatttacaaaataaactaaaatttggaagttagaaaactcaacttttctatatctcagaagatggctaccaacaaaccgtttttcagaatcataagttctgccaaacaggctattaagctcggttcgaaaactcgtttatctttttaactctcttgatagctaggagcaaacttctaaacgatttattttgaacaagaagtttttacaaaagctttttaaaaataaaataaactcatttttatttatagtgattaatatttgattaatcacatgttaatgaatgcaactaaaagcctaccgccaaaatcactattgaactaagcataagccttagtaattattagtacactgcatgcgcttagtatgttatttattttcaatggttttgtagacatatagttataaaaaaagaagtccttttatatctactttaacccttatacgaatggcaaactttgtgacgatcgacagaacatctcaatttctttttaaaaagtaaaatgaactgtttatccaaacattaattttgtttatagctgatacacaactcttctctcccacaaaaaggggaaaaaaatgcacaactctacatgactacatcccagaatagattaggcagcattctgacgctattgcatggacaaaccattatccaaagaaaaaaaactaccgaaaaagtatagaaaatccacttcttaagctttttactagtggctagtatgattttacaaaggctgatgtaaaaagaaaagttaaaaaattgacgtaatttcaggtcgtatttgtggtgcaacaaccgttcaaccaacacagctagcaacaagagtagaaacaaaaattcccctcctattttttaccaatccccagccataaaaattaaaacgagaaaaaaaagaaataatccccacaaatattaattgtataaataaaatcgaaaagaaaggaaaaaataaaaaaatatccaaaaataaaaccccctccactcccatcccgtttctccccctttccccttctcatggagtcgtgtagcttccgcaccgccgcctcgccatcgccattcccctcgcttccctcctcctcccgacaagcgccgccatgctccagcctccgattccccgtaagaagttccctccttttacggcgggtttatggaaacttttgggttttttttttctgatgtttttgggattttttctttggttgttgcagagaccaagaaacgggaggatggtgggggtgcggaggagggcgtccggattcgaggccttccctcccctacctggtaaggtgttcgtcgaggaggtgagcttttcttggtttttgtttgattcatgggtgtaaagataagagttttcttggttaatttcttgtttggtttgaagaagtctggcttgccctaggcgcaaatgtggtattaacttcgattggggttggatttgctctgtgcgacctccggattaggcagggattcagcttgctctgatgcttctttagaatacaaactgcacatctttgggagaaatcaatgccatttaagtggttcatgggttaatttccatcttttcttatcttggttgtactagtggggtggaaagttagctcatgcttcttccatttcggagcattggcgagtttcgtctaaaacagggcaagtgactaagtgagtttcatttgagtttgatggttccctttggtgaattatccccagtattgctgttcttgtagttggtgggttcgatgatgtagtactcttagctaaggagtagatttttagttctgttgcttggaatcttggtagtcagttaattaccatattcatatacttggatcacttatgactaacatttctgaacgttcccaagctatggtttatattattccattacatgatacactcttcgagggataagagctgtttacctttcatttttgtaggccaggactaattagatgtgcatttgttttttaggcaattggagctgaatatggggaaggttttgagacatttaggatggatggaccactcaaggtcgatgtggtgagtatacgtcatttaacttacatggcaattttttctatatctagcatcctgtattacttccttaagttacattttgtataagtttcctttcattgtttcaggattatctgaacgaaaaattgcaagaatgcttccttcaaaggataagacatgctatgaagccagatgaagcatgtgggcttattttctcatgggacaacgtaattgtgagtttttttttttgttcttgtgctagtttgtaatagtgcaatgtctactagcctactagtgatatttatttcttctaagtggcacattaggccttctcgtctgcagttactcgttgtgaagatcattcaaacaaactctaccttacgtgttaataatttaaaatttgtttctgtttcaacttcattacgggatgctttgtttttttggtttgaactacactggttgattggtagagaagaacaagagtcagcttccttaagtccattcttctcagtagtttatagagctgttacaatggggaaacacttttaatcacctaggtggacatccacccatttgttgcatgtcaactaaatgggtatgaaaagaaaatcaaaaaaaaattgacaagatatattcatatgtaatatatcaccccacaaacatgcaagttcaaattcgacttctacaagttgtaataaaaataacaaatcaaactctgagtagtatacgcatattcacagttaaatttgttatttttgtttcaacttataaaagttgaattttaagttgcatgtttgtgtagtgatatattttatatcaatctatcttgtaaatttttttgaaattttttcatgatcatttagttgacatgcactaaatgagtggacgtccactcgagtgattagaatccacctccattacaatgcccattgttgcatctataattgactcagatttgtcatcctcttctgttctcttaggctgatacagactcactaaagttggatgcctggagacagcttgctttggaagaaggtatacctttaaaataaaaatattcagtgtaaagttttatgaaacatactattcctataatgttattgtatgggtccttttcttttttccgacaatgcaaactgtagaaatcattttcttactcgtttaagttcatattttgtcttcacattcagattctcagtggtatattgtctgcaaggtctgaggagcacatacattaacttactataaatataagattcttattgtgcaaccttttatgacttctcattcaattttgactgaataaaatcggtctaaactacttatttgtcattgaggtttgtgtttacctcactgccagggatgctaccttgatattgctaataaatttatttcatgcagggaaggatatcccaaatgctggtcatgtccaaaagagtattcttcatggtgctgccgaccatgtgcttagaaaggtatgagttttctttatacatacggaaggtctatgttttagagttgataccatgcttgcatcatcaattagctttggtactttttagtaacactaatttgccactgaaagttattttgctgcaaacaaaataataataataaaagcatactctttgttgggcacattctttctattgtgcatatggctttccttttgcaatttgcacccagtggcagttaaagtggcaactctacttgtccttattcaggttttatgttgggcaaaagatgaaagtcaaatggaaagactgaaggcacggcttatagagttatactacgaaaatctcttcaaagtaattatttctacgcttcttttgggataaaagatggcttaaattatacataattgtttctgattaagtatgttcatttcattcagcttgatacaccagtaaatggattgcgggaatggttggatgctgtccagacagcaggcatcccttgtgctgtcgcatcgtccctggataggagatgcatgattgaagctttggatcgaatggaactaagcaaatacttcaaggttcttttttttgtatcatcctaatttccaagttttaccaaaacattattttctgaaatacattcttcgaatacgatgtatatcagaagttaattttattcattcctcctttatatttcaggcaattgtgactgacgaggatgatatggagtcaatagcacataggttcctctcagctgctatgaaggcatgcttctgctccgcttcaaaatatttagctgttttcaggatatactgctcacatgtttgtcaaacctgtcttttctcaccagctggatcggaagccctcaaagtgtgtggtgtttgaggatgacccgagaggcgtaaccgctgctcacaactgtaccatgatggcagttgcactcattggtgctcatcctgcgtatgtagttctctcatttattttttcttttttggaataatattctttgaaattagagcacagtttgttccattgctttcagatctttctgttgaactacatagcaaatcttggctacttacctgcggaatatacattttgtatgacatgtaggtatgagctggtacaggctgatctcgccatcgcaaaatacagtgagctctcggttatcaatctcagaaggttgtttgcacataaggggttaagtttcatggacttgcagaagcagatcatcgagaggtcacctcccaagaggaagctgacagtagacaccatcttctaatgaattctttacctcccaatactgaaaaagagagaaaagaaaatagcaccatgcatcctccctactgtgctgtgtatatagcattccatgttggttagattacatagaaagctgatgttagatgatctgttgttgcatacctccattctggatgtactagatgtaaactgatgtttaaccattttaatcatgataaatactaccagtctaccaaacagaatcatgtccagggttatgaagggtgtgcgcttctgatgtgtgggcctatggagggtgggccccacctgttagggattgatgccccctcggacttggaacaatgcatattatgtacacacaagatacatacgtattgagggcctatttggtagagctccaactcctaaatttagctccaggagttgggtctggagtggagttgtgtagctgcctaaacccagctccaccactctagttcattttgtgagagctctgctcttatgttaggtggagctgaaactgtttggctgagctccagagctagagctgtgctaaacaggcaaattgaaaggcgcacacctgcagttagataagttaggggctctctaaaattgggctattactgaatatatgctcagagcaattacaatttattctattgcttcagttggataagatggaatacaatttgttgtattgcttttagatctttttgttgaaactgtaccactaatctttgcttcttactaccattttgcactccttacagatataggcaagagctggaacttgctgaacagcttgagcaaatattccagaggtcgcctcctagcaggctagtctttttgcaatgggagatttgctctggtccagcaaaaagtatctcgaggtaacggtacctcacggtaccaaatcgtttccgatcgttggatctacctggtcaggatgtacaatgttagatccaacgatcgtaaatgatttggtaccatgagataccggtacctcgagctactttttgttagaccggagaaaatctcttttgcaatggaacatagcgatgttaccgtaggtattaggatttaagtcagctgatagtagacaacatcttataaaaaacgagcgattccttttactgcttaattgtatttttcctctttgtttctatcaattatcttaaaaaaagggaacaattccatgctgtttaataacatattaacatagcgctgagccgctgatgttagatgatctgttgcgtagctccatttctggatgcagcagttgtaattgtatggatggtttacagggaaggatcaactgctagaaccatgctgctgctgctgttgacctgttgttgtaagctgacattagcagatgatccatttattcatgataaataccagttttccaaacacagacatggacatgcttcagaagtatatgcattcttgtgtgttcgcagctggtatatatggcagacgtacgtagtatcatgctaatgctagcagattgaaagagacgaaaatatctttattttttttcccttccttaaaaaaaaaaatgaagagaaagagactgaaaggcagcacggtagttgagcagagttatattcctgttgacagcaacagttaattttgggacagtttggatgaaaagggattaagcaaacacttgggcaaaggaaacaaggaaaacccctgttatttttcctttcttctcagccgagaaatttgataatttaacactttttttcattgtcgaattactttaattgatacttatgaggatgacatgtgagaccatctgagtggataaaattgagacaagatgtcaaataattgaagctctaattctgagccccctgttttgtgctccgttcaaacaccagttttcttttctaatattcagacacctgaatgtttttgctctctctcacctcaccaaatcttctctaatttgtcctaaatatttagctgttagtagtttggtagtatctcttcttaaagatgctcgtgccatacgttgtaatatcataccgggtcgatggcgactgctgcgtctgcttaataagaagagcatcaaagcaaaaaataattcattttgcgaagaacaataattagtactcccgtcccataatataagggattttgagtttttgcttgcactgtttgaccactcatcttattcaaaaaaatttgtgcaaatataaaaaatgaaaagttatgcttaaagtactttggataataaagtaagtcaaaaaaataaataataattctaaattttttttgaataagacgagtggtcaaacggtgtaggtaaaaacttaaaatctcttatattataagacggagggagtagttgatagctgagttagtaatagtattaggcagcttctcttgccaactctagtgagactgtgacatgaaaacttagaattgcagagcaggtgaagtcgtgaagatgcaggagcagagtacataacaatggcgttaggattacacgttcagagagtgagctagagcacatcgttgatttttgttcagcgatcatcgatggatagacggcggattcggcgagatgtggagatcgaatctgtcgccgacgactctgccaattctgtccaggttaaatctctctcttcttagatgaaaattgcatgcgatttactgttgatgagtatgtttaatggtgattagttcatggattaataagcttattatatgttcatcaattgcatggtgtagaacatcaggctggtgattgacatcggcgacaggacgatccaggtccctctcaatggccacaccgtcgcgcagaacatcggccgtcaggctgccgccgccgtcgccggcgattcgtcagccggcggtgtcagtgagaaagccggtggcgg

SEQ ID NO: 32795 - DNA, 1811 bp, Oryza sativa
ggatgccgaggccgcgcgactggttcgcggcgctgctcgccgccgacccggcggcggccgccgtcacgagggaccaggccgggaaggcgatgctgtacctgatcgtcaacacctgcaccttcgccacgtcgctcgccgtgctcctgatgctgctcgccgtgggcgacgccggcggcggcggcggcggatgcgcgtcgaggagggtcaccgcgaggctgatcgccaacatgatgacggccgtggcgctgttcgccgcggcgacgttcgcgctctgcgccgccgacgactaccggctcatggcgttcgtcggcaccgtcgtcgccgtgtacgccgccgtcaccgtcgtgttcgtcaggtgcaaccttgctctgccgttccggagaggcggcggcggcggcggccatggttgttgtagctgggtgtcaagattgtaataagagcagataatactgggccggccatgcatttgattcagccatattactatacacgcgcggcgcaacgcacaataacggagtttagtaccacatggaaaatttacagcggtggagacctgtataaaagaggacgtggtcgtgttgctcccgccgagcttggttgtgcgagcttgtcaccccagctgtgggggggcgggagttggcaggattggccgatgttgggaggatcgagggtatagataagatatctctcctccctggtctcgttgggttgttgaggcacagatgctaattctatttgtccgactttggacttagggggaggactataggtgtcatcaaaccccaggcccaatttgcggctggttgagagccctgcgttgtttaacgtcggtggcctcctggttgctttaacgatagaagcccacggtcgtatcctgtccaacttctcctcttttttatttttatttttaatgatgctactctcctcttttctttttatgatgctatttttcttttacttttcccttcaactagcaagtggggtgaagatgacaattagaattgcagagcaggtgaggtgaagatgcatgagcagagtacaaaacaatggcgttaattatgttaggattccacatttattttaggattccacattcagagagtgagctcgagcacatcattgatttttgtgcacagatcgatggatcgattgattctgtcgccgacgactctgccaattctgtccaggctaatcaactcagctcaagtgcttgcaatttactgttgatgagcatgttcaatggcgattaattagttcatcaggctggtgatcgacgggacgatccaggtccctctcaatggccacaccgtcgttcagaacatcggccgtcaggctgccgctgccgtcgccggcggtgtcagtgagaaagccggtagtgctcggtggtagcggcaacagcggggcggcttcggcttgttgtgcatacgcggatggctgcctggatggtggtggccacgctgttcgccgccatggcgctcgaggcggcgctgcagccgccggcgtggatgccgaggccgcgtgactggttcgcggctctgctcgctgtacctgatcgtcaacacgtgcactttcgccacgtctctggccgggatcctcatggctgatgctgctcgccgtgggcgatggcggcggcggctgcgcgtcgaggagggtcacggcgaggctgatcaccaattaacacgatgacggccgtcgcgctgttcgccgcggcgacgttcgcgctctgcttcgccgacgactaccggctcatggcgttcgtcggcatcgtcgtccccgtgtacgccgccgtcaccgttgtgttcgtcaggtgc

SEQ ID NO: 32796 - DNA, 2329 bp, Oryza sativa
ggtttggccgttgttgggggatccaggtatataggagatatttctcccccgggtctcgtgccgaatgcttgttctatatccgactttggcccaggaggattgtggatgttcatccaagccctacccaattgtggttaggttgcaactagtttgtgagtactctagcgttgtgttcgggtcggcccttgcgccgcctaacaaaaacgtctaggtcactccctttctactcacgagagaagccacaaccctatcctgtccaactcctcattttttttaaaaaaaacatggtacattcttattttcacaccctttccactcacgagatcatccacggatttgatcactacaatcgatcatgagagaagcgacggtcctatcctgtccaactcctcttttctttttaaattcatggtacattcttactttcgcaccctttccactcacgagatcatccacggatttgatcaatacaatcgatccaaactctaaatgtgccaaatgggtttaaagcattaaaacctatgtcttagaggatcaacctaaataaagattggaaagaagtagaggacaggttttagaaaaaaaaaagctaagttgttggaaaagcaaattattatctgcaggtagtaatccaactcttgttaattcaatgttgaggagcgtaccaatatttatgttaacctttttacgatcctttggggaatttttttttaaaaaaacctgattataatgattgggtattctaaacttgaatgagcaaactagatgtttgctccgcaaatggttattcaggttaataaatgaggaaggggtgtggcaaaatattctttgaaacaaagttgatggaagaaaactatttctttagttgaaaagaaatcaagcgattctcactttttgttaggtttgatggtcaaacatgagttttgtgtccaggttcttttctgttaaaaaatggaactcaaattcgtttacgagactatatgtggcttggacggaaaaagccttaaagagcactatccaatgctataggaaaaagtctgaattacccctatgtactattgtatgagtacgaattactcccataaaccacaaaatcaaacaaccttcaccctcaacttttcataccgaacgaattgcccccttgactcgctctagagcggttttggtcctacgtgacacacacatggcagttatgcttcttcctctcttggtctcctcttccttgactcatctcggtcgctgtcgatctctacccatcgctcgccacctcaccggccccagcccaaagctaagccctagcagctcgtcatcttcgtcatcgccgctgagacttgctgcacctgaggttggcgcttgctgggaggtgcccatggcagtgggggagccgacgctcgcggacagaccagagatggcttggagagaggtggaggtggccgacgggtgcgcttaggtcatcacggatgtggaggggaccgcctggcggcggccactcatggaggctgccgaggaggcccaacacaggtgatggtggggaagaggtacaggcctcggcgcaaagacggagggcacaactagtggcagtgcgacaaggagtcatcctcgccccacaaagggagagcagatctgacacacccgtgagctggtcggcgatcttcgccaccttgcgctacaagaggagcgtgtcacactcacatcccccacgaccaacgccatggcccgccattgagggtaggaggaggctgctgcctgcaccgtgttgacgagagtgtgacgggattgggatggtgtctatttttaatatcaacaatataatttatggggtgcacaggaccaagaaaagttggtggcatagaaattcctaatcaaacactttaggctaagggagtcagaggaagcagtaataatcatagtgatctctatctctgccccttattttgtgctcaaccaaaacatcaatggtgataattttcagctacctgaataatattctgacgcagctgcggatcgaggcagctcccgggtctcttgttaatttcacaactcgctaaacctcactaattctttactagagagtctcttgtcttaattattctgctgttagcagtttggtggctgggtattagtcagctactctgcttctctagacttgccaattctagtgaacaacttagaattgtagagcagatgaactcctgccgattctgtccaggtcggttaatctctctcttcttagacttgtgtagctggacgtttaagcctccttaagttgtgtctctatttttttaatcaaggatctgtttgtactctgttttccttcttaattactact

SEQ ID NO: 32797 - DNA, 2200 bp, Oryza sativa
aggaaagcaaatacaatcctaaaccccacatgtcagtcacttggagttttggataaagtttaggaataaaaataatggattaggaacagtacctttttacaatttctcggatttattcaaatttgaaactttaaactagcataactctctcattttaactcggattagagtgaaacttgaacctaaatttatctaaattcataagctttccaatggtatataatccactatttgataaaatacatttataattattaaataattaatactaagataatgcataatagttaaaaatgtgctaataaataaaattgatattgtactgtaaagtagatgtcaaataattgcccttaacatgcttcctcactgtaaaacctatgtaaactaattaggagcattgtttcaaattaattaaagcataggaaatactagtgccacttattaatatatgtcaatatataattatactcatgacgtccaaattgtataaataatgtttagcctcatactttgtgactaaaagttgaacacacgtagatgagtctttaacttgtttatgagagataataacagagctagtgtgactaaaatcacccgcatgaaattaattaacggcatttcctatacagtagtatatgtttaggttggaaatcgacccttaagttgtatagacggtaactcactcataaatccacttaaaatcacatgtactgtgtagctcgtagtaaatagtaattattcaaataaatgattcagtattaagatattgtgcacacacctatactgtacattctattatagttatacggtatagtattaatttgcttgttgcatacattaaattggagggactatatgacagacatgaatattagataaatactagttataaatcttgatctcatataattatagttcaattgtaaattaggattattcattgtaaaattatgtgatgggataatctgtaaccataatatgattaacctaaacaactctaacatacaaagcatggataattattaaccttttctaatttattgtgacaagtaaaatattttcataattaaagcaaagcctccatcaataaaataataatacaaatggttccctgcgattaattgcttgatcccaaatccatctaacaacagaacctttggtatgtaaccgtgctatttagatagatgcatatatagccataatccttccatagccatttgatagaataaatcgccgattagccaaatatatatgtatcccataaatgctatgttggttaactcctaaatagaccacgatgacaatagaaagattaagaagccttagccctagcatgattgaaatccattagcaaacacgaatagtatgagcaaccccaggatcgaccccaacaattatcttttgcttgtgcatatttgcttgttgtttgaatattggtttttctcgcgtattatagaccttgtgtatcggttagtcgtgaggcaacgtctgcaacttccaggaggtgaaggttgatcaaattatcctaagcaggcaagtcatcactattccttgaacatgttggtcccaattgcgaaattattttgtttacaaataaaattacatgcaatgatgaacatcctacttgtgattatgccatgccttgattattgtttaccccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgaaattgatgacatgatttgtgaaaggaaaataaagtgaaaacaactgttttcgactggggcggacggaggatttgggtggtatctggaaaaggctagtaccgtccccggtcaattaaggaccgagccatgaagttaagcatgaaacgacccccatacaaccgcacttctcgtatgggtatagacctagcggattagatagccgtgcggaggcagtatccctgcatagatggttcacccctgagtgaggcaggtgcgctacggtgggacagccgttgaggtagggccgagaagcgtgccctacatcagtgtcaccattggtagggctgccatgagtgtgtgagagagaaactaacttaatgaga

SEQ ID NO: 32798 - DNA, 5110 bp, Oryza sativa
agggaaggtggatgtcctcagaaaaccatgacgactcaatggcgggaagctatccttgggatcacaatggatggtggacagaaccgtcgttgtttaatgtgaacactggtattaaaccttaatcagtctatgctaggtcttaggcttgtgaaaagaattgcaaagcttgctttacgcaaaagaaccggagcccttccttgaaataccctctatcatatgtattgttgttgtggtggtttgctgagtacggttggtactcacccttgctatttatatatcttttaggagagtgttgaagagaagcccttgtcggtatgcttgcgtatccaacaagatgatcggagtgcggtcttgttctaggtctcgttccctagtcgactgcctgtggcaagttaaccgggcctttatattattttgtcttccgctgttgttctctgatagttgttggcctacctggacctaatgtaagtatttaactcttttagcctgaattctttcgtgatatgttgtgatccaactatgtatgtgtgtaccaactactgatttagggattgatacggataaagacagaagatttccgatttctaaaatcgggggtctacatttgcttacttccattctagagggctgttttatgcaactgttgtatggacggtttacatgaagagaagtgctacaactatgctgctgcagcgctgctgttgttttaagctgacagtggttcattgcccatttattcttgataaataccagtctaccgaacaagacatggtcatgcttctgaaatatgttttttttttttgcgtgtgtttgtgcagctagtatgctgccatgctatcatatagaaagaaactaaaagacacaacaagggttgagcagagttctgtcgataccacaatcctattgttgacagttgtaagatcaaagtgtgttttgattcttattctgtgatgaacaattggcatctgtaattattggttttgatatttggagattactgtcgaagtagttttggagataattgattttcaggtgatgaacagggtttgctgttttgtcgggatcggtcagaccgggcggtggttgccggtcagaccggcttgtgttgagcggtcagaccggccggcccgcggtctgaccggccgacgctgtgtcggtttcggtttcgggttgttttctttggatatccgtgattgtttcatggttatggcttctagataaatactatacgtatgtaatactgttgtttgctactaatgagttaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgcggaatactaaggctagagttgatgcacgtggttgatggagattctatatggcatacgatggaggtattgtgtgcgtatgggatgcggagtcgaatttggaaggagtccaaatttagtacgattggttatgtaaagtttctttattgtactagtgggtttcctaaggtgtttaggactcctagtatgagtttggttcgtggctttaggctgcctacctcatatataaataaagggggagcgtgaggcttcccggtatcgcttttgtatcgcttttgagagtaattgagttgctagtttagttagggtttcgagtttagttgagatttttgtaaggagtgctgttggtgcactttgtaaacacaaagagaagcaataaagttgtcatctaatttaagagttcttcgatttgcgtttaccaggtttcggcggtctaaccggcaactcaccggcggtcaaactggcggcattgcggctgtcagaccggcgggagcacggcggtcagaccggcggcggcgacaagcgcggcgagcagcttcagcggtcagaccggttgatctataccggtcagaccgacggcatccgagcggtcagaccggcaaggtaacttcggtcagaccaatctccatcgatttcgagggtaacttttatttccgctaaaagttttcggtttttgggtatatcaaccattcacccccctctgattggcttagttcttgtgattcgatcctacaacagtcaatgttaatttagggacggtttgagagtagagggttaggctgagttcctaatcaaattacaaacacctaaacaaacacttgggtgaaggtaatcagaggaagcagcaatgactaatgactaatgtggtctctagctctgtttcccattttatgtgctcaataaaaacacattttgcttattttcaggcagccacctgagtttgttatcctacttcaccaaatcttcacctattttataattattctgctgttactagtttggtattccttgccaaaactgcaatatcatatctagctgaactagctagactgtcacatgaagtcgagaacaagttacaatcgcagagcaggtgaagtacatggtgagtttgagtttggcagaatgagaaggtgtaccaaactgtattcaatcatccaaggtttgcatatcatcgaccggcggcggattcagagagaggtggagtctagagccaatctgtaggctcctgaatcatcatccaacgcaatggcccatggcctcaatccctgtttctcggttacaaagttgttgcatgattggtccaatactccaattcacagaaactctgtagtacatgctcttggtctgaccggtgacctctggtagaatactgtcagtgctctctcaaacactgtcaaaaccatcgccgacatcaaacgttcaaatcaagtataaattcactacatttgcatcatgcacatccatgcgaatttcctgttatttgtaagacaacacatcttgatcaaattcatatccaaggctgaaggctcgatctccgggctagtaccatcccatgttacgtacatcagttctcaaagggataaaccttgatagtgatgagtttgtaacactaacactacctaggatattaagagatcctgaacattgaaaattaattaaagtggcggcgatgctgtgttcgattgagcctctcgctgtcttttctttttcttccgatactcgatgatcttgggccatactaagctgataaagagggtataggagccaaggaccaaaagcacaggttacatccacctgatgacagtccaatcactcgagatggccaagacaaaggtgcaactggtgctaatgatcaccgtgaacaatatggcattcatgagtctcatggaatgactagccaaggacctccctaccgccaccagcgtgatcagaagcgccagggcaatcgtgaaggtcaccgtgttgaacatgatataccaccgtatccccctcatttggccctcggtgagggtggtggcggcgtgttgttgaggacttatcggggaaggagcagaggcgaccgtggctcggaatattataccgctatgcttcatgttgtgggagctaaacgcctgaggccagtcatcggggaaccaggcaggcaactgtatcgccgcctggaatgccatgcccacgaacagcgtggccaccgccatcagccacccgcgcttgttgttcaggtactcattgtcttccctcgatgttcttcgcaccaaaccaaggaatgtttgagagaattatatttaaaaaaacatgaaatttggtatatatagtacttaattatttaagtcatagtatcacaagactacaaatttagtatttgagatagattaagatgaagataaagttagggtacgccaatcgagaaagcatttaacgcttgattaatcgagttttaattattataaatttaaaaaacaaatatatttaatattttaaagcaacttttatatagaaagtttcgcacgaagtatatcgtttagcaatttgaaaaacgtgctaacgaaaaccgaggtaaaatcagcatcttaattagaaaataacatactttagaaattgagtgtcatgttttttccttcacaaaactacagatggatcatcgtttttttttttacgcaaaactacacattttaaaattttacaatggtaagaggtgtagggatagcacatctaaaatttgttttgaaaaagacgatactaaatctatgctttgagatacaatgatttaaatgtaaagctttatgataaaattatttctatatctgtagttgtatgatactatggtttaaatatgtagttttgtgttaattttatcaaagtactagtttagtgaaatttattctttaattcatttttatactacttcaaactgaacacaatctcaaacaagttttttttttctcacggcagcccttgaagagctgtaggtaggaagatatcacaatttctaattatatacaggtaattgagtttaaaagagggcactaccaacaaaaacaagccatctatatcgaccattggtgacgacatcataatttttaaactatcactgctgacaaagactaaaacttccgcacattctcgaaacaaaaaaaaattcttgtcaacattttttttgagggaatcttcttaacatttagaccaatcaagcagaaaaaatgatactactagattgcaaacagaacctgaacattttcgctaggctcactgccggctggttcatgcgactgatccatggtctgcccgtgcgcgcttcctgcattcctctcctccctaaatatccgtgtatattcaaagtttcagatagaagcgctagctcaagttgttctatcttaatcaggctgctgccgctgcttatatagactaaccaaagttaattagatgcttggagaccgttctctttggactggagcaaggaatattaatcaaaccggtgtactggtaagtactactatgattctttgctatatcattaatcaataaccctcctaccattacctttttctctgttttctgaaatttttttctcctcggaatagctgccacgttgtctttattggtacagagctcctcgattggacaagaaactggcagcaagctagtatatcaacggtcatatcactgtttccctaaagaagtactccctccgtcccataatataaggga

SEQ ID NO: 32799 - DNA, 2219 bp, Oryza sativa
atctacagtactttaagtacaacttttcgttttttatatttacaaaaaaaaattgaataagacgagtggtcaaacgttgcaagcaaaaactcaaaatcccttatattatgggacggagggagtagtactccatggtcccagtgagggctttttctctgttttttgaaaatttttttgctccttgaaatagttgccacgttgtctttattggtatagagctcctcgattggaccagagaaactggcagcaagctgtatcaacggtcatatcactgtttccctaagacccggtttagattatggattaattaggctgtagcgcatgttgattcgagagactgtaataaaggtacatggtttagaaaggtaccatccttgttctattgctcatgccggcggacgtggctgcagaacgcggtgtggagttggctgtacgggccgctttgaaatggaggattagcaaagaaattttagaggatttattttcctaagaattttttctatagagccctttaattcataggaagatgataggaaaacttccataggattgcattcatatgatcaattccatagaaaaataaacaagaggttagacctcttgtgaaactttcttttgttgagggtattctgtggtataatcaaagggctcttctctttatttcgggtgttttcaatttctgtaggtatattcagagtttcagacacaagcgctagctgcagttgttctatcttaattacagcaaggataataatacagcaagctgcttactcgtagtctatctatcagcttactcatataatagttaacttttcactataaatatatggtccacctgtttgtctcatagattttcttgattcttgtgcctaagccagctgtaaacttacagcccgcttctcatctctctcctctcctctctcatccacatcggcattcagacttcttatagccctccattcttaggctgctgccgctgcttatatagactaaccaaagttaggctgtgtttagtcggatccaaagtttggattttggttgaaattggagatgatgtgactgaaaagttgtgtgtatatgacatgttgatgtgttggaaaaggactgaagtttggatccaaattttgaatctaaacacaccttaattactacctccgtcccaaaataagtgcagccgtagatatctgtgcccaacgtttgaccgtccgtcttatttgaaaaatttgtaaaaattttgaaaatatttagtcacacataaaatactatttatattttatcatctaatagcaataaaaatactaatcattaaaaaatttcaaataagacgaacggtcaaacgttgaatatgaatagtgtaaaactgcatttattatggaacggagggaggagatactcggagaccgttcgcttttggactggagcaaggaatattataatcaaaccggtgtactggtaagtagtactagtactactctgttttttgaaaaaaaaattctcctcggaatagctgtgccacgttgttttcattactccctctgttttctaatataaaaaattttaatattttgtttgcacagtttgaccaattatcttattaaaaaaatttaaaattattatttatatttttttatttactttattatcgaaagcactttaagcacaatttgtcattttttatatttgtataaactttttaaataagatgagtggtgaaacagtagaaggaaaatatcaaaatatcttatattataaaacgaattatttataaaatgaagggagtatcagagcaagttcaatagtatagccaactactagctccaattcatttatagccaatctaatagctcattcatataatagttatatactacactattaatacctggtcccacctgtcatacacactgtgtcttggagtccgtgctgcagctggctataaatttatagcccgctgcccttctctcttcttatttacctacttaaaatatgtttgcagctggcttatagcctatagctgctcttagagagctcctcaatttgaccacagactggtactccagtatcaagctgtaccaacgatcatatcactgtttttttttctcctcggaatagctcccacgttgtctttattggtacagagctcttcgattggacccgagagactggcagcaagctgtatcaacggtcatagtactacagtatttactgtcctctcgtgt

SEQ ID NO: 32800 - DNA, 7332 bp, Oryza sativa
  unsure (1)..(7332): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatctcctcaaattatgtttgcagctggcttatagcctactattgtacctgctctactaactccaaatcatctatagccaatgtaataaccaatttatataatagttgcttgttatactattaatacctggtcccacctgtcatacacacattacgtcttgaagtctgtgttgcagctggctacagatatgtagcctgctgctcttctctctcttcatttatctctttaaaatatgtttatagctggcttatagcctgctattgtacctgctcttagaaaagcccttagatgcgtcagagtggaggtgtccggagatcgaggtggctgttggctctgaagtgcgtggggtcaccgactgtggtggtgtcggtgaagaactcgttgttgccgaagtcgtagctcgagagtgtgtcgctactggggtcggtggaggcttggggactggggtaggcaccctcgatgaagaggagctgcctactcccccagctccctcgaagtgcacgtactcgacagtgaagtcgtcgtacgtcgaatagctgtcgtccaccgccttgtctcatgcccaccctcacccttcgtcgaacactacgtcgcgcgccgtgcgcacatgctgtgtctctaggtcaagaatgcggtaggccttcgagccctccgcgtaaccgatgaacacccctagggtgttcctgtcattgagcttgccaatgtagccgagctccttggcgaacgggaggacagtcgaagacccgtaggtgggggaccgccagcttgcgcccatgccaagcctcgtacgatgtcctaccgtcgagggccttggtaggcgagcggttgaggatgtaaacagctgtcaccaccgcctccccccagaagatggccggcatccccctctgcttgaggagagcccgagccatccccacaaccgtctggttgcgctgctcgacgactccgttctgctgtatgctgtacggcgcacagtagtggcgctgaatgccctcatcagcgtagtatgacgagaattcagccgccgtgaatttaccgccgttgtcggtgcacagcacgcgcaatgtcacgcctagaaattcccgaatagaatttcaagcagaatgtgcattaaaacccctatccaggaccggccagggtacacaaacgacaaagttgacatatatatccacgtcttacaaacattaaaaaagtcttacataaatgcagcgaaaaataaaagataactggagctaagccttgacttggattgcggcaggaacaccactccacaggcatcctcgacggcacggacgaagcctattcggagaaaccaccatcggactgtaacgccccgattttcgttcgggaataaaaatcaattaataatacattttctagaaattaaataaaacttaaatcaatttaatcaagtaaaataatgggagaattaaaattttcccttaaaaatcattggccgggaatattttgtaatattctttgcgccctaatgtactctccggaattttccgtgaattttcggagctcgagaaatagtttcaataacacaaagatcattgcatcaattaaaataaaaagaaaacaaataaaatttcccccttcctctctttgggccattttcggcccaagtcttctttcctctcccgcgggccgcgcgccttctccctctctcgggccggctcccctctctcttggcccgctcgcaaaagtctgttttgcgtcccttcttctctcccttcgccgacaggtgggaccggcggtcccacccgtcagctccttcttctacctttcgccggccgaccccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgagctccggtcgccgtttcctgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgtttcggtcgacgtcgactagcgccgttgcctccctcagctccgcaaggacgaggaggacctcggccgccgcctctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgactgccgcctcttggggtgcgtcgccgtccccgtgcgcgccgctgtcctccggccacccgccgccgttccacgtcgccggctgctgcagccggttgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggcggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtctcacacttaataaatcgacccaatacactgtagtccaggtgggttggttgggcctgttcaacgtggtgtagcgttgatcagtggagattaatgttactctaattactcaacagttttattgttttggcaaataaaatgttttacaaccgcctttatgcaaatagcaacaaaccgtccttgtgttccccttgcacgtccgcatcgttggtgtggcttgctgagtacggtggttgtactcagccttgctattatttcccccttttcagaagtgtagtgcttctgagctgaagacgaagttagaggaccaaggctcagaccccagttgagttttgcctgtggagtggagctgaagccccgctaggatcgcctttttccgctgctgctgttttcatttcggtgcgaggactaagtgcctcttttgtaagtattttacgctttatttacgtttggaactgtgtattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggagggtaaaccgtcagcttcgtgtctgttcggaagtcaagtcaagcatcaagcttcatgcagcaaagagcgggaaggtccgttcagagtcgtcgttccgcgaagatcaagaagagttttcccggagtttacctaaacccaatctttcctggaagaatagtttcgttagctgctaggtcgtgtgttgtttgcttgtgtgtaggggtatggtttgcatcattggtggggatgcgaccatactaggttgtttgcttaagcaacctgaacaataaaagtgtcctcaccccagatcagtaggcaagtggtttaaggccttttctttagcaacccctctcttccacctctcttccgccctggcagaagatggtcagtgttagagagaagagcaacaacggtgtatgaaagtcacagatcaatggatcagtcgaaagctacaaggtactcccgatgctagaagaatccctgctcgtgatcaacatttggtatccaggatcagaagatgggtgtattgatgcaggagatgcaaagctcgatgcaaggtcgaatgtagcggaagcaactctagcagtagtgtgttgcagtcaaagtcagtggatcagttcaagacaacaagctaccagctgagtcggagcaccacactctggtaagatcctggctagccaagatctaatgatggatgtgtcagatgttgataccgcaactgcagagtccaaagcagcaaatgcaacgacaatgtcttcaccaacaagtacaagctcagatgcaagccggaatcaggatcagagcgaaagtcagtttgttttccaagagcaagcacctgcaacctcagacagtacgccaccaagtcttcagcagactagcacagctaagtcaccaccaatcccagaggcaacaagtgctacctatagtggttatggtttacaaggtcagttcttgcaaggttgttcgtcggcaaggcgttagcgtcatcaagacaacagctctattcgcagcaccccagttcctcaagttgtgtcaattccaatgcgagtcggtcagtttagttttgagatatcaactacacaacccatttaggtggacgacaccgaagtcgggcctgaagcatgctagatatgccagcaatagaactgatggggaagtagtcaagagttagtaagatcacgagctaaatgagaatttctttatgtggaatttcctatcgacaaccaagggttaagttccaagtcttgtcctggatggaagtgcatcgtcattgctttattttgattgatcgttgaagttttctattttcaaagccagggccattcgtaaattcgagaagtgtcgatttttcttcaaggacaatggttcaattattcccggtcacgcgaaagtatgactactctctgtaagggggggtaggtcgcagagatgagttttggttcacctcgttgccgttttccttaaagattcaacccagtgcagcaagttggctagtacttgaaagagccagctgcaaggcgtcagcagagtaacactgatcccaagttgtctaattaaattcgaaggtacgccggtgaggccaggtcaaccgtttggcttaaagaagtagcatcaggaacagccgcaatccagacaaggacagaccaagccagtttcctgaaaatacttgtggtttgaatcaagagcaagtcgagcaaagtcattgtctgtgggttacggaagtcagtttcaaggtttcggaaaaactacaccgatccccggtcagcaaagtgaatcctcagtttatctaattgccagcattagcaattcaatcaaaaaaaaatagaagttctatgagcaccagcagttctggtcaaggtcagactaattagagtcggtccgtcagtttatgggaagcaacagaacagcaagcttatgcaggtttggttcatcgagcaatcggtcagatgaatcagaaagaggcagcatgtgtaagcagatcagtcagaccgcccgccagcaccagctttctttctagccatcccagaatctcgggacgagattcctgtaaggggggtagatttgtaacgccccgattttcgttcgggaataaaaatcaattaataatacattttctagaaattaaataaaacttaaatcaatttaatcaagtaaaataatgggagaattaaaattttcccttaaaaatcattggccgggaatattttgtaatattctttgcgcc

SEQ ID NO: 32801 - DNA, 563 bp, Oryza sativa
tagacctttttagtatcagagtgagctgcgtgctcgagacatacgaatgaccaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatat

SEQ ID NO: 32802 - DNA, 1090 bp, Oryza sativa
tgggcaacggctgggcttgtagtataactttcctctagctgacgcatccatgcaagggtgggcgtgatggagcgggattggccctacaacggcctttgtcgcttccggattcacctaagcacgagaggggactgcccgctgccttgcgaggagtgggggtgaaacttgaggtttggtgtgtttggttggaggggcttatgcgaagggtgctgtcacgacctctttccggtatatcgtggtggcatgccggcgcacaggaatgtgtcgtggggttgtgtcttgtgggtacagttatacacctctgatcagagtaaaactatttgaatagccgtgcccgcggttatgggcggtcaaccagattcaccgtgattagtctcaccctaacggaactgattagtgcatgtggtggtttgggcctgtctcaacgtggtgtcgcgttgagcaatgattggtttaatgttgattaactattacaactgttttactgctttcaactactgtttataaatgctagctttatgcaaatgaacccctttcgccttctttggttatatcctgcatcatacccttcgttccggcatgacttgctgagtacagtgggtagtactcagtcttactctatctccctcccctcagagtttgggtaattacgaccatgaagcatggccagatgtctcgagcacgcagctcactctgatactaaaaaggtctaatattgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttctttaaaacaatctttcgaactctttttctcacgaccgcggactttccaaacgaccgaaactacacgcttgcacgcaaaacgaagaaaaactcttataaaacccaagg

SEQ ID NO: 32803 - DNA, 5272 bp, Oryza sativa
  unsure (1)..(5272): unsure at all n locations
atcggcgggaggtgggggaaggaccctacaggtggggcccacctgtcggtggctcgggggaaaggagagaggcggagtcggttggggggagacgatgacaggtggggcctcgggtccacctgtcgtcgaggggaggagggaggaggctgggggttatgtggacttggaggagggggagcctagctgggccggcccacgcgaataaaggaggtaagtaggcaagggaagggagaatgggccgagcccaaagacaaagaggggattttaattgtttttctttttattttaattgatgcaatgatctttgtgctattaaaactatttatcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaatgatttttaatcccgaacgaaaatcggggcgttacaaatctaccccccttacaggaatctcgtcccgagattctgggatggctagaaagaaagccggtgctggtcggcggtctgactgatctgcacattgaactaccacattctgcttcaaactgattgattgactggttgatcaaacctgcacgattgaactggctggattcgacctttctgttcctttgctttgcgaaaactggaccgactggttctgcatgaactgacctagactaggactgcggatgctcctgaaacttacttatcttggactgaactgttgaggttggcaattttggtaacctgagaattcaccacgctggctataagaggatgaaaatggaatctggcatttgtaaatcatttaccctatgtccgcttggattggtcccaactcaaatgacaagtaattccaggaaaacctgcttgacctgtctttcgtctgaactgcaaccatcctcgatgctacttctctaagctgaactgttgacctggcctcacgggtgtacattagaatcgaacctgtcgacctgagattggggtgactctgctaatggttcgcaactgactcctttaattacgaaccaatttgctgcactgggttgaacctacaactgaaacggcaacgaggttagccaaaactcatctgtgagacctaccccccttacagggagtagtcttactttcgcctgactgggaacaattgaactgttgtccttcaaatatagccaacacttctctgatttaccaagagccctgactttgaaaactgaaaacttcatcggtccatcaaattgaagcaatggcgatgcactttcaccccgacaagatttggaacttaacccttagttgatgataggaaattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcatacatcttccatggatagttggacactttgcaaaaactgcgcttgaaagccataaccacaataggtagcatatattactcctgggattggtggtggcttagctgtgctgatatgctgaggacttggtggcgtactatctgaggttgcgggtgcttcctctttgaaaacaaactgactgtcgctctgatcctgattccggcttgcatctgagcttgtacttgttgttggagacactgttgttgcatctgttgcatcggactttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatctgttgtgagtacacttttattgttcaagttgcttaagcaaacaacctagtatggtcgcatccccaccaatgatgcaaaccatacccctgcacacaagcaaacaacacacgatctagaagctaacgaaactactcttcagggaaggattgggtttaggtcatctccgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagactgggaggagaattttgaaaaactgtttgacaaagaattgccgaagggcgagaggagacaatttgcaaatagggttttcagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaaaggggaatgatagcaaggctgagtacaaccaccgtactcagcaagccacaccaacgatgcagacgtgcaaggggatacaaggacggtttgtggctatttgcataaaggcggttgtaaaacattttattgagcaaaacagcaaaactgttgagtaattaaagtaatattgaatctccactgatcaacgctacaccacgttgaacaggcccaaccaacccacctgtactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtctttaattgccatgggtgcgactcgcaaaaccatgcacccacagcccaccattcagtcgcattttagttggataattacgaccatgaaacatggccagatgtctcgagcacgcggctcaacaagatactagaaaggtctaaaactgtaattatcccatcaactgagctagtggtaattaagcatggctaagcatatagttctagctaggtcacataagtaacacaagctagtcgattcattacccaaggttgacaaagaatagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattatttacgaattattgcgcaattattatttatttttacaaaggaaaaggactgccgctgacgtcagcaaagggccggcgccgacaggcgggccccacacgtcagcgagtcaaagggggagggcgctggtacacgggcccactcggcagcggctcaaggggggggcacggctggcaagcgggccccacggctccggcttcacgagccgatgtaccggccaggcccggtatcaagccggccggccggccatggtaaggcggcggcgcgggcatgcgaccgccaccgacggcgagcgncggcgcggtcggcggacgtcggcgcgatcgtctacgaccgaaagcgacagcgagcgcgcgaagagggcggcggcgcacggggaaaaaaaaagaagggaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccacgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggcgacgtgggggaggagagagagaaggtgggggggaagattcaaaatcgaatcccgcccctctcgtgcgctggcgcggccgggagacgcggtgagagggcggccactggcgtgggcgcggcaacttggcgtgggcgcggggaaagcgg

SEQ ID NO: 32804 - DNA, 664 bp, Oryza sativa
tatttttattacaacttgtagaagtcgaatttgaacttgcatgtttgtggggtgatatattacatatgaatatatcttgtcaatttttttttgattttcttttcatacccatttagttgacatgcaacaaatgggtggatgtccacctaggtgattaaaagtgtttccccattgtaacagctctataaactactgagaagaatggacttaaggaagctgactcttgttcttctctaccaatcaaccagtgtagttcaaaccaaaaaaacaaagcatcccgtaatgaagttgaaacagaaacaaattttaaattattaacacgtaaggtagagtttgtttgaatgatcttcacaacgagtaactgcagacgagaaggcctaatgtgccacttagaagaaataaatatcactagtaggctagtagacattgcactattacaaactagcacaagaacaaaaaaaaaaactcacaattacgttgtcccatgagaaaataagcccacatgcttcatctggcttcatagcatgtcttatcctttgaagcgaggacggaaggcggacggggtcgcccttgaccttcagaaggagaagagggagttagggaggggaggaccgatgccgggtgactggaaacgaaaaccgatggcgatgacaagaagtagagc

SEQ ID NO: 32805 - DNA, 451 bp, Oryza sativa
aatggagtatatggtgcggctacgcgtcagggaggggagcacctgatccgactcgcccgcgccggtcgccgggcgtataaaaacacgaaaagaagaatttttacgcaagaaaactgttacaggtataatcaacggtgtatagtcatcaggtattttggtctcactatattggattggatgtggatgtgtgcgtcactgccctcgtggattcgtggccaatctcgcgaagtcgcgatactttggcgtagaggcgcgcgcactccacaaattccgctgtgcacacgcgccaaaaaagaaaaaaaaaacaatttctggaggcggaggagccggtcgtccaaccgcgagtggtccgctccgaccgaagcggggtcgggtctggtcgagccacacgcggccgcggctgcgtctccgcgtcgccgtcgtcgtctccagaaacgcacgagccgagcgg

SEQ ID NO: 32806 - DNA, 608 bp, Oryza sativa
cgtaaccatgtgtgaatagattttgagctagtagggttgcagccacgagtaagtcttcccttgttattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttt

SEQ ID NO: 32807 - DNA, 6228 bp, Oryza sativa
tgtgatgtttttcagttactggagtatgaacactgacaactcaaactttatgagtgtgcataaatgcattcgatgacatgcacggaccatcatagctagagaccgaactgaattatttgtcttactgtctgactgaggctgtgtttagatccaaagtttggatccaaacttcagtcctttttcatcacatcaacatgtcatacacacacaacttttcagtcacatcatctccaatttcaaccaaaatccaaactttgcactgaactaaacacagcctgactcataaagtagagtatatttgtaagagaggagcacatatctagctagtatgttattttgcatgtgttttgccacaagaccatactggatcactgaatctgaaaaaatgaaataatgaggttacctttttctatagcttcttgggtaaacgggcaaccagaaagaaatatctggcaacaaagttgaggggttttactcaagtacagaaggcgaacttgctcagcatgaaaggaaagaccggagtgatcctagatcaatgggaacagcagcggcatggggcgcgtctgctgcatcgcaagacgacatttccatcagacccaacaaccaagcaagcacatgctatgttgcgaggaattgaaagaaagactcaccccagagcgaggcctttggtgcgtgcagccatggcaagccggcaaatcgatcgcctattgcgaggaagatgacgagcaagttccccggtgattgcgtggatcatccagatgggctggctcttatgcagtgacaaagagtggaagacaagagatattgctgttaggtggtatgtccatttagcttttctgtatgtgtcccagtgtggatgtgaaaagaacagattccagtgtccacttagtctgaaacgataagaacatcttgacttgctgacttgtattgggcaaaatgcaagaaaggatttacggatggctgggctgatcaccactaacagtaacgctgtcaacttatctggttcagcttcaccaagatcaattgctcaccattcattgtctagaaaaatgatcgattctcaccattgggttgttttctggccttctgtccatcaccgtattctcctctgaactgactggtttgaacgttattttcacggttgttctatcttttcggaatgaaataatattaccttttttcaacttgtgcactcatgcacaattgcacacaacatattgctgcacttgtagtcctctcctctgccagcggaattgcagtccagccgcagctttctagccaagagatgttcagaactgcaattatatgcttcaacagattgaacatgaatatttgcctacatctacatgaatttggtcttgagtttaccctttcttgagttaaatatgcaagaacatcaaagagcaaccaacaatgtcgaaactaataaccgaatgagaagattcagatattcattattgtccattgatttaagatcaccaccttcctccttgggtgctactatttccaggttttgttggatcaacagtgcctttgttatataacatcatgcatatatattgtgcgattctgaccggctgattagtgattagtagcatttgtttgtagcgatgttattctttcatttgttggctcaaccagatccatgggtacttttatgttgaaaacatctacatagacgatgcttatgagcaatccagaaaacaaaaggtctattttgcattcggggaagtcatagtcaagtagcgtagcactgtgcccgtaaaaaatcagtccatgcacaattcacaggtttcgaaatcttagatagctatgaacacacattaagcatgtcaaaaatcaaatccatgggcacctaggttaaaaactttttaagaaaatattttttataaaaaaaatactttctcatgcgtgcagatgcagtaatactaatagaatccgtaagtaaaagtccgaactttcagatgcagacaagcagtgagtagcagtgactgaaacttgcatgtattattcatgttgtgtgttcaggcagagttggggatgctcgatcgtgcgcgcccgcacatggcggtccggccggcctcgcagcgaacatggcggtgtggtgggcaggggttcgccgtctcagacgaggaaagcgacggcggcgggcggccggcgacggcgagggcttggcgagcggccgccctggggagatcgtgggctgctacggccggatgcaacgtgcggcccatattgtatggcccatcaaggggattctctgtggaataagttcactttggttccctctatttgtcgcctagtctgattttcatcccttaattgcaaaagtgggtacgacaggtcccccaacttacgaaaccgtttaaataaggtccctcggtagtatttgacctcggttttggctgaggtggcgcctacgtggctaatttgactcggtcttcatctgacgtggcattgacgttgcgcttacgtggcaattcgatccaaaaattaataaaacctatgggacccacatgtcagtttcacacacacaataataaaaaaaaatggtggggcccacgtggaccccacctatcatcctcactaccccttctctctatcccctttctctctatcctctctctccttcttctctctatccctccctccctctctcccttgagaatggcgagcggcagcgagcggcgcagaggggcggcgatggagctgagaggcggcatgcagcacatgcagcatggcggcggcgtctgggacaatgcgcggttggtcggcggaggcggcgtgtcacgccccgaactagtaccgactggaactagcccgtgacgctccaaattaacctgttgatcgataccagtcccaggaaacagtgctggtatcacaaggagacagaatatcacagcaacagcggtctctttattatagagtagagatacggtcatgttggactacggacagaccccgagctcacaactgcattacaaaagggaaacggaagcaggacttggaccaaacaacacaggcgcgacttgggaactaggccgaaaccctaaaactcattgtagccggcttgctcctgaaagaacttctcatcagcaggatccgcttcatcttcttcagcaactggggggggaattatttatatagagcaagggtgagtacgggagtactcagcaagccaagggaaaataggtgtttaatgcaggcttcaaggagaggctgttgtttttgcaattgattttatttgaactcttttctaagaacgactaagtgagtgcttctcaaactacacggataagacagtgcgtctcgtccggtcggagtatgtgcgatgtatcagtctttagaattgaaacaaggttggcacccggccgacagcttttcaacggccactcgggccaacaacttttcaaacggccacccgggccaacaacttttccaaacggccacccgggcctagctgatcccttcagctacagatttttcaaacatcgaacccctttttcacaacagcaatttcacaagcagtagtcaaacaaaactacgctaggaatcacctcacatccgcccatgaccgtgggcacggctgttcgaatagtttgataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgttcggatgaaattccaaggaaacgatccttaagtgcaagagcgggaaaaccgtacacccggtacgttccccggttcgcggttttggaaattcatttagttcgcaagcaccgacccaggtgtcgggttttccaagtcttttgtaaaactccagttttacccaaattgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccgatctgccttgcagacgggacaacagattaagtgcgatcctatcaatgcataatattttgcaagcaatataattgaatttcaaatataggctcaagatgttcaaaggtggcttgccttgctcgagatctggagcttgatcctcgaaatcctcgcgctgcgggtcttcgggctccgaaactacacgcgaaacgggacaactcagcaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggatggaaaatagacttccctcgggcggctagggcgtggcccgagagaaagggcggctcggccgggcttaacgggccggccggcccaagaaggcggcccagagcggcccaagacgcgcgcgcgcgggagggaggagagagagagccggtggaccgggctcaccacgcccggtcccgggtgggacccgcttgtcagcggctcggctcaccgtgcggagggagcacgcggcgcggcgctagggtgggggagggacgcggtgcacgcgcgcggttcacggtggatgcggatgcggcgggcccacgcgcagcctcacggctcgcggtggaacgcgcgcacgaggaggggctgaccggggtcggctcgacccggtcttggctgagctggcgcctacgtggctgccacgcgagccggcgggaggtagacgacgacgccggccggaacggacggcggacgacagcggcgagcggcggagcgaaccacggcgatacaggcgaaagcgagcacaccggatggttgaacaggacaaggggagacgagccaacggctcggattcgccggaggatgcccgacggcggcgaattgcggcggcggcatccggcggcggaaaaagggggaaacggcgacgaggtcacgaggggccgattcccggcggcgagagcatctacgcggccacgggaatccgatgctagcgtcgaattgggcggagctacgccgagcgaggccggcgacgagcggcgcttccgagctcgggcggcgacggcggcgagcacccggcgagaggcggcaacggccggggcggcgccggctagctacggggaggctactcgtgctactaccgaaaactaagagggagaggtggagcgaggaggaagaacggagggagcactaccgcgatgaggaggggcgctgtgacgagaggccgacggcgcgggagtaatctctccggcctcgggccggggaagaggaagaagagggcgcgcccggagtccccttccgcgtccttgctcgtgccggctcctccgacacgcgcaacgacgaacggcgatggcgaacagagcacgggggcggcggcaatggcgcggaggcgatggaaggagaagagagggagggcgcccggggctttaagggcggcaatgtcggtttggaaaccgactttgggcggtcaaggcgcgagctggcgctcggcgctcgcgtccaaatcggcgacagggcggagggaggaggatgacgccagcggtgacggaaaaaggggaaaagagggagagaaaaaggggcttgcctccttgccgcttttggaaaaggaggaggggagcgggggcgtcgcggcagagggaggaggggctctgcctccgtcccttggtggcttgcgcgcggaggcggggccgaggcgatgacgacggcgatgacggcgggacggtttggagcggcgcgacgacacgggcgacaggcgcgggctggcgcggcagagggtgacggcggcggcgaccgggcggtcggccaccacgacacgcgcgcgcgggaagcaacgggcggcgcggcggtttgagaggcgcggctcgggcacgcgcgctggctag

SEQ ID NO: 32808 - DNA, 7438 bp, Oryza sativa
ggccgagagggattcggcccatcgaccctgggggaggcaaaatagacttttgcggagggatttgatttggaaggatttggattcggaattggactcgacgatagatcggggatttgagatcttgagatggcacggacactagacaacaagcaaagaaacatatttcgcaattagggtttttaagagataattttcccgctaggcgccacgacggaacgggcgctacacggcggcggccccttcatcgtcgccaacaaggggctcgaggtcgacgccccacacgctcgtgcagaggttgtgcacgcagcgttcgtgcggtcccacgaacacaccgggcgccgcgtgcaggtacttgcccttgagccacttcagcttgtagtacaccttggcttggtcaatgtgcagggagagggagcccctgatggagtcgaagagcgcgcccatgtcgggaggcgtgggacatggacgagcgcgcgcggaaggtggcggcgccggcgaggagcacgacctcgtcggcattgccccagagcttctaaatggcacccccgtgctgccccacggcagcgggcgcggtcacctcggtggggtccgtgaaccgcgctgcctgctccaatgtaacatcctcaaattttaatctaaaatttgactgcatcatgctggcttttgacttgaattaatcttaatttagcaaaatcaaaatcctttttaaaatttcctttttaatcttcatttttggttcaagtattacccctttaaaattcctttaaacctaccctataccatcgtacccaaaaatattctaattactcccctaccctaaactctagtgagtttagcaaatttctttcaaaatttaaaatctagaaaccttctttaaattacccttatatttgttagacttagttatattacaaaaccctagcaaaaacccttcaaaaacccctagagaaattcttttctccttaggcaaatttgtcaaatttctgaatttcactgttcattgcacatgagctgctcgatgaaatgcctagcccggccctagcagcccagcatccacccaaatatttgcaaagtctagaattgatccttgggggaccacacccatccaaaactgtggcctctctttgcctttccaccccctgccatgctgccttggtgccctgcgcgtcgtgccgccgcagccgccgcgcgtaggctccacgaccgcccgcgcgtgcccggccaccttggcgcgccatccatctgtccagtgcgcctcaaccaaccgtcgtcgcacaaatcttgtcaagacaaatccgggacggccaccgccacagctcgccgccgtctgccgccatgcgcgcccacccgatgtcgacgtcgaagctgacttcgcctctaccggggatgaaaccctccaaattcgccgccgctcatttaaacacaaaaggtgtaactaactttccctctctcaactcgaaccgaacgccgccgagccggatattttaccccttgccgccgccgcgcgtcgagcccgggaggacgccagctcaccgccgctcgtcttcacccccagttaaacccaaccgtcgtcggtaaatatctgaacatgatctcccgccactcaatttgctcttcccttccctctcacagcctttgccatccctgccaccccttaactccaagctcatccatggcggcattggtttagggaaaatgaagagtttgctttagggattactttcaatttgtcaacattgatgtgcttaagggctttaatagaaaaatcaacctcagaagaattatttcccaaagagacctcaatacggtttaaagacgaacaaaaactaagttgagaagcggaacaagaacttgtaaaaggctcattaggtgtaccttgaggggaagccaacaaggccggccttgccccataaggggcaaattgatcatccagattgatggctgctttcctcttcatcgctttcaacagagagtcatcatcggccgaagcgatgccgagggctgtctcggagttggaacgatcactgcggcgtattggtgtcatgttcggcgcaagcccgacagccactgcttcattgctgccggtcactggatagtgcgaaccagcgtgtcccgaagacttaagaagcattgccgcggtcatctccttttcaggctgcgccgacaaaaccatatcaccatccgctaccgtcaccacttgctcgccagccacctgctcgctacccgatatcttcttgtcgaccaaagtcggctttgtcagcccgacagtcgcccatcctgtggcttgtgcgtgctcccaaacaggggactgggaggagaatgaattggtgcatgtgttcaattgcttttacttgaaaactggattgtaatgaggttgagctaaaatagtttagaatcaaatttgtccaatagagcaggcgagcagcagagtggatgtgcctctaataattgaatagacaagaatgcagcaaatttcaagaaaattttcaatgatccacctagcagcacagcatcgtttcactagacaagtatatatacaagattatcccctcctccttttccgggcttgggaccggctatgtcattaaacacctcaagtgacataggcggagttacctacacacctacaagaagaagaagaagaagaagaaacacacaaatcattgacctctcagagccactcgttgacctccagctcatgctcatctccatggagctggcggtgttgctccggaagcccagggatccacagctgagagatctcctgcatacctttttccagcaatagccactccaaaccacccaactcctcgacatgcctcaaattcaggcattcatttacaaacagctctctcacttggggaaggttggagatcctctccaggccttcacatccttcaacttgaaggaaaccagagaggaatgggaggtcctccaccgtcttcaagcaacttgtgcatcttataaagaactccttcaagttggtggcctgctgtccaagctgtggtgggagagccctcagcttggggcagcccacaagttgcaacctcgtcaaacaaggcagcagccatgacgaccttggagttggagacggggcttcctcccccttttgcttcgaagcagcagttccatcctctcccccttccttggctgctgcagctgcttcctcctcctgcacttcttcttcttcaacaaaggaccacttgtcagactcgtaagaagaatggaggaaatttcagaaagttcagagtttcggttaactgaagatgcaaaggagggagaaaacgtttcatcctgggtaatgaagatctaagagatgagacaaagccacgtgttcgagagagggatccgacggtgttaacgtcatgagaagccgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagaggtatcagagcacgagcgaatccttggctcttggatctctctggtgaaggttggtggaaggcggcggcgagatccaccgtaaaattcctgagctaggagggattcaatccggaggcgagtggtgcttcagatcggacagcaagggttgggttgccactttcgtggtgtgcacctgtaaaatctccggcgcttctgatttgaggttggcggctgtagatccgactgcaggggtaataggggaggaatcttgaattctgaacctaacctgcaggggcgaaatggtgaccaagatgcgctcaaacgatgagattgtgggactggaggagatgaacgagtttcgctcagatgtggcatctctgaagaaggaagtagtagagcttaagggcttgaggtcagaggtgaaggagatcaagggccttctgctggagttgtgcaaacagaaggggaacgagggacaggagaatcctgtgggagatgctgcagcaaaagagaagagcacgggagaagcaggacccagtcgatctgtgcaggtaaccacgcctagtttgggagttcagttctctattgagccaaatactatgagcctatctgcacctatgggtcaagaagctagaccacaggggggagtcagtagtgttcagacagatttggggcaggtgactactgtattatcaaaacctccaccattcataccatttgccccatttccaaaccagagggtacctttcttaaactcagctccttttcaaactcaaacaacagttgggggaagagtgcccaattcaaattttcaaacacaagggacagccactagctcaggcactgggcaacaaggggttcacatattagatcatagcagacctggtggtatggtttatcaaggagaaaatcaacattatgctgaagctgtaatcaagggacctcggttggaaataccactgttcacaggagaagatcccattgactggttgaagcaatgtgagaaattctacgagattactgggacaccatatgatcaatgggtcaatctggcaattgcacatctgcagggaagagcaatgaagtggtttagaggagtaggtattccttggcagttgattccttggccacaatggtgtcacatggtgagcactcgtttttcggctgcaaatgagcatgaggcagtggaactattccagaatgttaagcagtatggttcaactgtggaacaatatatagataaatttgaggagtatgtggatctagtcaggagggaccatccttacttacaggaacagtatctgaatagctgcttcatcggtgggcttagagaggatatcaagcatgatgtgtgtgggcaaaaaccacaaggtctgttggagtcctattggtatgcaaagaactatgagaaggcagctaatgcaaggaaggtggcactgaatttcagcagaaacagaaatcagaacaccaatttcaacaatcttggcaggaacgcaaataatagaccacaaaggggtgatggtgagaagaaagaagacagaaaatgctggttttgtaaggaaccatggtttcctagacaccaatgcaaggtgaagcaagctatcaatgctttactggtagagaatgaaccttgtactgaagaggaggaggatgaatcaaaagagaaggaacaagaggagctggccactgaccaaatagaggcacctaagcaggagggagcacatgaggagttaatgagtgtgtcatttagtgcagcttctggcacaactcggcctgatactttttcagtcctaatcatgatcaatgggaaacaagcagttggtctaattgatagtgggagtactgggactttcatgacccatgagtttgcagttaagtgcaagtgtcctatagcaacctcgactattaagaaggtgatagtagcaggaggaggagaattgaaatctaatcttgtagtcccagaagtggcatataaaattcaaggggtgaaatttgttaatgctttcagcctgatcaccttgaagggatatgatgtaatcttgggggcagactagatttttcggcatagtccaattactttggatctcaaacagagggaactgtctatcaccaaggaaggtaagctagttgaatttcaggatttcactaaacctgggaaacatttcttaattgatggtcataaaatggagaagctgataaaaaagggagctgtggggtgtgtgttacaagtgaatgcgatgactgaagaagagaggaaggaggaggctgcagtgccagcagatgttcaggaagttttatcacaattcccaggagtgatgaaggagccaaaaggcttacctccaagaagagcttgtgaccatgtgataaacttgaaacctgggtcagaacctcccaaccagagaccctatagagtgccacattaccaaaaggaggccatggagaacataatatcagatctgatccagtctaaggagattaggttcagtgacagcccttatgcctgtccagctataatggttagaaaaagggatggatcttggagaatgtgtgtagactaccgacagctgaatgcccagacagtgaagaacaagtttcctatgccaattatagaggacttgttggatgagttacatggggctagaatattttctaagctggacttaaggtcgggatatcatcagattagaatggctgaggaagatattcctaaaactgccttcaaaacacacatgggtcactatgagtaccaagtaatgccttttgggttaactaatgcacctgccacttttcagtcactaatgaaccaagctctagcaccctttttaagaaagtttgttcttgtgtttttttatgacatcttgatttatagcaaaacaagggaggaacatatcaagcatatcaaggcagtattgcaagtcctggagaagaaccagttggtggtacggcttaagaagtgtgcttttggtctgagcagtgtggcttacttgggacatgtgatatcttctgatggagtggcaacagatcctagcaagatcagtgatatcatgaatcggaaggaacctaaaaatgtgactgaagttagggaattcttggggatgactgggtattatagaagatttataaaagggtatgggttaatctgcagaccccttcacgacatgttgaagaaaggaggtttcaattgggggttagctcaatctgaagcatttacagagctaaaagggaagctgtgtactagtccagtgttagccttaccaaactttgagcagccgtttgtgattgaagcagatgcttgcgaagttggtattggagcagttttgatgcaggcaggaaggccaattgcttattatagcaaggctctagggccaaaagcagcagctcagtcaatttatgagaaagaggctatggctatactagaggctttaaagagatggaggcattatgttttgggtggagaattagtcatcaaaacagatcagcagagtcttaagtacatgatgaaccaaagactggtggaagggatacaacacaagttattgcttaaactgatggaatataattacactattgagtacaaggctggtagggagaacttagtagcagatgccctatctaggagcccgaaaaacaaggaagaagtgactgaactttgtgcagctattgctgtggtggtgcctgagtggatactggatattaaaagaagttatgaagaggatgttcaagctcataagttgctgagtttaattggcacagcaggggatccagaaggggagtataagtttgaggctggaattatgaaatataaaggaagaatatatgtgggggaaacaggagaaatcag

SEQ ID NO: 32809 - DNA, 8670 bp, Oryza sativa
  unsure (1)..(8670): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttgggactgggggagttggtaagacaacattagctcagaaaatatacaatgatagaaaaataaaaggaagtttcaacaaaaaggcctgggtttgtgtttccaaagtgtactctaaagcttctcttttgagagaacttcttcgaattatggaagttcatcatgatcaagatgaatcaattggagagctccagagcaagcttgaaatagcaattaaggagacaagttttttccttgtgttggatgacatgtggcaatctgacgcatggacaaatttattaagaattccgttgcatgctgcagaaatgggagcaattctcataacaactagaaataatattgttgccttagaaatcggagtggaccatacttatcgagttgatttgatgtcaaccgacgtaggatgggagctactttgcaagagcatgaatatcagtgaaagcatagaattgcaaactctgcaggatgttgggattgagattgttcgcaaatgtggttgccttcctcttgcaatcaaggttattgctagagtgttagcgagtaaagaacaaacagagaacgaatggaaaaaaatattgagcaaaaatgcttggttcatgaacaaccttccaaatgatttgagaggtgctttatatctgagttacgatgagttaccacgtcatttgaagcaatgctttctttattgtagtgtatatcctgaagatgcaaacatttaccatgatgatcttacaaggatgtggatcgctgaaggctttatagaggaccatggaggtcaactactagaagaaacagcagacgagtattactatgagctgatccaccggaaccttcttcaaccagatggtttatattatgaccacagcagctgcaaaatgcatgatcttttaaggcagcttgcttgttatttgtcaagggaagaatgttttgttggaaacccagaatcattggtaggtaacactgtgtctaaacttcgacgtgtttcagtcgtcacagataagaacatggtaatgttacctagcatggacgaggtgcaatataaagtaaggacatggaaaacttcttatgagaaaacactcagagttgataattcatttttcaagagatttccttatcttcgtgttttagatttgactgattcatttgtaccaagcatcccaggttgcatcgggaatttgatccatctacgtttgcttgatcttgatggtaccaatgtatcttgtcttccagagtccattggcaacctgaaaaatcttcaaatattgaacttggagaggagtgttgctttgcacagtcttccttcagcgatcacccaactgtgcaatttaaggcgccttggcctcaattattcaccgatatatcaagttccaaaagggattggcaaattggaatttctcaatgatgtagaagggtttccagtctatggtggcagtagtaatactaaaatgcaagatggatggaacttggaagagttggcttatctttaccagctaaggcggcttcatatgattaaattggaaagagcagcttaccgcactacttacccattgttaacagacaaagggtttctgaaatttttgtatctatggtgtactgaacgtacagatgaaccatacacagaaaaagatttcagcaatattgagaagatctttgagcagctaattccgccgtgcaacctggaagatcttgctattgttaaattcttcggtcgccagtatcccttctggatagattctacccatttggcttatgtaaaatccttgcatctcttcaactgcaaattctgtatgcaccttccaccagttgggcagctacccaacttgaaatatctaaaaattgagggagcagctgcagttaccattattggacccgaatttgctggccacagggcgagtaatcttggacgaacagttgctttccccaagcttgaagagttgctcattagagatatgcccaactgggaagagtggttctttattgatgaagcaacgtcaactgctaaggaaagggttgatgatggagattctgcaataccaaaagagaaagcattacctccaaggatgcagatactgtcacggttgaggaggctggaactttctggctgcccaaagctgaaagctcttccacagcagcttgcacagattaacagtctgaaggagatagagctaagatgggcaagcagcctgaaggtggtggagaacttccccctcctctctgagatgcttttgattgcgacatgtcaagccctggagaaagtctctaaccttcctcaagtgcgagagctgcgcgtgcaagattgtccaaacttgagacttgttgaggatttgagcactttggagcagttgtggctttatgaggatatgcatgaggtctctacattgtgggtgcctgggcttcaacagcagtgccggcaacatcatggagaggatcttgaagtctacaattggacatagtaataatgtatggatgcccaaaattatttggacgcttcagttgtttgatgcaaggtatgtgattttatatactctggattcggattgcgcccattttttggcgtgctattgtgtacatagatatatattttttgctttaccagttctcggtcttgaggatgaaaggatctagtactttgtaatatcggatattacagatatgacaataatcccaaagatatggcagtataagaactaaaaaactgtacttctagtttgttctggtaatcctctattaggttctgcaacttccatgcagctcattatcagcacatcgaccttctactgagcaggaatgaatgaatggatcaacgggtagatggtaggagtaccagactgactgtgtgtatattcagcaaatttagtctccctgatgtttacagcctaccttaactgaatttcacatcagcaatgattgcgtgcaaggccctttttcctccaccagatgatgcttaaggaccacaaaatacatgtatatctcgatgaaccgaaaataaaagcattccctccattatccaacatcgttttttatcgagtccatccttctccatttaaacactgaacagaacagcttgttactctgtcatcaggagagatattatgaccaatacccccaggttttccccttgttattccgtattgttgaattaactgtagttttgatgcattcatgtgttatgcagggggatgctgatcagtgccccttttggatacttcaaccttcctaatgttccatgtaagctgttttcctaatttctcccattgtaatctgctctactagcaatggcttatctgctgcatctcctgtacaggattcagaactcaagttcttgccgcaaaatggtttctgtacacacaaaaatggctaaaatttcaaatgccaactgcgattaacagcagattgagttgctgatggaggtgaaaactcactatgctttagagttcgctcccaaatcatcaaccctcttatatggactccgaaatcagaatctgagttttgtgttcagttatttcagttcagtgatctagtttcatctcaactgttccgagtaattaacaactggagtagaaattatccttcccctgaactgaatcacaaatgcatcgcaaagcaatcaaagctgtggcgaaattcatctatctagcgacgagaagagaggaagggagggaggcgtcacgtacctgggttgaactcgaggaggaggaagaggccgcggcgtcgaccccgggcgccgtggcggcgaagggggcccatggagcgctccaacttctcctccgtcggatctctgtcgctccctgcggcccaccctccagctccgcctccgcctccgctccccgacgccatcgccgaggtggggggttggatggccgtaccaggcgctccacgatgtacctcactcactgactcatcggagaactcgcccgcagcaatggtagctcccttctccaccatcaacttcgccactcgtcggagcgccgccgtcgccgtcggcgaccaacgcgcccttttccaacgacaatacgagataatccgagggcttattcgaaaatgatcctccaatgctcaggcgcccttagatatcccggcccattaattagggcccacacgtcatccgcaaaccccttgatggcccataaaatatgggctccacgttgcatcccgcccatgttcacttgcagcacgttgggctgtgaaagggtccaaagtccaagtatcgccccagagacggcccgtacactttgggcctcacattgctcctgccctgcgctgacgggccgcatgtccgcgtagtatcgtcccggcccacaaattaaatggaatcgcttgctggcctacgcccattagtcggcccgaccgcaagagcgatagtctcctggatgatagaatccgccgccatggcagccgctcgccggagctccgccgactggccacggagctcctctccggcgaagatttgcatcacgtaggttcttcgagtcttccctttccataatgtgctttggctctttcatcttcctctctctgtctcacagatcagacaagtgcaaatgagagatgctgtactgctgagtaagcttcagatactgttgtgttaccaaaaattatctcgggaaaccaacacttgacgagcatgtcaatacctattgatgagagatgttgtatgtactgctgtttaagctatagaacctattgatgttatacagatctgagtgcattttttttctttgataatgtcaggtgtgagctcatgaaactgggattgtgttctgttcgtagcatcctcttctttcattctttgttgtgaatcaatggtcctgttgaagtcaccaattggatgctttgttctctatgttctgcttctgtagctggatgagtatcagtcactgtatctgaacacatacagagtgaactctatggtttcagagcaggtatgttccttctttgacatggtcatcaatctgaaagcatgtcctccactagcatgtgcagtagtatgattccatgatggaggaaacaaaacttaatcatgtgcacgtctttctttttcttttctaatcaaagtgcgcgcctgctttaacaccatggactataatattcacgtaaactaattataatcacatcaccacgtacgtccagtgcgcttcatgcagccacggggaagctgccttcttccaggtcaggattgtcgatcagagccaaaccaagcagtttgttcagagttcagaattacatagaaactactgaaatctgaatgctgaaaatgattttgttgttgcatgcaggcacagcgaggggaaaggaaggcatgacacttatcttcgtgtgctgcaaccccagctgcaatcacagatggagggagtgacatgtaaattaattgtaattaatgctactattatgctgcatgtaaaggcaatagagctttgcattatgccatgaattggtatatgtttactagtcaaatcgagggataagacgacaaacaatgagtatgagatgccattgagcccgtgacggaggaaacaaaactcaagcatgtgtatgctcacccctttgtaaaggcaataaagcacgcagctggtttcacatcatggaatcttggaagcaaactctaaattaatcacatcgaaataaactgtaaactaatcacatcgccagagcccaggcgccagctaatcgttgcaatatactattgcagctgttgatcagtgccctagaatatgtgagtgtagctaatagaagtacgaaaaggaaaacgcaaagttccctactaatctgtaaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaatagtagacacattggttggatcatgcatcaataagttgcaagcgatcattacagacaagacaatactcattttaggggtaaaagatgagcttgaagaactgcaacgaagaacaaacgtcataagatcttctcttcaggatgctgaggcaaggaggatggaagattcagtagttgaaaaatggcttgaccagctaagagatgttatgtatgatgttgatgatattattgatttggctagatttaaaggaagtgtcctactgcctgactatcctatgtcatcgtcaaggaaagcaactgcttgcagtggcctttcactttcgtcctgcttttctaatattcgtatacgtcatgaagttgctgtaaaaattagaagcctgaacaaaaagatcgataacatttcaaaggatgaggtatttttaaaactcaaccgcagacatcataatggaagtggttcagcatggacaccaatagaaagctccagcctagttgaacccaaccttgtgggcaaggaggtcatacgtgcttgcagagaagtggtggatttggtgcttgcacacaagaaaaagaatgtttacaagcttgctattgttggaacaggaggagttggtaagacaacactagctcagaaaatattcaatgataaaaaattagaagggagatttgaccatcatgcatgggcttgtgtttccaaggagtattctagggattctcttttgagacaagttcttcgtaatatgggaattcgatatgagcaagatgaatcagttccagagctccaaagaaagattaaatcacacattgcaaataaaagtttttttctggtgtcggatgatgtgtggaactctgaagcatggacagatttactaagcactccacttcatgcagccgccacaggagtaattctaataactactcgagatgacactattgctagagtaattggggtggaccacactcatagggttgatttgatgtcagccgatgtaggatgggagttactttggaggagcatgaacatcaaagaagagaaacaagtgaaaaatctacgggacacaggtatcgagattgtccgcaaatgtggtggcctacctcttgcaatcagggctattgccaaagtcttagcaagcctgcaagatcaaacagagaatgagtggagacagatattggggaaaaatgcctggtccatgagcaaacttcctgatgaattaaatggtgctttatatcccgggaaaccaacacttgacgagcatgtcaatacctattgatga

SEQ ID NO: 32810 - DNA, 2514 bp, Oryza sativa
acaaacagagaatgaatggagacggatattggggaaaaatgcctggtccatgagcaaacttcctcgtgaattaagtggtgctttatatctgagttatgaagtgctgccgcaccaactgaagcaatgttttctttattgtgcacttttccctgaagatgcaagcattttgcgtgacgatcttactaggatgtgggttgctgaaggctttatagatgaggaaaaaggacaattactagaagatacagcagagagatattattatgagctgatccatcggaacttgctccaaccagatggtttatattttgaccacagcagctgcaagatgcatgatctcttaaggcaacttgcttcttatttgtcaagagaagaatgttttgttggagacccagagtcactagggactaatactatgtgcaaagtacggcgtatttcagttgtcactgagaaggacatagtggtgttacctagcatggacaaggatcaatataaagtgaggtgttttacaaacttatctgggaagtcagcaagaattgataattcacttttcgagagacttgtatgtcttcgcattttggatttgtctgactcacttgtacatgacatcccaggtgcgattggaaatttgatttatctgcggttgctcgatcttgacaagacaaatatatgttctctcccagaggccattggctcccttcaaagccttcaaatattgaatttgcaggggtgtgaatctttgcgcagacttcctttggcaacaactcaactatgcaatttgaggcggcttggtcttgctggtactccaataaacctggttccaaaagggataggaagactgaaatttctcaatgatttagaaggatttcctatcggtggtggaaatgacaataccaaaatacaagatggatggaatttggaagagttggctcatctttcacagttgaggcagcttggtatgataaaattggaaagagctactccttgcagcagtagagacccatttctactaacagagaaaaagcatctcaaagttctgaatctacactgcactgaacagacagatgaagcatattcagaggaaggcattagcaatgttgagaagatctttgagaagctagcacctccacacaacttagaagttcttgctattgtgaatttctttgggcgaaggttccccacctggcttggtactaaccatttgtcttcagtgaaatacgtgctcctcatagattgcaaatcttgtgtgcatcttcccccaatcggacagctaccaaacttgaaatacctaaaaattaatggagcaagtgcaatcaccaagattggacccgaatttgttggctgctgggagggtaatctcagatccacagaggcagttgctttccccaagctcgaagcgttggtcattgaggatatgcccaactgggaggagtggtgtcagaaccctgaaccagaaatggagaaacagagtagcgatttgtgaattttggtaggatttgggtggccgccgcaagactatctcctagggttctaagttagctactcctaagacaaatagaaattgtgattcttcttatcttcttcccacagcaaaagccagcttaagtaagtttacagcagctaaaattattacagtgaatgtaaagagcaaaacgacaagctttgatagctacagcggcttctcatgacgttaacaccgtcggatccctctctcgaacacgtggctttgtctcatctcttagatcttcattacccaggatgaaacgttttctccctcctttgcatcttcagttaaccgaaactctgaactttctaaaatttcctccattcttcttacgagtctgacattactccccccttaagcccaaccttgtcctcaaggttgaaaatttggaaacactttctgaatataagaagcatcctcccaggttgcttcagccggagttaaattgctccacagaattagccattgagtgacagcaacattgttccttggaatcattctcctttgcagcactgctactggctctgttttgatttgaccatctggtcccactgccggtaaatttggcattggtacagcatgagtacccaggtgctttttaagttggctcacatggaagaccggatgtatagcagcttcttcaggtaactgcaatctataagctacagcacctaccttctctagcaccttgaatggcccatagtatttgcctcttaactttaatgatcctctgatcccaaaagcattttgtctatagggttgtagtttcagatataccatatctcccacctccagctttctctctgttcgattcctatcagcataatacttcatccttctttgtgcatcttccatgcttgctttgagtttctgaactatagtctctttctcttccagggttacccttgcttcttgagatacatcacatgggacagaaaattcactgatttgaggtggactgtatccataaagggccttgaatggagtcatttgtattgctgtgtgatatgttg

SEQ ID NO: 32811 - DNA, 15790 bp, Oryza sativa
ctgcccctctgctcttcagctgtatatatgcagctattctagcatttgatagtctccttagttgttcatgtcgtgtgcattgactgattgtttaatgatttatatgatttagttttattttcatttatgctgcatgtaagcatttcatcatggtcaagattttcataaaatggtggatatacattgacaaattcattagttgtccatttctttaatcctctcgtgatcttattaacatgcgtcctgtacatacggtgtattctagataaatgaattgtcctatatgtactacaacataatcatgtgcaatagtgttcctagctctgcagacaaagatagagattacttctactccaaaagaaaattgtatgggttatatcaccaaacaatgctatgatggcattgctatattcactatatgatagtagtaatatcacaaatgcatatatccatccaaggacttggggacaacataaatggtttagcatttggtacacaggctgcataagtgcacgactaaacataatggacttcgctaggccaagagataagtaatccttaattcagctcttgaatgtgctagctatgattggccgtgtacatccttcgggatgtagaggccgggttttatttaatccattatttaaaaatgcgctatctatgacgaagaccagatcacgtgcatttagccttcaagtctgcaagtgtgttctatgtcatatcaatgtgcacatttagtactcagtatcttataaaaacacaaatacacatgaattttcgcaagacattaggcaatagagtagtttttttagatttcacaaaaaataggtcaggcccaatgttacagattccttgcagcctgtgagcaggatattgaagatggaagggttgtgcccaacatctgttcctagtgtagggctcctaattaaggtttgtttggtgaaaaaacaaaagccacctaaatgtctttgtattggttcaaattgattaatatttttgttcgtattacatctgttataagcagaggatattgccgagcgacatgcctatgtatagtccctatgtgtcttttccttatactttttgtaattcacgtatgatgtttggtaagttcaattgtagaaaatagattgttgcaaaacggatgtcacttgtattttcttttccttaattaagttatttaattaccaaattgcttatgaatatacatccatgattaatttttgtgcgcttatttgtgttgtaggttaatcttgaagaatttgggctgcagtcacctgtaatctgtacttttgtctttacctagctactggtctttgaaatatattaaaaaaattaaaaaaacaaaaatatcaaaaaatgggaaaatgtcaaaaaaaaggttatattttctttagctcttgtaaaatacatcgtcatgttttcttagatgtgtgcgtttcttttctttttattttttttattgtaggtgtgtaggtaactccgcctatgtcatcttaggtttatctgaatgacatagccggtcccaagcccggaaaaaggaggaggggataatcttgtatagatgttggttgaaatgacgctctcctactatatagtagatcattgggatttttccgtacttttatcagattaatttcattttcaatgatggaatagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacatacactctgtttctctgttggacgaacctgagttggaaaccagtttagtttgagctcatttcaaccccttctttcaccagaagcaattgggctaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaacttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaacgcagcacaaagcaaagcacagctatagcgcatccagcgatgagaagaaaaagggggaggaaaacgaggggtcctgtacctcggttgtgctcgaggttctccggcgccggcgacgtgggactcggcggcgatttacctcgtcggagcgctcgctcgcttgccgtcgtcgcatcaacggcaatataaacatataatgtctccctgactcgtggggccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttacagaggaatctcaatctccaaactggtaggaagagagtttggtcgatagaagttgagctcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaaactagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcgggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagggattgagattgttcagaaatgtggtgggctacctcttgcaatcaaggttattgctagagttttggcaagcaaagataaagcagagaacgaatggaaaaagattttagctaattacgtttggtccatgtataaacttcctaaggaaataagaggtgctctatatctaagctacgatgatttaccacagcatttaaagcaatgttttctttattgtattgtatatcctgaagactggaccattcaccgtgattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaactgacaaaaagcatcttaaaagtctacatctatgctgcactgaaccgactgatgaagcatgctcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccaattggacagctaccaacttgaaataccttagaattgatggagcaagtgcaatcaccaagattggacccgaatttgttggctgctgggagggtaatctcatatccacagagacagttgctttccctaggcttgaattattggctatcaaggatatgcccaactgggaggagtggtcctttgtcaaagaagaagagttgcaggaggagaaagcagctgcagcagcccaggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactaattggttgggatttttcactggaataaactaatcattgggttgtacatccatgcttcttctctgctcttcagctgtatgcaactactctagcatttgatagtctccttagttgttcatgttgtgtgaattgtgattgtttaataatttatatgatttagttcttttttcattgagtttttctcccggccttccttttgtagcacgcggtactggtactgtgaggtaccagtctccatccggccgttgattgctgaggggtacgatgggtatcacgtgtggtccaaatagcgtgtgtgtctcgatatctctcgctttcccttctccttctgcatctagcgctgccgcagggcacatgagaaaaaagtcgaggtgaaggtcgaccccatcggccgcaccgccgcaggcagacgcagcaagggcgatggcatccgcaatcgtcccagaatcgtggccgctgcagttgtcctcgccagcgccacaggagttgtcgctgccgcaggtgtcatcgctgcagccgtaggtgtcatcatcgcggtcacaggagtcgtctcggcgccgctgcaagggccgtggctgcagtggatctccaggaccccatccgcagcatggtcgcaggagtcgcagcgttgagaggaatggatgaggcgccgccgcgaaggggaaaacgatgggacaaggggaagacgccagcatcgagaccaacgaatgccgccgccgccgccgtcgtattgtccgccacgcgccgccgtcgggaggaagcctagggttttgctactctgcggcacttccccaaacaaaccaccgatccaaacatccttccaaacgcgaaaatacgattatacccttccactatggctcactcgtgcttgctaccccacgatcaagctggtaccctgaggtaccatgtaatcgtgaccattcgatatgccatcattaatggatgggattttagtaccttgcggtacaaaaagaatgaccggagcaatgctctttttcattagtgctgcatgtaaccatttcaccgtggtcaagattttcataaaatggtagatatagatcaacaaattaattagttgaccatatcttttatccactcatggtcttattaacatcctgtatggtatgttaaataagtgtatcgtcctataggtactacaacatgatcatatgcagtagtgtacaaagatttgaagacagagatagagactactgctactccaaaacaaaactgtatgggttatatcgccaaaaacatgctatgatggcattgctattcactatatgtcaataggaatatcatagatggatatatccatccaatgatttgtcccaacataaatggtttagcatttggttcataggctgcaaaagtgagggactaaacatattgggcttcgttaggccaagagataagtaacccttaatttgactcttgaatgtaccagctatgatgcagaccagcttacatgcatttagccttcaatttcacaagtgtgttctatatcagatcatgcatgtgtgcaaaagatagcatttactatcttgtaaaaacacatatacacatgaatttttgcaagacattagacctatagaataatttttttttacgacaaaaaataggttaggcccaatgttacagattccttgcgacctgttagcaggatattaaacatgaaagggttgtgcccaacatctgtttctactgtagggctcctaattaaggtttgtttagtgccaaaagtatccacctaaatgtctttgcattggttcaaattgattaatattttttttcatattctatcagttaaaataagcggaggatattaccgacatgcctatctgtatatgtgtcttttccttatactttttgtaatgcatgcctgatgtttggtaagttaattccacgaaatatgattgttgcgaaactgatagcacttatatttatttccttaattaagttattaaaactgatgtctgatgtataaagtatatatacatccgtgattaatttttgtgtgcttatttgttttgtaggttgttaatcttgaagagttggagtgcagtcattcctcagagaataaaatgaaaaaaaaatcacaaaacatgaaaatttaaaacaaaaaaaaaacaaaagcatcaaaaaaaggggaaatgtcaaaaattgaaaaaaaaagcattttctttagctattgtaaaatacatcttcatataatttgttatatttgcttgcgtttgttttcttttaaaactttttttattgtaggtgtgtaggtaactccgcctatgtcatcttaaggcgtaactaaatgacatagccggtcccaagcccggaaaaaggaggaggggatataatcttgtatacttctatattgaaatgatgctctgctgctaaatacatcatttgatattttcttggaagtttctgcacttttatcaagctaatttcatcttcagtaatggatcagaatagttatggagagtcatccactctgtttaattgttcaacaaatctgattctagactattttagtttgacctcattacagtccagttttccagtaaaagcaatttggatgaacacatgcatcagttcattctcctctgtcggtctgtcctacatccttcagttatcagtgccagatcaatgatcacaagagttgatattttggagaccacaaatgcacaagtctgtttgttggaggctttagtatttttcatgatcaaaactggtgcagaaaacatctgttatcacatatcacgctatttaggttcagaacataattatgaagcacatgatcaacaaataaaaatgatgaatttaaattcatgaaaaatggaattggcaaaaaccagaaaaacagagaggcgtgcttgatgtcctgacaagaatgatttccagcgatggtcagtaattactgaagtacattgctctagtgaatctttacataatcacttcacctccatgcaagtttcttgactggaaaaaggtaaacatggaacagaataacaaactgcacctggagggggctactttatttttatttttttttgaaagataccttaaagcggatactgaactggactgaaattgccactgaatgttcgatcacattaagcctggcaggaaagcggagttctcaacaaacagagttggacaggaaatggtccagcagcaatgcaaacaagcaatgctgatccgggtaggaatgggcgagttcaagtcgttgtgtcacgcagggttcttcttccccgaggcgaagatcaagggacactggaagtggagcaagacgattaaggtcgtcgaaagcgagacgctcggcagcgctacctatggtaagaataggaagatcttacaatcgaattcagggcgttcaggtaaacactagacaaatcccaatcgccaaatccacagcatcctaaacgaaaatcaacagtgtttctcacagcaatgatctgaacgaaattcatcttcacatgcatatatatcacccatggccagcacccccacacatacatatcttattcaacaaaattacaagcagttccctgataaagttgcatattacaccaacaggttctgcaacttccatgcagctcattatcagaacatcaaacttctattgagcaggaatgaatgaatggatcaatgggtagatggtaggagtaccatactgactgtgtgtattgttaggaaaccgccggcccatgaaggcccggctcggttacccactaattaggcccatcactaaatatggaaggtggaagagggaatggctataaatagaggagtagagaggaggattgtacacttgagaatgcaatggatgaatgagaaaggatgccacaccctcatatcttgtgtctccacttttgtagaattacgcaatccctcttggactatctcggtacatttagtctccctgatggttacagcccaccttaactgaattttacatcagcaatgattgtgtgcaaggccctctttcctccaccagatgatgctttatgaccacaaaatccatgtatatcttgatgaacagaaaagaaaatcattccttccattatccaacatcgttttttattgagtccatccttttccatttaaacgctgaacagaacagcttgttactctgtcatcaggattggttcaggaatcaggagagatattatgacaaataccctagcttttccccttgttgtcccgtcatattgttgaattaactgtagttttgatgggatgctaaaaagtgccccttttggatacttcaaccttcctaatattccatgtaagctgttttcctaatttttcgcattgtaatctgctctactagcaatggcttatgtgctacatctcctgtacaggattcagaactcgagttcttgccacaaaatggttactgtacacacaaatctggctaaaattgtaaatggaaaatttcaaatgccaactgcaattaacagcagattgagttgcaattaactctcctatgctttagagttcacccccaaatcatcaaccctcttatatggactctgaaatcagaatcgagttttgtgttcagttattgcagttcagtgctctagtttcatctcaactgttccgagtaattaacaactggactagaaattattcttcccctgtactgaaactcactcactgactcatcgaagcgctcatacactctttgatgggccatacactttgggcctcgttttgctcctgccctgtgcagctgtgctgacgggccgcatgtccccgtagtatggaaaaagtacaccgaaggtccctcaacttgtcatcgagttacaaaattgtcccccacgtcccttaactaatcaaaaccggtcacaataggtcctttggtgtttttgactccggttttatcctatgtggcaactgactcagcatgggacccacgtgggtcccacatgtcagcatcttattccttcctctctctactgccctttccaatcccccttccacgggcgacgggcgtgcgcgggacggagaggcggggcgcgggcggctgggcacggcgtggccggcggccgaccggaaagaactgagcggcggcggcgggggaggagctaggcgcgagggcggtcgcggtggagccggtgccatcctcgcctcgcctcccgcacgcgcgcgtgtgcgtgcgcctcgccacacccccgccgcctaccgcgcgctcgcagccgccactgccgagcaaggcgaaggcgccatggcggcgctcacgcaggcactcccgtccgtggcacccgtgccgccgccgtcgtgatctctctcctcatcgtcatctagttccaaggaaggatttggtctgtgtctgtacatgactttttttttgttttgctcgggctagcttggccattgttagtgaattgatggtgaaaataaaaaagagtttattgggtaggtctggtgttgccgccaacgccgtcccgcgaccaggcagcggcagcaatcggagacgaccacgctgcggcgacaaaacagaggggaacacgcagcggggaacggaggggaacatgtcgatctggccgatgtcaaggttggtgggtaccagcgtggggttcacccgctcgacggcctggtactgcatcaggctctgcagcttggtggtggagacaatccagaaggtgtcgccggcgttgatctggtactgcataggcgcgtatgcattgggcgagtgggaggggcacccacactggagcggcacaagcagcggctgccccgccgctcgcgcgcaacccctccccccaccgaccgcgtgacgcccctcccccgtcgccgcttcgtgggtctcgtcccctccctcccccacgcacccgtccgtctcgcgcgacgccatcaccgctgacgccctcctcctctcccgcctcgcagaacgcagagcagagaagtgagagagagagagagagatgaggaagggagagaagaggggaaaagagagagaaggctgacgtggccacactgacatgtgggatccacgcgggtcctacgctaactcagccgccatgtcggacaaaaccagggtcaaaaccaccgaaggatgtaaagtgaacggttttgttagttgagggatgcccgctatttggttttgtggttggaggatgattttgtatctcgatgacaaattgagggacctttggtgtactttttcccccatagtatcgtccaggcccacaaattaaatggaatcccttgctggaccatataacatgggcctacgtcgcttccggcgtacgcccattaatcggcccgaccgcaagagcgatagtctcctggatgagagaatccgccgccatggcagccgctcgccggagctccgccgactggccacggagctcctctccggcgaagatttgcatcacgtaggttcttcgagtcttccctttccataatgtgctttggctctttcatcttcttctctctgtctcacagatcagacaagttgcgcatgataccaaattagagatgctgtactgctgagtaaacttcagatactattgtgttaccaaaaattatcccgggaaagcaacacctgaattcttttgatatcaacacatatctgtttgggacaatgttagatcagtgctcctgttgatgtcacaatccaattggatgctttctaggagtaaaatgctttctaggagtaaatgttctgtgcaatattgagttcaacacttcaatcaaaccagatggtttcagatcagaggtattctaaggcatagttatcaacaacacaaacttgcagaaggactatcaaactggaggaaataaattttggtcaaatagaaagaagtcatgaaaacaagtactcatctaagcaattactccagtaattatgtataatattctatgagaaatagttacaatggcacagactccaagagtttttgaagacttcgtgatatgttcatcagccataaattctagaattagaatgcgacatgactagcaagatccaaattctccaagaatgctctgtccttgtctctattgcccggctccttcacactgcagatgcaaagcagagtgaactgattggggtctggatggtcgggtgtgatcccattctctagactctttgagataacaaagatttgctctttgtcacctttaatctccttcttgagaagtactagaagcatctcagttgcctgcagcttagtagggttcaacgtggagaggaagatctgcaagaaccagataggcatcagccatgagtaccatgaagttttgccgtgaatggtaagctgattagaatcttatatagtcatatatatttacctttcttagttttctatgtaataagtgataatagaagaattttgttgttgctgagtg

SEQ ID NO: 32812 - DNA, 3389 bp, Oryza sativa
tgactgaacttttgcaagctcctgaatcacaggaggtagctgacagatactgtgtgtaccgcaacatggtgcaccacatcgccggggagttcaccacattgcttgacctggaaggatgtcttcttccaggtcaggattatcggtcagagacaaaccaccagtttcttcatagttcagaattacatagaaactactaaactctgaaaggtgaaagctttaaaagctttaaaccacagcgaggggtgaggaaggcatgacgcttatcttcgtgtgctgcaaccccagctgcggtcacagatggagggagtacgtggcatgcaaaggcagtagagatttgcgttatgccatgaattggtctatgtttactttgtcaacaagagtatgagatgccatgatcctatgacagaggaaacaaaactgaagcatgtgtggccttccttctctatctgtttttttttctaattcaagggcgcagctagttgactagttccacatcatggaatcttgaagccaacagtaaagtaatcacatagaagtaaactgtagatcaatcacatggaaataaactgtgaactaatcacatcgactagacaagtggacaagcacaaaacgttgggttgtggagcatagacaagtggacaataactcaaaattgggtcagcggtattaacgtgggaaagataaaagaaaagagtggttcagcacttgtctagtctgaatgttcagctagctatgcaatatatatatgcaaggtcttaccactccctcctgcagtactgttgctttgttccactgttgtgtgtgtggcattcttgtactgcatttctaccagctgtgggtaagctcaagacatatagctgaatttacttcctttgtttccttaagataatctgtaaatgctcgttttgattgcaggcacggtgtttcatcaggatcagtcgtgtctatttctgtctgccctgtgatcgcttgagacgaggtctgctaggaaggaaaatctgcttcatctgaataaacacatatatactgatatctccttgtagcagacactctcccgtcggtggatgtcaacacattcacctgtatttttggtattatcccattgatccttctagttaaccttctgaatcattcaagttttacatcggtataatgagcatacacttcacctcttattttcatctcccctttttgcagttgtagcagcacaatcagtggttctctcttgatgactggctcataatgttctgaaatcctttctacagttggcgtatccactgagtttcttttgatcttcactaatctgagtctgtcgagtatctaaagtagatgggtcagagcaaacttctagcttgtgcaagatgaatgctactatactattgatccttgttatgtgacttatgtcttttcatgctgaattatcactccataaggtaagatttgcatgcaatatacttgagtaaaacccctcaacttgtttccggttacttctttctcctcatttacctttaacccaagaagcttacccgaaatgtaaccccattattccagttctttagcttcagtatgctaacttgctcaaaactcatggcaaaacaacttattaaaaaccttaccgaaatgtaaccccattattctagatactctgaaactgattgaacttttgtccattttcagatcgtgtaattctcataagtaatttacttagaaattttggtgcatcaccatcaacgagtttctctatggcaaccatattgggttctttgattggatcatgcgtaaacaagttgcaaggcatcattacagaggaggcaatactaattttaggtgtagaagaagaactcaaaaaactgcagaaaagaatgaaacaaatacagtgctttctcagtgatgctgagcgaaggggaatggaagactcagcagtacacaattgggtttcttggctaaaagatgctatgtatgatgctgatgacattatcgatttggctagttttgaaggaagcaagctattaaatggccattcttcttcaccaagaaaaacaactgcatgcggtgggctttcacctctctcttgcttttccaatattcaggttcgccatgagattggtgataaaattagaagtctgaaccggaaattagcggaaatagaaaaggataaaatatttgcaacacttaagaatgcacaaccagctgataaaggttcaacatcagaactgagaaaaacatctcacattgttgaacccaaccttgtggggaaagagatattaaaagtttctagaaatttggtgtgccacgtgcttgcacacaaggaaaagaaggcttacaagcttgctattgttggaacagggggaatcggaaagacaacacttgctcagaaattattcaatgatcagaaattaaaaggaagcttcaacaaacatgcttggatttgtgtttctcaggactactccccgtcctctgttttgagacaactacttagaaccatggaggttcagcacagacaggaagaatcagttggcgagctccaaagcaagcttgaattggctattaaagataagagttattttcttgtgttggacgatgtatggcagcatgatgtatggaccaatctactacgaactccactgcatgctgcaacctcaggaataattttgataactactcggcaagatattgtcgctagggaaattggggttgagaaacagcatcgtgttgaccaaatgtcaccagctgatggttgggagctactctggaagagcattagcattcaggatgaaaaagaagtgcaaaatctgcgagacatagggatcaagattattcagaaatgtggtggtctacctcttgcaatcaaggttattgctagagttttggcaagcaaagataaaacagagaacgaatggaaaaggattttagataaaaatgtttggtccatggctaaacttcctaaagaaataagaggtgctctatatctaagctatgatgatttaccacaacatttaaagcaatgttttctttattgtattgtatttcctgaagactggaccattcatcgtgattaccttattaggatgtgggttgccgaaggctttgtagaagtgcacaaagatcaattacttgaagatacagcagaagaatactactatgagctaataagtaggaatctcctccaaccagttaacacatcttttgataagagccaatgcaaaatgcatgatctcttaaggcaacttgcttgttatatatcaagagaagaatgctatattggagatccaacatcatgtgtggataataacatgtgtaaactgcgacgcattttagttatcaccgagaaagatatggttgtcatacctagcatgggtaaggaggagattaagttgagaacttttaga

SEQ ID NO: 32813 - DNA, 25392 bp, Oryza sativa
gatgctaacacctccacacaacttacgagatcttgttattgggtatttctttggttgtagattccccacctggcttggtactacccatttgccttcagtgaaatccatgatcctcgcaaattgcaaatcctgtgtgcaccttccaccaatcggacagctaccaaacttgaactacttgaaaattattggagcaagtgcaatcaccaagattggacccgaattcgttggctgcagggaaggtaatctcatatccacagaggcagttgctttccccaagctcgaaatgttgatcatcaaggatatgcccaactgggaggagtggtcctttgttgaacaagaagaagaagaggtgcaggaggaggaagcagttgcagcagccaaggaagggggagaggatggaactgttgcttcgaagcaaaaggggaaagtagccctgtctccaaggtcatcgtggctgatgccttgtttgaggaggttggatctttgggactgccccaagctgagggctctcccaccacagcttggacagaccaacttgaaggagctccttataagatacacaagttgattgaagacggtggaggacctcccgttcctctctggtttacttttagttgaaagatgtgaagacctagagaggatctccaaccttccccaagtgagagagttgtttttaaattgttgcccgaatttgaggcatgttgaggagttgggcggtttggagcagctatggctggatgaaggtatgcacgagatctctcagcagtgggtccctgggcttcaggagctacactgcaagctccatggagatgagcatgagctggtggtcaacgagtagctctaacacccacttaatgtagatggtgcaaggtatgtacactaattgcttgggatttttactggaatatactaatctttgggttgtacattcatgctgctcctctgctcttcagctgaatgcatctattctagcatttgatagtctccttacttgttcatgttgtgtgcattgactgattgtttaatcacttatatgatttagtatttatttcattactgctgcacgtaaccatttcaccgtggtcaagattttcataaaatggtggatatacatcgacaaatttgttagttgtccatatcttttatcctctcatgatcttattaacatgcatcctgcacatacggtgtattctagataaatgtattgtcctatatgtactacaacataatcatgtgcagtagtgttcctagctctgcagacatagatagagattactgctactccaaaagaaaattgtatgggttatatcaccaaacaatgctatgatggcattgctatattcactatatgccagtagtaatatcacatatgcatatatccattcaaggatttggggacaacataaaggcaaaatttgccactggacacgcaaaaaaacgtgtaattggctgagagacaccgcgaaaacgtgacatggctgatggacactacaaaaaatgtgtaattggctgtaggacactcgtcgcattattttattatttccgggtcaaaacaggtgagatatttttctaaatgcccggattgccccttctctttccttctttaaacaccggtgggtcccatgtgtcatggacagtgtatgtttaatctaatttataataggtttttaaccacctggccccacgcgtcatggactaatttttgtaacaccctgaaaatttgaccaacaaaaatcaaagttccaaaaatatggaccttcaaaaactttttaaataaattgcatcatgctgattttgttcacctatttcatcggattttaatttcggagttcatagatcacgaataaagaatagttaattaggaataaaccctaaaattagattggcaagagaaataattaagatataatttaaaataaagattatgtgaggatagaaataaataaaacattatcacgaccatatttatatcaattaaatttaaatgtgatggaataagaattaactctaattaaattccaataaattatatataaaaataaaatatgggtaatgataatctaggttagagcaacacaaatattgtgtaaacttgatttgtgcaaaaattataaatattgggacaagatttgaataggaaaaacaaccaaataggaaaaacagaaaaaaattcactattcattgcgctgtaagtgttcgatcgcgttccctagccctaacccctcctctgccgcacgcgcctggccgccatcacgtcgccgctgtcgcccgtcgcgtcgtcgccttgcgccccgtgccgccgcgcgccgtcgccgtcgctgccgcgccgccttgcgccccgtgccgccgcgtgcgccgtcgccgtcgccgttccgtcgccgcgcgtgcgtctcatcgcctcgcgcctcgcgccgccgtcgccgctgtcgcccgtcccgtcgccgcgccgtcgtcctgtcgccgtcgcgtcgccgcctcgtgccccgcgcccgcgcgccgcccgcccgtcgcgtcgccgcctcgcgccccgcgctgctgccgcgccgcatcgtcgtcgcatcgccgtcgtcgtcgcaccgagccccgtgtcacgccgcgctgcccgcccgtcgccatcgccgcctgccgcgccgcgcgccgcctgtcacgtcgccataaggctgcccgccccgctccacgccctataaagcccgacccctcctcttctccaccccacacacatccccttcatctttcctcctctccctctcccccttccccacgcgccgccgtcgtcgtgccgccgcgccgccgccttcgagccgccgcgctgcgccgcgacttgcgccgccgtcgccatcgtcgccgccgctgcccccccacctcgcgtccaccgccgccgccgcccgggtgggcaaggagccgagagagagagagggagaaaggagccgggagggagagaagagagtaaaaaaaaagaaagaaaagaaaagagaaaagaaagaaaaggaaaaagggaaaagaaaaagaaagaaaaagaaagaaagaggaagaaaataaataggcatttgagtaaaatttagaggtttagaaaatttaaaataattagaatttaatcgtggattaattatagtcgtaaaattgcgaaatttaattatattttggtagcctctatgagtaatcaatttgcggtaggaatttagatttatttaagaactaaaataaaggtgttgaattcttaggaaaattacttaggagacacaaaatgtcttaggttgaggaatagttctatttcgcgaataatatagtggatataacaatcgactctcgtgctcgctttttgatttggtctttattggattttatttgaattcggaattcaaatcaattcttcgcacgtacttgtagagcccgagggagttgcggatccgagcgaaggtcaagacccgcaagactttgagcaaggcaagtcatcactattctttgagcatattgatcccgattgcaaaatttattttgtttacaaataagattggatgtgatgatgaacattccacttgtgaactatgccatgccttgattattgttcatctttaaatctttgtaaccataaatacgtatgagtccctagtcaactatgacacttgcttagaaatgctactctagatttatgcatgctcatactttattaaatgctatatgcttgggcaattacctttgggaagttaattgagatgcggcatgtggagacatgagcgccacattgccatgatatgatgacatgaattatgaaaataggaatgaaattaaacacttgttttagactggggcggacggtaatattgggtgatatctgggaaaggctagtaccgtccccggtcaattaaggaccgagccatgaagttaagcatgaaacgaccctgtacaaccacacttctcgtatggggatagacctagcggagtaaatagctgagcggaggcagtatccttgcatagtggtttcttgatgtttgaggatggggctctacagtggtaccgccattggtaggactgccatatgataatttagacataattataacttaatgcatgtgcgtgagtcttcccttcccgggtgcgccagaactcctctcgctgctagaaactgtgtacgcctagagtgcatgaggatgaaaagttcatagagcggatactgccgatgccaggttatcgaaaagctttgccgtgacacgtctcatgtgttgggacgaggctcatgtgttgggcagtcgcggagtgcgggtaaagtgtacatccactgtagtgtgagtaaaacaaatctattcgaatagccgtgctcgcagttattgagcaccgggacatgtattacacttagctagactctaaattcttaacttgtgtggaatgggatattgcatgatgatttttatgctgttggagccacttcctgagaggagggaaggtggacatcctcagaaaaccatgacaactcaatggcgggaagctatccttgggatcacaatggatggtggacagcaccatcgttgtttaaatatgaacactggtactaaaatttgctcagtcaatgctaggtcttaggcttgtgaaaagaattacaaaacttgctttgcgcaaaagaaccatagccatcctttgaaatacccctatcatgtgcattgttgatgtgatggcttgctgagtacggttggtactcacccttgcaaatataaacttaatcagaggccggagatgaagcttcggaggatccctgtgcctattaccaggagggtgatgaagacgatggtgctcaataggtcttagttacggtcgttgcctgtggcaatggcgtgccgctgccttaactctgctgccttatctacctctgtttttgggatgtactccggaccgctcggttcgatgatttaagactatgcctgcgggcttatgatgtaataatttgcactagactctcgtgtatgtgcatatggtatttcagctataaactcgtgtgtaccagactacttgatccagggaaatggtactgtttacacgattgattcctgttataaaaacgggggtccacaatttttttctaattagtagggtgattgctatttgctaatcataagtggggcccatatctctctcctatccttcttcttcttcctcacgcacgcgccagagtagaggaacggcgcgcggccggcgcgacgacctgagccaggacggctcggcgtgcagcagaaaaagcggcggcgctccgccatggtctcaccgccggagctcgtcccttacttgaccagagacgggacaaagacgggacggagaagcgcgggtgggtcaggatggccgtcgatgccttggctgccgtcttgtccgcggatggggtaaacgaagataccaaggaaggtctcatcgatgccctcatagccggcgatctgggccccatcatgaacacgctcatcgcagctgttcccagatctggtatgggtcctcaaggacgccggcaatctgctgcatggcggcaaccgtgcaggtgcgaggctgcccagctcgctcgtagatggtccggccaggcgccatcccgacgctcgcgcgagttcaccgtgggagacgactagaggatgagagaggcagtggcatccgcgccggaggccgtgggaaagttgctcgtgtgatgcaaggacgacgacactgtacatgggcccacatgtcggctgcatcgagaagagaggggcattcctgtcattttgaaaattttcttccctctttcggcatggaaattataaaataatgtcttcggtgtcctacaaccaattacacaacttttgtagtgtccatcggcaatgccaagttttacagtgtcccttagccaattactcgatttttgagtgtcctgtagcaaattttgcccaacataaatggtttagcatttggtatacaggctacataagtgcacgaccaaacataatggacttcgttagaccaagagataagtactccttaattcagctcttgaatgtgctagctatgattggctgtgtacatccttcgggatgcagaggccgggttttatttaatccattatgtaaaaatgtgctatctatgatgaagaccagctcacgcgcatttagccttcaagtctgcaagtgtgttcttgtcatatcaatgtgcacatttagcattcactatcttataaaaacacaaatacacatgaattttcgcaagacattaggcctatagagtagttttttagatttgacaaaaaataggtcaggcccaatgttacagattcagagattccttgcagcctgtgagcaggatattgaagatggaagggttgtgcccaacatctgttcctagtgtagggctcctaattaagttttgtttggtgaaaaacaaaagccacctaaatgtctttgtatgtgtcttttccttatactttttgtaatgcacgtctgatgtttggtaagttcaattgcagaaaatagattgttgcaaaacgaacgtcacttgtattttcttttccttaattaagttatttaattaccaaattgcttatgtatatacatccatgattaattttttttttgcggggaacatccatgattaatttgtgtgcgcttatttgtgttgtaggttaatcttgaaggatttggccgggctgcggtcacctgtaatctgtatttttatctttacctagctactggtctttgaaatattaaaaaaataaaaaaacatgaaaattaaaaaatatatatcaaaaaatgggaaaatgtaaaaaaaaggttatattttctttaactcttgtaaaatacattgtcatgttttcttagatgtgtgtgtttcttttctttttaattgttttattgtaggagtgtatgtaactccgcctatgtcatcttaagtttatctaaatgatatagccggtcccaagcccggaaaaaggaggagggtataatcttgtatagatgttggttgaaatgatgctctcctgctacatagtggatcattgggatttttttgtacttttatcatattattttcattttcaatgatggaatagttatggagacacttctgtagactcatccagtcttattgctctgttggacacatctgattctaaactaagcttgaccagaccaccagatctgagagttacgttgcaaattgagatagacaagtaggtaaaggaaattcagtgccaggcatgacaagaggcagggcaccccagataaggtgtgcaacgagacattcgagtctctgagctcatatatgcccaaagtcctgaacaactcgatacaattttgctacaagatcaaatcataacggctagatcaaggtaagttctatttttatgtcggtttggccgatctagctaatgaattgacaaaatataagtacagttacatacccactaatcaataaagacatccccatgctaaaacaagtatgaaagaaatgtgcatatccctcagtatctaaaagaaaatagttttaagttttagcctataagtttatcccacaaagattatttttacagtgaggttcactagatctctttaatactactttatatttttctccctccttctcttttttttctcctcattaatagaatacaatgttcttttagcctcctacttaatctatctttgatagctaaaactacattgttttagaaacggagggagtatgtgagtgacaggttacaacttacaacaatcattgtctgatgtgtcacttgcttcggttcacaataggctgtgaactttatgtgttgcttcggtttgttgttcccctattgttttgttgctagctgctatgcttgtcatcagttcctgtgatgaacgtggcggtctgaaactctgtaagcctgcaggtctcactctctgtctctcctcattcctgagtcctgacagcctgtggcccatttctgcatttagtcctaattaatgaatttacctagccagttgacaccatcaggagggaaaaatactgaagactctgtgaaccctgcaatctagtagtttacatgtttattcaaatgagcaaatattcaactccctcatggactctgaaataagaattgagttttgcattcatttcttgtgctcttcagttattcagttcagttctatatagtgtcaggactatcatctgaactgtttcgggttcatgaacaataactgttaagtccatctaataagttcagttattcttcccctgaatgactaatgcagcaaagcaaagcaatgctgaatcgcatccagtttatcttaatttgggttcctgtgcacacaatttgggtgaacttgtaaagttcaaatgccaaatgtgattagaagcacatttagttagttgctgatggaggtgtatagggcttttgtatgtatggattgtggtaaggcttgtcagaagttgtaattcctacctccagtttcagatacatggcagaatttcacctgatggcatttgatcgttatgttcagagatgctcagttgctcactactgatgctgtagagctcactcccccaaatttgcaaccctctcatgaactctgaaattagaatcgaggtttgtgttcattcctgtacacacttgagctattcagttccaattttcatctgaatcgttctgtgttcatctacaaagcaaagcacatctagagcgcatccagcgatgagaagagaaaaggggaggaaaacgagaggttcgccccaagatccggccgagcctcgtcgaacagcttcgcgctccgccacctatctccggcgccgacgacgtggggctcggcggggatttacctcgtcagagagctcgttcgcttgccgtcgtcgcatcaacggcaatgcaaacatataatgtctccctgactcgtggggcccacttgagggcaagaacgcaacaatgacgcgtgtctctcctgcttgagaactaaccagcagccgctcgccggagctcctgccggaaaccccaaatctcggcgcccgtatccggaggcggttcgtgtcccgttggttcttggagacttggactcctatcctcgttcagatcaggggcgctgttcagttcttgtttatccagcagggcgcaccgaaatttgcagaggaatctcaatctccaaactggtaggaagagattttggtcgatagaagtagagttcttgtttgttctttggtctgtagagttcactagttcagataatcatgtcatcaacaccatgaattgaaagagatgctgtactgctgtttattgtgtttactgtttaattcgtagtatccatcaaacctgtatctgtttgggagaatgttcgatcaaattcaactcatgaccaaattcgtgttaggcaaatattcacattcaatctgttacttcctccgttttacaatgtaagtcattatagtatttttcatattcatattagttttaatgaatctagatagatatatatgtctagattcattaacatcaactaggaaggaagcccgcgcatatgcgcgggcaatttatttattgtctataaaaagaatattaaaagaagccctatcacactatattcactgtaagaaatagatcatagattttgatagtactaaatgataagaatgtgtatcatatccaaacaaaaaatcactttgttccggttatatgtaaattcgcctatcacccctacttattattattgtcttggaaatatgagtatctttttaatagatagaattgtagttatacctaaaagtaaacccaatacaccattaatgccagaaaaagttaaatctccacatcatacccaagtgcctatgtctcacatgtgtccaaatctatatataaatatttaaaagtactgcttctaccaattaataggataaaaccgtttaacttatataagaatgcctctctaacgatcgggtgaagccgactatagccgttaaggtttttctttaatgccttaattcatggtctcgtattgatatagtcgtgctcctcaagtaggccagttaagctctattttcaatggtaacctgtaaaatcggaccacctcaaccgaataatgcatactcctgcatagtttactacaacgtagccaattgagattcatgcttggcaccctttagggaatgagtgaaaaaagatggaggtaatgaaaaaaaaggtttttttgtgtcttgagttgatttaatgtatagagtagacataatgtgtttatgatgttaatcaatggtactaaattttagtagtaaagacatattgtttaaaaaagattagtatggatccattcgactatctaatatcttcagtggcgaggatccacataaaaaatatatgctctcacgatgatcatttgctaacatatggttttgatatttttttcacttgtattatacatctaattcccctatgcatgtaagtagggtttaatatgcgttggaatttgtgctaatttgttaacactatttggatgagaccaacaaaaaatagatataatgtagttacgtgtatgttttttttttggggggggggggacagtagtctctcgtacatacgtttgtttttcttttttttggacaaaattttttctaatgtagggatagggtgtacgcatgtgtactcccagtgtgcttctgcacatatttatatgagttcatatgattgtcttttaaattattagtaaaaagaatactttcgagaaaatcaatgggaagagagtggagcaaagggtggcgtaaggcagttgcatatggcatggcttgttttaccacctcagtaggagtagttgctacatttatataccctcaatttgggaaaatcttagagctggaaagaaagagaaaactaccagatgggacggataatatacacactcttttttttctttttatatctcttatctacatacttacgtaggagttgtgtacgtacgtatgcacagaactatacggtttttagcacatagggattagtttagtatatctaatttaatggttgaaaataatggatcattgatttaattgtaaactgatggataaatattttacttttttatataatttttcatagattctctctaatttattagagcatcacgtggcatcttaggagtatttgtagaagtgtaggaatagtattactcataggtgtaatgtacttgtagtccactattgtttgtagtatattgtttttatattctatttacctataatttgttgatggttgcgcacttagtatcaccctttatcttcggtgttggatgacacacgtgctcattagatatcagctatcgtttggtgcattgtgcatggatatctcgtaagtaatattatttagcgatttgtggacaatggcttgtatatagaattatatatggagataagtgaggacatatgttcgatattttaggttatgattaaccaagaatattgtatactacatatgtttagtaccctaagtaacaaatttaagattgtgttctaaagtgcttatcagattggctactctcttatttatattgaacatgtttcccgaaattgctaaacatgtttcctgaaattgctaaacaatatattatatggtgcatgttttgcaaatactttttatataaaagtttttttttagaaagatcaactaaatttatttttgctttttaatatttaatacaaaattaaacatgtgctaatgacttgcattattccaagtgcctacataaactcacccaataagcttgatctaacgaagtttaaagtaggagataaaggacaacgacacgatgtaaaaataatatatttgatatttaatttctaataatatataaataaagaaaaaacagtacataataaatttactaacctcattttaatatattagttttttttacagtatggaatgagtaatttttgagggtgctatttataactgggttttttcattttcaaaacgcaggtctaatagtgtacttcctccgtataaccttgtaagactttctagcattgctcacattcatttagatgttaatgaatctagacatatatgtgtttagatttattaacatctatatgtatataggcaatgctagaaagttttacattgtgaagcggagagggtacatgttatgtttttttctttttccgggggtacgtacgtgtgtgtgtttttttctatatagtattcgtatgtgactgggtacgtacatattttctttttgtcaaatagtgtacgtgttatggtttttttttcttctccgccggcatgagaagtgaaagaaaagcgtacacacacaaaggggaaacggaggtcagatggatacgtggatagtacgtacgctacggagggatcatacttgcgttggacggatggatcgagattttgatttccttttaagataaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttaaatctaacgatcaaaattaatgggtccatcaatttaaaggaaaatcgacggtcagatttctctattttaatagagtgacatgtggcgactcgagagcgtttataggatgccacatgtcgatttaggagcgtttgtagaaagtttaatggacttttagtatataatagaagatagatagataatagatagatagatagatagatagatagatagatagatagatagaagatagatagatatgaatgtgggaaatgatagaatgccttatattgtgaaacggagggagtaatacgtttaactgcagttctcaacatctctcgatcgacgagcaagctgtggctgctgctgcaattcggcctgcaattcaagtgcagcaatatgttgtgtgcaatttgtgcattagtgcacaagttgagaatggtaatattatttcactcggaagagatggaacagttgtgaaatgcagaaccactcggttcagagaatagtcctggacaaaaggacagaaaatggtccaatggtgacaattgatcatttttacagtgaatggtgagcaactgatcagcatcgaccatggtgaagctgaacctgataagtcgacagcactaggggtgatgatcctagccacccataaatcctttcttgtatatttcctaacatatataagtcagcaagtcaaatgttcttatcgttttctttagtcgatggttcatcgattctgacatcaagacaagaagccaacatactgctagccatgttcctttcctcttggctcacatacggccatttgaatggattagattcagaaataatacaatatctcgtctttctttcttaattacttacatgagttggccggtgcgcaactctgccgccggctaccgcctgctgcgcagagatgcaagtgggtagtcccgctacccgtataaaaacccgcttgctagtatatttttcgtatggtagtacgaaatttagaagaaaaaatgaactagaagtaggataagcgggacaaaaaaaaaagcccgcttgcccggcccgcttgcatccctatgctgcgcgccaggttgagctcctcggccgcgagcgtgccccgggtccactacgctgcagctctccctccgctcgcgccttccttcgtgcccgatagatgcgaccgcgccctctggactccctcacccacctccgtgccccacgccggtcaggcggccaacacgcgcctcctccgccattgtcgacgtttgatgtcgcgattccggtatttgcatagtatggggatcgttggtactaggatatacgcgagactgaggtaaaagagatggggacgaggatttttatataggttcgggcccctgaattgtcaggtaacaaccctacatcctgttggccgaagccggtattactcttattcaccataatcacaccagtataatatgtggggtagcctatctaattgttgtcgacatggcggtctgaaggtctgactcgtagtcgacaacagggtaatcttcctcctcgaatccgtgcccggcgagatcagagatagcgctttcgtctctcccgacagtatccggagacaccgtaggggactagccatgcttatccctgaagttgatatccaacgtcttgtcttggcgtatgttggcttgtatgttgtggcttctgttgttccgtgtcccctctcctcctagggggccttgtatttatacccataggtgtctccttgtcctagtagaactagggaaaccaatatggatatagtccgagtaatccttgtcgtttccatgtagaactctggttgtctttccttatccagaactccctccatatctgaagtcagtttccgtattagacatggtatgtggtgggtcctgccgagatgtagtcgactactattaggtatgtggtatccataaccctgatagtagcccctgacttcaatgcaaatgaacgaattcatattctcgaccactgaccatggagtaactgttatcgagctcaagtgaccattctcggtgagttcagagataacgttagacttcctttatcagcctcgtgcgggcacctaaagggtttgtctcagtccatctccaacgtcaaccaagaaagtacagaacattcgactaagtctcccgtcttgctgtaatcgagaatttggattgaagtcaagaaattttatctcggcgggtacaccatctcttcaatccgtattccttgccgagatccaccaactgttctcgagcgatcgagaaggcgtagaatctgcgacggagccttgtcaacatttgtcgtactcgccttagtcgatcttggtgtagaaccatagagacatggagtcttccacaacgtcgaatagaattttcctgaaatcaatactcagaaaagaatatcaaatagaaatagcccccgggcgaacgctcaaagggtgacatgttatagtatgtatggaaaactgaaaatgagttaaatttacagaccaatgttttgtatatgagcgccttctctcttaccgacttcgatcagtcagtttgttgagtcatacactctccctagcccccagccttgtcgtcggagaatcgttctcggaggagaaggctcttggacccttgacctgccttggttgaacaagcactaattctagcccccagtcgtgaagttggaaaatccaatttccgattacacggcttggttaatacgcacggcgagaactcttacacgaccagatcttacgtggtcttttgtctctacaggatccgacaaggccttatcggctctaggcgcccccagccaaagttcccttaggttcctcggaggccttgtcaagacggcgtaaagggacatgaggataggtttcaatgctaggtgtcgtcatggtaagggatctctaggtaaaacacttagcaatattgtgtatctgatatcaactttgttcgagtagaggtaatgggagaatcgctacaccgttggtcaaaaaccagttgtagccccaactcgaccacttgaaacaaaggtagtgggagaatcgctacaccgctggtcgaggaccaggtagtagtcgtaactcgaccacttaaaagtggaaatagtgggagaatcgctacacctctggtcgataaccaggtagtagtcttaactcgaccactagaagtaaatgtacgagagatcgctacgattaactggttgagaaccagtgagtaggtgtctctcgaccatttggagttggtacgagggccgttatgctaccggtcgaagactagtcgtagctgtccctcaactatccgaagtcatctgaagtcgtggtgcgaggaccgttacgctattaccatagttgtacctcgaccatcaggatttaaggcacgagagatcgctacgtcctactggtttgagaaccatgagtagaattatctctcgagcaccaatggaagctgcggtgcgagagattgctacggtttacaggttcgagaaccagcgagcgagtagaattatctctcgaacaccaatggaagtttgcggtgcgagagattgctacgtacttgttcgagaaccagcgagcgagtagaattacctctcgagcaccaatggaggcgctagagttggtttattacatgtgcatctcatgtggccagcatgactcacatacccaacttatagcatatccggatgtccgttcgcaatcatgtcgggtgatcaagccgacgacgttcgcgaggaattatccgttaacaaccttttctcgagtagctcagccatggctggtgtcgcgaccgagaaaattaccttttcccgaacgctagtgtattaatccccgtcccaggaaaagccggggtacaccacacaaacatgaaacaaaaggcacatctttattatatcgataatatttacattattacaaaggcacttcaggcatgacaaacaaaaataaacagcagcggactagcgggcctacggctccatcttcacaggcgctcaactggggtataagccaggactccacctaagacttcttctccaaagcttctgttactgaagggggaaagattgagcaagaatgagtacaaccacagtactcagcaagtcacaccggaaatgcataattaatgcaagggggtacaaggggataataatataggggttaagttttgcagtaaacagcatttaaaagtcatttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaatcattccacattttagttattaagcaggttttaagaatttaaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccgggccgcagcccgtgtagccttcatttgtcctagagatgtccatcgacccccgactttgtccatctccatccgtgtacttttgtttataaccagactgagccacaaactaagccttacccacttgacatgtggaagtacggtagtgctttgcaacagaggcccgaagaccgaggtgctgctaacaaaaccatgcaccccgagcccagcctaaaaccattttgagggttttgaatagagggagaggtgtgcatccaattccacaataatccaaccattccatagtgtccaagtgacatgaatattcccaaagtctagagttataaaaccacctaatgttgcctagttaatcagcgaagcatctacctaaattcatactagtggaaccatgaatagagtatccactagctggggttttgtttattctagggtgaacaaggtaataataacaatagcaataataatgtcataacgaaggtaaataggcatggctaaataaaacagtgataacgcgggaatttaaataaagcggtaatgcattaatttaaatcaaaataattttataaactgggattcaatatgctcaagaataatgtgacttgccttgctcaaagagaacggccttccgaaccttcggcgacgatcgcgaaccacgcttcgggaacctccggaacgacagaagctacgcgaagcacacaagcaaagctacaagcctataaagaagcaataacaatacataaaaagaaagcacacggttctttaggttataataaacattaggagacttgaacgggtcgattcagagttcgtatgaccaagatatgatcatccgaagtttaatgctgttatatggagatttgcggattattataattaggctttgcaactataaaacatgtgaaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtagccgacaaacggactccactagacaccacgcgggctgcacacgtggaaaccacgtggctaccgagcgggcacactaacacggacactacacggtcacttcccgcacacgtgaacgactaccgacaccggtacacgggtaccggggtcgacaaccgcacaacgggtacggggcgacaacgaaaggacaaggacggggcagcgagaggacggatccttaccaccacacgacgaggcgagggaacgacaacgacgaacgggcgcggcggaggcggccgggaacgacggagacgaacggcgaggggacgacttcggtggcgatccttggacaaaggcgagacgcggccggcacgaggcttgacgacgcggagccgaggacgaagacgacgatggggctgctgcacacttgacgaaacgcgggcggcgaacgcgatcggcttgacggagggacgaacgccacgacgatgaggacgacgagaggacgacgacgacgacgaccggggccggcgaggagacgacgagggcagccggcggcagctgcatggagacggggacgacggggaacgcgccgctgcgaatccgacgacggaggcggcgccgcgagacgacgagccggcgaggacgaatgatgacgacgacgacgaacaccggcggtgttcgggtggaggggaggcgaggccgagggcgaccttgccgctatgatgccggaggtggtggtggcgcagcgagccgacgagccggggaggaggaaggggcggccgaagggacgccggcgacgacgaggatggagaggccggcgcaatgcttgacgacgcggtctccggacgaatcagagggcaggccggggtggaggtcgacgcggcgacgccgagggaggagacggcgcggccggcccacacctgagcggcgcggcaggggcggctggaggcagtacagtggcggcaacgccactggacgacggcgggaacgcgcctccggcagtcccgcgcgaaacggagggcaggctgtcgtaggctctccagaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatggttacacatagcaaacacaactaagatgaaagaaacttaagacttacaacaacttaataattacataggccgaccgcccaaatagacttattagagaacagcggaagcttgactacccaaacacaagcacaccgactaagggtataccccattaagttctcatcctagaagaagcaatcggaacccgcatcactcaaagactaagactaaacctgcaaacaaaaggttatatcaaacagcaagagtcagtacattaaacaagttaatgtactggcaagcacaagtcaatcctaccatactacatgtaaagcatatattcaaaggaagacaatatgtagctcaatttcagcataaagcaagttttgtttcgcaattcttttgtaaagaagttgatgcttcaattaacaaaacaagttttaagttttaacattaagtttatcataattccatcataatcaatctcttgttgtcatccttgaacaacaagtcataatatatcatcacactcacacaactcaacacgttttatcaatttcaaatcaagtcacatgttcacattttaaatcataaagcctatactcatgacacatcaccaaagcgctcatgaccgtgagcacggctaatcgattagtttaaagaactctgcagagtttgtacagctttacccacatgatatgaactctctagtttgttttgagtttgcaagactccaccacactcttcatgttgaatgtgatctagaggtcataacgaagcctttacactacttagaatctagccttacaccagcacgatacgtgttcctccatcctaggcatacttggaaatatgtctagaaccgttaagtggcgggcccacgccttaaacttaacgccgtggtggcggacacaacgggaacccacccacgtggcacaataccgttgtattggacagacttagtcacctaaactaccacgtcggggcaaataggaagttcctctgaatcatcgactaattcctcataattatcgactaactcatacacaccggcctaccagaatgcaaggctagtcctaaatagattaatcagcttaggccatcccatactagcacatgtggatgtacgaataactttaaatgggtgacacaagttcggtccttatggacttgggcaaacactccccctatcggtatgcaactaacactatatgcacaccacttgctgcccaagtataaaatcacattttacacattttagttcgcaaatacccatcatattcattttattccagcaaaggttcaagtatcaaaatcacattttaattatagatggaatgaacatttgcatatttctaagcatggctaagcaagtaattgcacatagagcatatataaacccatttgagcacaaagagtgtactctaaccatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccactccttcaccgattatgcaattatctagataaaggacacgatatccaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatactttggtaaagtgatttttactagattagacttcataggagtgtgaagttgtgttttctaagactaacacatttggtttcacaatttttggagttataatgatttctttatgcattttacaagttataacgtgttattggtgtatagtgttttatatgttcatgacttttgagttataggttcagaacatgctacttcctgtataagttgaataaaaggaataatttggttatctaaaacatttttagttcacatgtttatggtctttactagtatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatatacttatacatgtttatgtattaattaaacaacactatgtgtttaaattcttatttcactaagttaaggttttgatcaatgttctctacagaaggtgccaaattttattttactatgttgaagataactatttgctggttctatagaaactttgttcatttcatttggactaaaatgaattttctacaagttttacaaattaatggctgctctatgttagtaaatccttatatgaatatttagagacttttactacacagcaagtatataatattatttcataacttggaaatacttgtgttagtgatcctacataacttaagtttattcaaattgaagctaaattgggttctacatgaatttctaaagtttagcttatctaaaactagtcattttaaagataatagttttagaggcttttaatgcaaagtaagtaattacttttatttcacttaatcagagattgtatgatgatgaatgatgaatctgtagaatttgattttgtttcaaaatgagttgaaatgaattttctatgtattttataagtttgtacatgttttatgcatgacttatcttagataaatcttagagacattatttgtacagtaagtgtcaagttttatattcctggaataaagttcataacttcaagaatctacagaaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgatgtttctaggaatcaacccgcagtcctaggcccatatgtcagttactaacattttgcgcaaaaacctctggtttctcgggaaatagatcccgcagtcccctagttttaggtttgtatgcaaaacaatgcttgagttttagtttatttacagattattactggtcctacttgtaagtgactgttccagttgttaatacatccctgggagtctttaaatttcaaaagccatgcccttgctctggacagagcagagcagcagcacagccgtgagcttcacagcatcaccagtggcgaacaatggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcatgtgggttttgaggctcgatttaatcgtgcatgcgtatgataaggactctagggactactaggaggctcaccaagaatcaaacgcggctcggcgaagtcttggcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcggcggcggccagagcacgacggtgttccgagttgacgcggtcgcgttcccggagattggctgcactaaaagaggcgttcttggtggcgttagagacggcattgagagggaattacagaacgcttattgaacggaaatggagctcaccggatttcgacggcgtcgaggacttatctcaccggcgccggagttggcacccccgttcccggcgaatctgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgttttcttttagttgtctgcttcaaccgattaatttgagatatcaacatgagtgttaacatgttaccaaattacagaggacaagtttgtgctaatcactgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccatatgttatcacccaagattaactataggtttgtttagtgaaataattcttttagattatgctcatgggatctattatggaatgcaagaccaaaactccaaatgcacaaagaactcgagcctaggcatgcattatgtacatgtatgcttgatgacatttctagtctaatgttgggaatgaaaaggttttattttgttctcaaattttaatcatgcaatggtttaagttgatcatcacctaaattaaaacggaaatttttggctctcgaaatttggagaagttaacctctaactattttgacaagaaatcttaagtcctaaaatttcgggtatgttacacaggccgggggagaggaggcggctgcaacaccggggaaggcgacggcacggccggccggcgcacggtcgaggagggagaggcggtggaggcgcccggcgcggaggaaagagaagggcgacggcggggaggtggctagggaccacgggagaatgcgggagggggctaaaactggagaacggatcgagggggttccattttataggagaggagagggagccgggcacgggagagggcggaacggcgacgggaaacacggccggcggccatggaaagcggccggggaagacgcgggcgttcccggcgattgggggcacgattcaagggggaaattggggggaattgaagaggattcaatggggattaaaacccccgaatcaattttggaattagccaaatgaatcaagcggatttgagggaggaacggcgctagggttcacggg

SEQ ID NO: 32814 - DNA, 21796 bp, Oryza sativa
  unsure (1)..(21796): unsure at all n locations
cccgcgggccggggggagagagggaggactttgggccagacttggcccaaaggaggaaggaggattatttttaggtttttctttttaataaactttgataattgtttttgttgcttaataattattttcggtgctctgaaaattcaagtaaaatttgagggctccttttagaccaaagagaatttaacaaaaattctccgggccacatttgaatttttcttgtacgtattttagtgtttgccaatttcttttcgaattttaaataaattctattattccttttagagaatgatttttaattcgggatgaatttatcaggacgtgacagctggtgctatgagataggtcatcggtcttcgttggtaggttgggcgcgacgattctgcatttgtcgagatcgttctcaataatggggtgtactcgaccacaacctactcgagtgctcaattgttcctgaaaaatattttctagaaggcaagaaatatagcagagaatatcgagtatgtactcaaaaaactgcataaatcttctagtattatcaggatataacgagcagatgtaaatatcaggcattacgtgaaccgtaaacaagcttgatttgtacaaaataaaatagagcgagcccccggcattaaaccgtagtcggtttaacatcagggacactcgcacaacagatattgtacaaaaagcatgctctaggtaaacataattgatctgacaatatctgaaaataggtacggtaaattgtatataaaatattgcgtacctttgtagatatatgccggatatatctacggaataagtagatcaattaaattaattattccactaattaccttaattttccttggccggtcaatgcacagaccgtagctctgtacataccaatatgcatccgtatgcataggcatgtatgtgtacagcgtacaggggtgctggtcacggtagagtgcatccgatgcatgcgaggtgaagtcgggatctcgtcggaagacatactccggtcgggttagatcttcccacagccgaagttatcgagcagcttgttgttggagaatccatctcttaaacccatctcgtcgaaatcctgaagcaccaaaatccccctacctggcgcgcctctgtcaacgtttgatgtcgcgattccggtatttgcatagtatggggatcgttgatactaggatatacgcgagactgaggtaaaagagatggggacgaggatttttatacaggttcgggcctctgaattgtcaggtaataaccctacatcctgttggccgaagccggtattactcttattcaccataatcacaccagtacaatatgtgggatagcctatctaattgttgtcgacatggcggtctgaaggtctgactcgtagtcggcaacagggtagtcttcttcctcgaatccgtgcccggcaagatcagagatagcgctttcgtctctcctgacagtatccggagacaccgtatggggttagccgtgcttatccttgaagtcgatatccgacgtcttgtcttggcgtatgttggcttgtatgttgtggcttctgttgttccgtgttgtccgtgtcccctctcctcctagggggccttgtatttatatccataggtgtccccttgtccaaatagaactagggaaaccaatatggatatagtccgagtggtacttgtcgtttccatgtagaactctggttgtctttccttatccaaaactccctccatatctgaagtcagtttccgtataagacatggtatgtggtgggtcctgccgagatatagtcgactactattaggtatgtggtatccataaccctgacagtcgcccatgtaaccctagccgcgcgtgcgtgtgtgctgtggggaagcggcacgcgggcgtgtattggtaaataacagtggcagataagtcttccctctctaaatttatttttttattttcttctaaatctattcctcacagtgtgaatacaatagggctagacggccacttcgattttgaaaaagagggtcaaatgaacaaagttaaaaatatagggtcaaatttatagttagactttaaaatagagtgaaaaaaagcaattgtctctttgtcgttttccatatatatggtcgcaaacatttcagggctagcccagccttggctggccaatcaaagtttctacaattctctctcagttctatcttggtatatcagatcctcatcatcaagagatatttttcttaaccagcagaaaaaaattcgtccccatcttcgaatttggacgaaatacattgaaatgcttttaaatttagcattaataatatcttcaaatctgtccaaaaaacaacatcggtagtgtgcacttagaatcagtggagaatggacaagaggctagaaaacaacccaatggttagcattgatcataatgaagtgtcaagtatatatatggaagttagagttatatcagatataattgatttctatcatagtcttactagtcttacttatttttaatcttttcttatttctacctaagcatatattctacatatacaattgccctgaggcccaatacaacaaatccaatattcacaatatatgtcctcccattctattcaacacgaacctgagcctcatatgtcgacatgatagggttgatgaacatatatactacttcctccgttttataatgtaagaatgttataatgtcgacattatagcattccccatattcatattgatgttaatgaatctaaatagatatatatgtctagattcgttaacatcaatatgaatgtgaaaaatgctaaaatgacttacattgtgaaacggaaggagtattagacatgctttttaccctctctagtggtcgccaccctccccagccttttccttttttctttctcacttttgtaatctcttagccttcacggctattatacagtattttcctctcctttaatacaaacacaccatgctggggtttaaaaaaagacagtgatagagtattttgttgaacttagtcacccataattccagctacatttatcatcatagaaggaactttcatgcatatgctgccataagtcaataagtcaacgtttttatcgttttgtacaatggttcatcgatgctgacacctgacatcgataccggccggcaacaacaaactgattgcaactagaagggaaaatattagaaacaagaagctttagctttgttcacctacctactataccatcacgagctttaataccgggtagcaaaccttcccatatttatatatgcgatttcattcatataatatatactccctccgtattttaatgtatgacgccgttgactttttgacaaacgtttgacctttcgtcttattcaaaaaatttatgtaattataatttattttattgtgacttgatttatcatcaaatgttctctaagcatgacatacgtatttttatatttgcataaaattttttaataagacgagtggtcaaacgttggttaaaaagtcgacggcgttatatattaaaatatggagagagtataagccaatggatgcatggctttgtcatgtggatgagatttagctctccctcatctcacctcaggcccgtcaactcgtctcaggctactaaatagtagtgtagtaccttacacgaacttcacaaatctcacagccatctcctgtcctctttgtgcaaccgcatgagagcccagcaaatctcgtacagtatatggaatcaccaggagtgcgctgatcatcgtcttcctcacgatgggggatgccatggttagctgcacaaaaggcatctctccagtgaggtgagcctccctcacgacatacgtccacttgaacattttttttgttcttgtttaaaattatgtgtagcgattatacttgtgttcttgtatagcaattctacaaaactaaaggtactatttgattcaacaaaacctgcgaacagtatccaaaggggggcaaaattgaaggggaaaataaggggttgtatgcacgatgagtttttcttctttttgcacaatttacaattgtacgatgctttggtatagtaggagagcctagccgttcaaaagcatcttgcataaacagaaacttttaaacaaactacccttgctaaggctcatcagtacgctgatcaaatgtactcggtaagggatgcatggatattttcaagtggagctaatcatcatcttcacggttgctttgagaaccatatgactaagccttatcatcaagtatacagacaatcgacatgccttttaagaacttttttttgggtcatgcctgataacttctaccttacgtactacattatttgtgtaaggcacaatcacatggagttggtggcattatgctctcatgagaacattaaatttcatcaacttacatagtacggactatttacttccaagttgtgctccttgcatccttgattaatgggaacaactcagctcatggaatctcaaagtaaatggatcacattgccaactaatattagcaatatattactcctacatctcatgtcttgtcctgttcaatacacctaggcacttgacaattggtgacagttgcagttttccatgttgctaattactcccttagaggggtacatcagagtcaacacaatggaaggggaaaaactaaaaaagcatcggcgactttgtagacttgtatgcagtcttcatactttataatgtctcattgtacgttcttgatgtgatgcaagaccggtttctctctagtgtccagccatccctctgcttaatacagagttcatctctcttaacattgaaaaaaaatagagttcttctctcttcctagctcttctcttgatttgtccatgttgaccatgtcgccgaagatccatgatcaacgtggccatttctgttcttattgaagtttttttactgaagagatcttgttgttgggagttgggacttgggagggaccaatttttctgaacatatagcactctccttcagtccttctgcagcactctgaccaatggcatgataatttgtatccatatttccggttatttctcttattctctggttcatatggcgtaaccttaatttcttcttttccattgatgtgttttacttctaaccattggttgcaccagctttctattaatgaacttgcaattcacctgttcttttatttttcttctctttgcaggtgatctcaggttttatcttggtggtttcctgctgaaccttctgctatcgatccatcgaaaaatctagtgagttgatagttgcaggaaactgatgctatcaatccgttgaaaaatcaaatgggtcgatagttgcaggaaactgattttgcaagactatagctaattcttaccgtcggcataggattaatgccggaaataggtctgtaatgaaaggtaatgcttcttcacatcttggaatgttgaatgattttagtaaagtgaaagattctttctctagctactgttttgtgtgatcccgactgtgctttctgagcaattttatggtccttgaggaggtaccatgaagtaccattttttctattataaattttggtacctcatagtacctttacactaaaattttggtaccttatggtacctgctcggttgtggtanaattgctcgtgctttctgggtagcagcaactacagttgaactattaacatatttttcactttttgcacttcaattaagcagtgtctcaagttatctaaacatattatactttttctacaatcaaaatttggtgaaattgtggtgattggattattatcgttaggtagatacaatcatagtttgaattccataatctttttctcatgttttctaaacaaacaaacaaacaaacaaacggtttaatttgctgtcctaatatatatgagagtttttacgctccaggtactggtactgctaggtaccaaataaaatccaaccattgaatcaaaaggggcatgatgggaaaaaagaatcgatttgccgagcgcccctgcttctgaactgcttgttgactcgccatcgtcctcgattcttcgctggcacgccgccgcgtgagtgttcttcgacggcatcttctctgacgccattccttgccgccagcgccacctgtgtgttcttccgcggtaccactactagtgccacgacctttattcagctggtgcccggtggctgtgttgttatttctcgatccgtcgccgccggcgattaactgctcgttgctctacgcgatgccgattagtatggacggaggaggccataaatcttgtgataatgagaggataccgtgattgaaaggagtgagaggaaaaatcagtgcggatggttccgccatggactgagtagagaaaagaaaaaggaaagaaagaaggatgagaaaaaaaaggcagatggttccgccatggactaagttgaagaaaaaaataagagaagaaaagaaggatgagaggaaaaatcaaggtagaatggtagatggttccatcatggatgagtcgagaagaaaaaaaagcaaagaaaaaaagacagatggttccacttccggcatggacgagtaagtgccgtgccgtgcggcgaggatgccggtgacgggtcgaattcctgttgtcgagtcgaggtggggagatgaggctgtttgttcctcctcgctgcaatggatgggagaagaaaaggggaaggagcagtggagcacggtccggcgagcgcattgaatcaggattctagcgagaggtgcacagctttgaggctaaacacgaaattatggttttacccttcggatggttagtaccgggaggggtgagcgcttgtaccgctaggtactggatgcttgacagccgtccgatcatcctggatcgatggaccaaatttggtaccgcttccccgctggacggtaaaaagtctcggtccaacaaaaagtacctcgaggtatagtaccggtacctcacggtaccaaatcgttttcgatcgttggatttaacaatactcatcctgctcagctagatccaatgatcataaacgttttggtccgtgaggtaccggtacctcgaggtactttttgttagatcggagtaaatctcgtagaaaggaggaagtgagagaaatagagatggacgacttgctgtgataccggtattttcttgctgctgctttaatttgttgtatgcaaatttggtgattcatgtggattcgccaatttagtcacaaacatgtgattcacggcacaaggaaaaataccgttagtagaggtaccagtgaccaagtttggtttagggtttcgggttcagccattctagctctacatctatataatgtgcatacacttcacctttcttttctttcctccctttgttgcagttgtagaagcgtggtctatggtttcctcttgctgctggactcataatcttctgctgtatatatattctgtactttggctcattcaatcaattgtgtttggtcttcactaatctcactcaattgagatttgaagtggatgtgttggtcatgcaaactggttacgagatgatggctagcaactatttttcgagatgaagagggaattttgttaataattcagaataagagtacattcttcaggaactatttgctctatagaataaaaaaggaaatcaacatatcaatatcaacggcagaacgttttaaacattatgccaattgtgcaacctcatgagcaatgaattatgttttcctcatcatgatccggcaggacaattaaaccaggtaattgttcatcaaagtcgatgaggcaaactaagtaactttgcaatgtttgagcaatcaaacactaatattataggttgcttgatccaatcaacaggaagagctgaattattggttgccttgtctacacgttggccattcaacctgtatatgaggcctgcaaaattattattactatactttttttttctgctgaatgaaaacagtcagtaaggtaaattttgcttgcacacttcaaatatcgtattcttttctcttcatgatcttttgagacttcctttcaaacacatgagttttacaatattttcaaagaaattagttctattaccacagttcatgtgttccaaaaggaggctttacgggatgaaactagtagggaggtgtttctacatgacgttaattaccacaatgcgaagtcctgtcacgacttgtagaaatgttttttatgatactcgaagattgtctagactagtcatttcacactgatccaacagttggcattttttgaatcatattacgtcctatgcaaatactcactacatttctaaatatttgacaccattgactttttagcacatgtttaaccgttcgtcttattaaaaaacttttgtgaaatatataaaactatatgtatacatattagtatatctaacaatgaatcaaatgataggaaaagaattaataattacttaaattttttgaataaaacgaatgatcaaacatatttaaaaaagtcaactgcgtcaaatatttagaaacggagggagtaggtcttaaaaggaggcattacatttcaaacttgctattgtaagcatggcgacccaaaagacaactataatttttgaaataacgttatttggcacattttgaaattttaattacaaaatacaactgtaattttcacaaaatatgccaattctgttaacatcacttggcaaattttgtgaaccttctctaatttttcactatgttaacagaattggaattattgccagcctgcctttttttacattcatctggtattttggccttggtggatctccccgtttgtgtttgcctgatggcggcggtattagatgctttgattgtctcatgcatcaagaagttgcaggatatcattacagacaatgcaatactcgtgctaggagtagaagaagagctcagtgaactggtgagaaaaacagattacatacgatgttctcttaatgacgctgagacaacgaggttggatcatgaagcagttaataattggcttggacaactaagagatgttatgtatgatgtcgatgatattattgatttggctagatttaaaggaagcatcctactagctgaccatccttcatcatcatcaagcaaaccaacacgttgcaattgcccttcgtgtcattgtaatatttggacacgtcatgaggttgctgttaagattagaagcctgaacaaaaagatagcgaacatttcaaatgatgaactacttcaagatctcagacgtagaccgcatccgagaaatggttcgatatggacaccgataaaaacctccagcatagttgaacccaaccttgtgggtgaagaggtcatacttgcttgcagagaattggtggatttggttattgaaaataaggaaaagaaagattacaagcttggtattgtagggacaggaggagttggcaagacaacacttgctcagcaaatatataatgatgaaaaaataacagggaatttcgataaacatgcatgggtttgtgtttcaacagacagcacacaaacttctctattggaagaagttcttcggatcatgaaaattcgatatgggaaagcaaaatcagttgaagagctccaaaacaagctcaaatcagccattaaagagaagagttttttccttgtgctagatgatgtatgggaatctaatgcgtggactaattcacttcaaaaaccattgcatgctgcagccaaggggatagttatagtaactacgagaaatgaaaaagtagctcaggaaattaaagtggaccatacccatcaagttcatttgatgtcagaaaatgtaggatgggatctactttggaagagcatgggcataaccgaagagaaacaagttcatcatctgcgggacatagggattgagattgttcaccaatgtggttatctcccactagcaataaagatcatcgccaaagttttaattagcaaagagaaaacaaatgatgaatggaaaaggatattgagcaacaattcgtggtccatgaataatcttcctgatgaactaagagctttatatctgagttacagtgagctatcacaccaactgaaacaatgttttctttattgtgctatatatcctgaacattcaaccattaaccgtgatgatcttactagtatgtgggtggctgaaggcttcattgatgagcagaaagaccaactactagaagatacagcagtagaatactacaatgagctgatccattggaacctccttcaactagacctttcatattttgacctaggtgggtgcaagatgcatggtctcttaaggcagcttgtttgctatttatcaagagaagaatgttttgttggagatccagaatcacaaaatggtaatacaatgagtaaaatgcgacgtgtttctgtggtgacagagaaggacacggtggtgttaccaagtatggataagaagcagtataaagtgaggacttacagaacttcatattccaagtcactgagagtttacaatccacttttcaagaggcttacatatctccgtgttttggatttgactggcacacttgtacagagcatcccaagtcacattggaaatttgattcatatgcgtttgattaatcttgatgggacaaacatatcttgtctcccagagtccgttggtaaccttcaaaatcttcaagtactgaacctgcaaaggtgtaaatctttgtacaggcttcctttggcaaccacgaaactatgcaatttaaggcggcttggtcttcttgatacaccaataaataaggttccaaaagggataggaagactgcaattccttaatgatttggaaggatttcctattggaagtgtaacttataataaaaaaatgcaagatggatggaatttggaagacttggctgatctttcacagttgaggcggcttgttatggtaaaactagaaagatgtactccttgcagcagtgaagattcatttctcctaacaaacaaagaacatctgaaagttctatatctagaatgcactgaaccaacaaatgaagcatgttcagatgaacatgttaaacatgttgagaatatctttgagcagctagtccctccacagaacttgaaagatctatctattctgagattccttggtcagaacttaccctcctagctttgtaatgtctatctgccttcactgaaatatttgatcctctctgattgcaaatattgcatacatcttccaccaatatggcagctacccaacttggaacgcctgaaaattgtgaaagcaactgcaattaccaagattggacccgaatttattgggcaatttccaagatccagggaagcagttgctttccccaagcttgaatggttgatcatcaatgatatgcccaactgggaggaatgggcctttattgaagaagatgagatatcacttgcagcaatgaacgaaggaggaggggatggaactgctgtggccgaagaggaggagatatcacttgcagcaatgaatgaaggaggagaggatggaaccactgtgacggaaaagggggaagcctcatttccaaggttgtgtgtgctgccctctttgaagaggttggacattgataactgccccaagctgagggctctcccacaacagcttggacacgaggccaccagtttgaaagagctctcccttgtagcagcaagctgcttgaagtcggtgaaggaccttccatccctatctggtttcctttctgtttgtagatgtgaaggcctggagagggttacagaacttcccaaagtgagaaagctgtttgtaagtgtttgtccaaatttgagctgtgttgaggagttaggcagtttggagcagctatggttggatgtgaatatggaggactcatcaccgtgggtgcatgggcttcgagagcagtaccgccacctggatgtctacacgtggcctagagagtgagatgtgaagacccaactaaaagacagtagattagtagagacacaaggtaagggcattggctctgtatttgttgatacatatttttattctatcgttatctaaaatagtggaaacatattttaatttcattccaactttgcatattttcagccaaaatcatgcatgtctaatgttattctcacctgtacactttacattcattgatgttgtacactttgcatcattcttagtaaggagatcatcatatatattagacaaaatgtcaaactttcggtagttgttatgattaatatttgtacctatattactgaccttgtcacctaaaactagtacagaaatccttaaaactttgtgttgtaattattctcaatgtccataaccagtacagaaacaagtgttatagcattttataatctattatatcctaaagtacattaaacctcctacaaacgcttctaagccatcacgtagcactcctacgaacactcctaagcctccacatgacattctaataaattaaagaaatttctaaaaattccgagaaaaacaaaaacatcttgtcatttatctttattaaatctggtgaacccatcatttacaaccattagatctagtcgtcaacccgtgcgttgtatgggttattaaaatatttaagaaattcaattgtacatgtggttgaatacatgggttaaaatgattattttgcttaaaaaaatgttggaatggcggcattcgggcatccggtctcttgtactttaccatgatttgacttggaaaacagtgagggaagtctccacggttcggatataatgatgattaatccaaaactaattaattaattcaattaaaaatactcaactacagtaccatgactatagctggccaaatgggtggcccggcccaacacgcacggccccactagtggcacgacccactaaggcacggcaactgtagcaggccgtgcacgtggcccataaaaaattgaaaattgagggaaaaataatatgaagttaaaaaatgaatgaagacaggacaaacgtgaggaaaatttaggaaatatacgaaatatattagaaaatatatggtaaaaataggataaaatatgaaaaaaaataaaaaaatatgagaaaaatatgggaaaaattagaaaattgtagggaaaataaatgggcagctgggccgtgctcgtgccgacccgtcaacaggcatgccgtgccgtgtaagcccatgggctaaggtgctggcccaagcacgacacggacaaatgggccatgccggcacagcacacagtccgcccaacatctgttcctagtgtagggctcctaattaattaaggtttgtttggtgaaacaaaaaagccacctaaatgtctttgtattggttcaaattgattaatagttttgttcgtgttctacctgttaaaagaagaagaggatattgctgatcggcatgcctatgtatagtccatgtgtgtcttttccttatgccttttgtaatgcacgtgtattgtttggtaagttcaattccagaaaatatgattgttgaaaaactgatagcacatatattttcttttccttaattaagttattaaattaccaaaatacttatgtatatatacatccatgattaatttctgtgtgcttatttattttgtaggttgttaatcttgaagaatttgggctgtgcagtcacttgtaatatgtatttttgttttacctagttattggtctttgaaatattaaaaaaattttatttttttaaaaaataaataaaacaaaaatatcaagaaagggaaaatgtcaaaaaaataaaaaatatattttctttagctcttgtaaaatatattgtcatgtttcgttagattttgcgtgtgtgtttcttttctttttatttttttttgtaggtgtgtaggtaactccgcctatgtcatcgtaggtataactaaatgacatagccggtccccagcccggaaaaaggaggaggggatagtttggtatagatgtgtgttgaaatgatgctccgttgctagatcattgggaattttctgcacttttattagattaatttcattttcagtgatggaataattgtggaaacatttctggagactcatccacccttattgctctgttggacaaatctgattctgaactatttaagctagcttgaccagaccaccaggtctaagagctgcgaattgacaagtaggtgaaggaaattcagtgccgaccatgacctgatgaggagcaaaaatttttttcaagtcttggagcccaaatgtgcctgaagtcctgaacaacaagatacaattttgctgcaggatcaaacaattttgctcctctcatttgtttcttgtctttacctagttgctggtctttggaagattacaaaaactgaaaaaaaaaagagtgaaaagaacacgaaaattacaaaaaaaaagtcaaaaaagggatacagatccaaaaatgaaaaaaaaaacgtgtttttgttttttgtcttgcacgtgtgtaggtagctcctcctatgccatcttgggtgtgcatctttaatggcattgctagttccaagcccgaaaaagagaaaattgcatatgtaccatcgcgtaaaattggcttcgtaaaaataccatcacttaaatgggcttcgctagaataacatcctgaactgagtacacttcgccactttaccattttcatcatttcttccattttaaatttattttatcatctttgcatctctttttggactgaaatacccctaagtcatcaacgctgaagcacttctggtcccaagcccggaaaaggagcagggggtaatagtgtatagacattaagtgaaacaatgcgctgctgctatctagagcagtgaaagttctcttgaaaatttctgcactcttgtcaagttaattgcatttttattgatggaatagtttactgaaaaacacttctagacactcatccactctggtgctctattgggcaattctgtttctaaactattttagcttgacctcattgcaaaccagttttcatgtgaaagcaatggaggcgaacacattcaccagttcgtcctcctctcattccctgcatcctgtttgagaattgagaattgtgaacactgcggtgtggaggctgcggttcgtcagaagtttaaattcctagatccagtttcagatacttagcagcatttcacctgatggcatttgatcgtaatgttcagagaatgttatctcctaatgctttggagttcactccccaaattttcaacactgtcatggactctgaaattagaatccagctgtgttgcgttcattactgtaagagctctttttttttttaaacctaagccagcattgctggttttatattaagagagggagaaactgtacagacaagagacatcgggcccgaaacccatacagctgcatggttaattatggggaaccgacatcacagaggaaaacatgggacctaactacactactaacaacaacggcggagcccaaacgcaagacatcattgccaagctaaacacaaaagtggcacaacagctccgacatcatagaagaggtgttatcgttgccgagctagccggccaagcaacccagcagcgccgacttcaccactgcagcgacattgaagccacggaagttgccaaagcgaaagcagctccgacatccacaatggacatcagccaagccatgaaagagccacttccttcacatggccagcaccaactctttggaagagaccgcaacacgtcatcgttgtcaagcgtcgccgcaccccagcagcgagcagctccgacttcctccgtagaaacaaccgaagagtgtgtcgcccaccacaagagcgaagcgaacccaagaggcttaggcctcgccaagcaccaaggaaagaaagcttttgaaccgaagagaccctcaatagtcatcgatgtaaaggaacttccccgaagcgacgcccccaaggaggacacgacgcgtaacgccgccgccgctcgtccgaagccggagcaaggttttcacttggagatttgtggggcaaatgggagagcacattgacaacgccttcaagaagggaaatggcgccaatgggtgcgtcgtcgtcatcgagccggccaaaggtacagcaaggctttcgccagcgtctgcacattacccacacaagcacccccacatcgacgaccaaacgatagtccaagatgactcacaagcattccaccctcgacgcatcctaccatcgcccacactcctctgctgcaccgaccagaaccggccaaggcggccaaggtactggtcgtcgaagctccccgctgccatcgcctccacgagcacccactccccgctatgccgctgccaccgtcgccacaagcgcccgcagccccgctgcacctcgtcaagacgccagtgggcgtagctggaggttgccactgcgccgacaagggcctcgcatccgcctcctcgcagcaccagacccccgccgtcgccggcctcccactgccgctctggcgagggcacactggtccccaccttggcagcacgccatcatccagccaggagggtggtggatctggccaagggccaccggatccgaccgcccccatcgccgggccgagggccaccgccgcctcgcggctgcctcgccgtcgtctcgcggctgcctcgccgtcgtctcgcggccaccccaccgccgtctcgcgtggccccccatcaccggccgagggcctcgccagccggggcccgcgtcctccctcgtgccgctcgatgcccctctccacctccgtcgcgacgctagcccgctggccgaaaccgtgggtgagggggccagatccggccacggaggcgccggatccgccgccccaaaccgatcggccgtctcaccttcggctgcgccgtcgtcggccttctccgtcctcctcacgcagaggacggttccaccgagctgtacgtttgggccttgccgccgccttcccggctcaccactggctttgccgccggcgagcttcggcggcggcgaggtggaggagggggatgagggtgtggcggcacgggtggctagggtttcgcccccgagccgcccgcgtgagagcgacgcgggggacgcgtcctcctttcatcttcctgtaagagctcttcagtcattcagtttagtgcacagactttttagggcccctttgaatcgcaggattgagaaaacataggaataggaaaaacgtaagattttgataggaatgtaagtgtaaaacagaagattgcaaaacgcaggaaaaacacaggaatgaccgtttgattgaatcgcaggaaaaacacaggaattagatgagagagatagactcgtaggaaagttaccaagaggttgaagctcttgctaaatttcctccaaaatctctttaggattgtccataggaatttcaaaggattgtatatgattcaatcctttgtttcgaagggcttcataggaaattttcctataggattgaaatcctccaaaattcctatgtttttcctccaattcaaagaggcgcttagtgtcatcgcaacaagttcatctaacaggtacaaaattgtcttcccctggatgacaaaatgcagcagaaagcaaagcaaaactgaattgcattcagcgacgggaaaagaaagggaggagtgagaggtgtcgcttacattctctggtctccggcacgaacgccgaggtgggggctcgctcgacggccgcgcgcgctaggagctcgaggatgacctcattggctcgtcggatcgcccgctcgcagcaacgcccggttcccttctccccatcgcctctcgctgaagctcctgccgtcgccgggtcgccgtcgctcgcaacgacaacaatacgagataactcgagggcctatacgaaaataaacccccagttcacacttcacaggcgtgtttaaatctcagccgcctatatcagatcgaacggtgcagagaggctgaggttttggatcgctcgaacgaagagattttttttttgacgcaaaaggtagagactaccttataaccattgcattaatggtggtcaaatcagataaaatctggtaaagccgaacaagagaacagaggggggagaagaaggaaaaaacagaaagaaaagacatgagaaaaaacagaggtacaagggagaaaaacaggaagaaagaaaaaaaaatacaagagatacatagatacaaaaggggagacaagatggttaagcgaatttgaccacccaagcagtaatgtgtgctcgaaggcaaggcttgaggcaacgaagagattttggtcgatagtagttgagttcatgttcctttgttggtctgtagcgctcagtgattcacatcatctcaagacatgaatcaacctattttttttagataatggataaaatccggcctctatatccaaaggaatcaacctatttctgtttgggagaatgttagaacaatgcttcccgttgaagtcgcaatccaactagaaatgctttttatatgcagcttgtagatagatgtgcagacaagattcagttcagcacttcagccaaactgtattcagacaagattctattatcaaaagacacaacagtagtccccacatgtgacatgtggaccaaaaggagtgaagtagtatattgtaggagtatttcaaaaactcccctgtagcctccccacttgggtctaattttattttacaggaaccgtaagcaaaccctaggattttgcttatacaaggtttacctaactataccattgatgatagagacacttacattcttgccctttcctaacccgccctgctccttcacactgcggaggcaaactttttttgaatgactcgcacgagattacaagattacaaccctggagggtcgtaaccaggaaaaagaaaaaaaaccccacccacacaccgacatcgccaacacacaagcccaggagaaggctagcaccggaccggccgccgctaagtatgaccgaccgccactaggccgacaaagggacactgacgagatcgccccataggggtgccaaaacgatgtcttcaagaagagaagtgacggaaaagccgctgccgccgtccgtcgggactcgaaggagccaagactaggctttcgcccggcaattacccttgggggatgaaacaacacgacaacaccctcaggagggagaacctcgttgttggttcgaccaaggccggactgagttttcacccgccgctcaccacctgcaaatccacggctgacgcactgatgccccaccaccatacaagctctgccgacctgtgggacccctgcactggtgtccccagtcggctagccttcgagcgccgaagatcgcgccacacccaccagcagattctcctcacacctaggtcgcctcctccaccgtcagccgcgcctctcgcgccaagccggcctcctccaccggacacgcctctcgcgccaatccggcctccctccatcggacgcgcctctcgcgccaatccggcctccctccatcggccgcgcttctcgtgccaagccggtcaccgacccctctaccaaacgatgtcgcgccggccaaatgtagccatctcccacgccctcgtcttgccgtccgaggccgccatgcctccggtgaccgtagtcatggccaccaccaccacagccactgctgttgaacgcaaagccacctcaccgtcctcatcctcacctcgcacctccacttgctgccgccagtgacccgcatccgccgacatcgccagcgcctccacaggctatcgcagaagatcccgccgccgccgggtcaccgtcgatcatgacgacaacaatacgagataactcgagggcctatatgaaaataaaccctcgattcacagtcacaggcatgcttaaatctaagccacctgtataagatcgagcggtgcagagaggctgaggttttggatcgctggaacgaagagattttggttgatagcagttgagttcgtgttcctttgttggtctgtactctgtagagttcagtgattcacatcatctcaagacctgaatcaacctatactatctctgtttgggagaatgttagatcaatgcttcccgttgaagtcgcaatccatatgctttctaaatggtaaatgcaagtagcttgtagatagatgtgcagacaagattcagttcagcacttcagccaaactgtatctgttggacaaatctgattctattatcaaaagatacaacagtactccccacatatggaccaaacacagtgaagtagtttcccagtaaaatcaattgggatagacacatgcaccagttcatccccctctcagtccttgcatcctgctgtttgagagttgagaattgagacacaagttaggcaaaggaaatcattcactgtttgttagcagtacgtacaaagtttggccagatacacaaaaacgcatgaaaacaagtatacttgtaaacaattactcctgtaaactccaatatttgatgagaaatatttctgtatgtttactcgtgaaacctgtccattggattcaacgctaaaagttttgatcccaagtatgcaacaggactggaaataagccccgaattctcatagaaacctctgccgttgtctctgtcaaccagctctttcacaatgcaaatgcatgcctaagcagagaactggttggcgtcaggaaggccaagtgagattctgttctccagacacttggagatactacaaagatttgatctttctcatcttttaatcgccttcttgagagagatcatctcagttgcctgcagcttctagaaaaaaaaaacaggtacaattcagcgaggagagggaaggtcagcaagaagcagataggacacagccatgttccagaaatcagttccaactgttagccttttttttttcctgtaaaagaaacaactgcgttaccactgtcatataggccagaacacaacatcagttagatcttactacggagctagtgcccttgtttggttgattcaggttcattcttgagctaaaaagtactaacagtttaggatggcaatgtcactgcattgcttgactgaacttgcaattccctgaatcacaggaggtagctggcagtagagctactgcgcgtaccataacgtggtgcaccacaccgcccggggatttcacccaggtgctccaggacgtcgccggcgaccccaccctgccccgcaccaagtccgtccggtgcgccgcctgcggccacggcgaagctgtcttcttccaggtcaggattatcgatcacaaccaaaccaactagtttattcagagttcagagttaatacaaaagatactcaactaacgcaagttctgcatattctcaaaaaaaataattctcggtttcggttcagatgccaactgtgattaacagaatgtgtagttgcagatggagtaataattcggggtatctttgtgaacattgcagtggagaggccgcgccaggggcaacgcccggttcccttctcctcatcgccggcggcagcggcggcggcgtctcgacatctcttcctcccttgtacaacgacacgacaacacgagataatacgagggcctaaacgaaaatcggcccacggattccgaggcgcgtctaatctcagccgcctgtatatgatcgaacggtgcagagagaggctgtggttttggatcgctggaacgaagaaattttggtcgatagcagttgagttcgtgttcctctgttggtctgtagcgttcaatgatgcagagatgccgtactgccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggncgcaggaa

SEQ ID NO: 32815 - DNA, 716 bp, Oryza sativa
atacgtaaatggattaaatttccaatataatctggtattgtttgcacaagtgagtcacttagatccaaaacacgaagatgagttaatctcatgaaaaatgtgttatcaactccctgtagctgatgatcagttgtaaaagttctcaacttaatttcctccttaccagtgaaaggtatgaccaccgtgtctttctctccgacaactaacatgcgtcgtagtttacatatagtattgtctactaatggttttagatctccaatatgacattcttcccttgatagataacaagcaagttgccttaagagatcatgcattttgcatctgctctgatcaaaatatgtgtaaactggttgcaggagattcctaattattagttcatagtagtattcttctgctgtatcttctagtaattgatctttgtgcacttctacaaagccttcagcaacccacatcatgataagctcatcacgtttcaaggtccagtcttcaggaaatacaatacaataaagaaaacattgcttcaaatgcagtggtaaatcatcataacttagatatagtgcaccacttatttccttagggagtttagccatggaccaaacgtttttagctaaaatccttttccatttgttctctgttttatctttgcttgccaatactcgagcagtaaccttgattgcaagaggtagcccaccacatttctgaacaatctcaatccc

SEQ ID NO: 32816 - DNA, 731 bp, Oryza sativa
attatatggctggcctagaagcagttagatacaataatggtccaatcatacttctatactccttctgatcaacagcttcaccatcttcatcaggatccaacacaactatagaaccaattggtgttgaaattgccttgcaattctccatcctgaaccatctcaaaagatctttcgtgtacgataactcacccatcatgctcatctcaaattccctgcgcatagtctcagcaaactctacaaccaaagcgtgagttgaacaaccaaagatgatatcatccacataaatatgaacaaaaagcgttttgtcaacctttcccattgaaaaaccttttgcaagaaaaaagttcttacgcctatcataccatgctctaggtgcttgtttcaatccatacaaagctttagacaatttaaaaacatgctagggaaaattaggattttcaaaacctggtggttgtttgacataaacttccttctgtatgaaaccatttagaaaagcacttttcacatccatttgatacgatttaaacctttcgaagtagcaaaagccaacaaaagtctaattgcctcaatcctagcaacaggagcaaaagtttcatcataatccaaaccctccacctgagtaaaaccttgagcaacaagtatagctttatttctgacaatcaaaccatcctgattttgtttatttttgaaaacctacatggttccaataatattatgtcgggctgcaggaa

SEQ ID NO: 32817 - DNA, 1174 bp, Oryza sativa
cgcgctcttctttcgcttgtatcgagaagccttgcagacaagacaagcatctaagttcgcgtattgcttgtggtacaatatgcaatcatttggacacgcgtgaattctccggacctctaaccctaggggacacagaacctgttttgcttcatatgtcgtctcgggcaatgtgttctcctgaggaagcatgtccttcagtattcccaaaagttctgtaaaactcttgtctgaccatccactactagccttcaacttcattaggtctaatgttgctgataatttggtgtgctttggcttgcatcctgcgtataaaggagtctccgagtcactgaccaacctgctgaacttcatggaatctctctcgttcatagctgggtcatcaacgtcacgtaacatgtcttgcagcatatcagggtccacatcaactatttcaccgcccaatggagatgggacaaacatgtcatgctcttcttcatctccttcttcatgattgtctgcaccactcccgtctgcagctgcaccatcagtaccaagatcttgctctccatgcatcatcacccaacatgtgtatctctccatgaatccccggcgtatcaagtgagcgtgtacttccttttcatcttcccacaaaatctcattcctgcaatcactacatggacaacacatgtacttgtcgtttcttcttatcctatcctcctctgcggcttttatgaaacttaatacaccatctctatactccttgtactgacgcctcaagccagtcgtgtacatccaacttcgatccatcgctgaacaatgaacacaatattagttaacatctcataacataagtactactaaattaacaggaaatgtttagtaccttttacttacttttatgatttttcctgtttttgtttgcaaaaaaattacaaaaattcgcccccttcaacctcccaccaaaatagtgaacagtgggataaactacagacaacggactgctggagtatatatagtgtgcaaagtatatctcaatcgggccaaaaaaatgtcatctctaacgggcgcacactaatctctaacgggcacaaatagaagcctgacaccgataagagtcatcggtgacgggcattaaggccatctcaatcgggccttctttggagcccgacaccgatgacactcatcggtgacgggc

SEQ ID NO: 32818 - DNA, 10531 bp, Oryza sativa
gagctggctgtgcaacgtgcaagcagtaatattttttttatggatgatctgtacattgattctatgatgcgcttgaacaattgtatttttaattaaattaatcaacgagctaagtcctatattcactatatttactatgttttcgatacagaaataggcatctgatggatcatccgcaatgatctcgtatttaatgggttaaaaaaataggcctcctgcaaattctaagaaaaacaaaccagaaactatatggtcccacctctcctcttctcctgggcatgtgtaggtatactaaaagatcattaaacttcctacaaacgctctcaaccggcacgtaacgctctaataaattagagaaaatcctacaaattctaagaattatctattatattgtactatatactaaaagtttattaaacttcctacaaacgctcttaagtcgccatgtggcacctctataaacactcctaaatcaccacatagcactatccaccgtcgattttcatttaaattgatggcccctatattttttaccattagattagatctgttattaaaaaataataccttcctcccacacaagaaatatataactgtgtgtactaaatacgattcaaaggagaaaaaataaagcttatctactgtgccgcaagaaaaaaaagaccatatacatgtacttataagatatacagtatagaagaaaataaagccaatgaaacatatgtacgtacttttcttgcacggagcaatgagctggctgtgcaacgtgcaagcagtaatatttttttatggatgatctgtacattgattctatgatacgcttgaacaattttatttttaattaaattaatcaacgagctaagttctatattcaccatatttactatgttttcatatagaaatagacatctggtgggtcatctgtaatgatctcgtatctaataggttaaaataataggtctccagcaaattctaagaaaaaacaaaccagatactatgggatcccacctctcctcttctcctgggcatgtgtaggtataatagaagtccattaacatcatacgaacgctctccagccgccacgtaacactctaataaatttgataaaatcctagaaattctaagaataaacaaaccaaatactatgggtcccacctctcctcttctcccacgcatgtcatacaactcacatgtaactaaataatcataatttgacaccattatatgctacccattaaattaataatgtactccatatatttactttaaaggaactagaacaacatatatacatatatagatttgtctttcgaagcactataataaaagtaaacatatatttatttgtcgtatgtattataattgaaaaataaggtcaaagtgtcacgtcccaaatcgactctaaaatacatcctcgaaattgtgccgagaataattaaaattcatgtgaaagccttcaacaattaaaatgtgcaaatttaaaagtcaaataaggcttggaggatttttgtatatttcctaaaagcctaaaatgcataaataaattttagtggaattttcagagcacaaataataattgagaagaaataaacaaagttaaaaaggttttataaaaagaaaaaccctaaaagaagtcttctttcccccccttcccttcttgggccggctcggcccaattccctccctctctctcctctcccccgcggcccattggcctcctcctcgcgcgcgcgccgctgacaggcgggcccgcccgccaccctcgctgacgggtggggcccacctgtcatcgccttcctcccgccgcagccgccgctcgcccgtgccctagcgccgccaccgccgcggattccgccgcatcccgccgtccccgcgcgccataatgaggggggaatcattccccgcgattccctctcccgattcccccgctttcccctctctctctccctcggattcgtccgatttccatcccgcaaacctcgccggcgcaatcaatggcggccgagatctccgcgccggtttccatctcctccggccgctttccctctctcccgacgctatttaaacgtctcccgtgctctcctcctccgtttccgccgctcgccgctcgctctccccgtcggaatcgtgctcgcgccgtcttcctctctctccgccgtcgccgacaagctccggttcgccgccgccgtcgctccggacttcctcccctctcggcgtcgtctccatcggcttcgccgcgttcccgtcgacctcgtccgcgcctccgtttcgctcgccgaccgccggagcaccgtcgccctcgccgtcccgaaccgcgccgccgccttcctccgtttcggctgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggccgccttcgggcgcgccccgcggctgccaggtggggcccggccgtcagccgcccgcgcccgcgggtgcggctgacgcgtgggacccacggcgccggccgccgccagccgcgtgctcccggtccaccgtggaccgagaggctgacgcgtgggccccactcccgtggacccggtccgcgcgccctctccctcggctgacgcaataaatgggtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttgttagagtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattatttccttgttcaccctagattaaataaaacccctactagtggacactctactcgtggtatccctagtttaaatttaggtagatgcttcgcaatttaattaggtaacattaggtggttttataactttagacttgggaaattctcatatcacctggacactgtgaaattgttggtttattgtggaattggcttcacaccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttactgcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtagtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacaagttggtatcagagccacccttgaccctaggacgagccgtagatcccaagccttagcaatattttcaaaaataaaaatcctttgttatttgtgaaaatcctctagtctctctctgtcttgctgcttcatttatcgccaaaatctgacctttgaaaatgttgcttttctttttgtttttgtttgtagatggccggcagcgtcacccgtcgtggtttggacatgactggcttcgtcttggagctgcgaggcatgtgcgtggtcctggggtatccacatggagtggactaccaggccaggccgcttccggatcaggagggtgatgatgcggagccccccgctgcttgggaggtcactgcagtgatcctctctggctctcccgagcggacttcgctggcagtcaccgcgggtggagattccttccccgccgcttgccagaacgccgccctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgcggcatggtcgagaacaacctgaagatcctggagctgcgtcaggagaacctgcagctcaagaaggacctggacgcagtggagacgcagctgcaccagctcaagatcgcccagggagagatctgccgccccaagcgtcgccgtgtctgccgcagccagaagatcaccgcccgcaagagcacctccaggcccgagcttgttcgtcagtccctggcgtggacttgtttcgtcgagacccctcgtgccgagcctgcgcccgtggttccccaggagggggaagcctccggcgttggaagcacggaggatgcgctgttgctcaccttccgtcctggcccgtcgcagcagtagacgagcagttagtaggcttgcgcgtgtgttcttcctcgtttgtcttcttgtcgagtcgtgtggggcatggttatgccggtgtgaggcgtaactatgtcggagcctgtcttattttatttgcctaagcaacttgaactttaatgaaccaatttaatagcagtaataaattcaagaataatggtagtcgtgggtggttagttttaattgttagctctctctctgtttgctggttctgtgtggggttttcagatggtgatgaccaggagaaatgctgctaccggtgatggcaaccaacccgaaggcagtaaccacaaccaccagggcaacccacctccacctcctcctccgcctccaccaccaccaccagacaccaacgccattctcacccaaatcctcgcccagcaagccaacatgatgactgctttcctccaccacctccaaaatccgccacaacttaatgctccaccaccacccccacaacactctaaactcgccgagttcctccgcatccgtccacccaccttctttagctccaacaaccccgtggatgcgttggattggttgcatgccgtggggaaaaagttagacactgtgcagtgcagcgatgaggagaaagtcatcttcgccgcccaccagctgcagggacccgcatctctatggtgggaccatttccaggctacgcagccagaggggcaacctatcacttgggctcgcttcaccgccgcttttcggagaacccatgtgcccgccggagtcgtggcccttaagaaaagggaattccgagagttgaagcaaggcaaccgctccgtgatggagtatttgcatgagttcaacaatctggcccgttatgccccggaggatgtgcgggaagatgaggagaagcaagagaaattcctggcaggaatggacccagagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcagccgcagcagcagcagcaacctcgctccgcgcctcgacctcaattcgtggtgcgcatcccacagccgcagcagcagcagaatcaacaagggactcgtgcgccccgtcctcctacgccaactgtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaaccacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccagaacaaccggttgttttctttgcacccccaacctctgtcagaagttcagaactgcatcagataggactgtcagaaatccccatcgtcagggagttcggagatgtgtttccggaagaactacctggtatgccgcccaagcgagagattgagttccggatagatcttgctccaggaaccactcctctgcataagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaacttaaaggtgccactgtattctccaagattgatcttcgttccggatatcaccaattacgtattcgtgaagaagatattccgaagaccgcattcaccacgcgatacgggctgtatgaattcacggtgatgtcgttcggtttaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatcagctaaaggagttgctgtggaccccgaaacagtgaccgccgtcaccgattggaaacaacccaagacagttactcaagtccgcagtttcttaggtttggcaggatactaccggagattcatcgagaacttctccaagatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtcctcatgcaggacggtcatgtggtagcctatgcctcacgtcagctacgacctcatgaaggcaactaccctacccatgatttggaggtagcagcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaagactatgatgtgggaattcactatcatcctggtaaggccaacgtggttgccgacgctctaagtcgaaagagccattgcaacactcttaacgtccgtggcattccacccgagcttaaccaacagatggaagccctgaacctaagcatagttagtcgtggattcttggccgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaagcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctgtgtgatgtgtgccagcgtgtcaaggcagagcaccagcgaccggccggacttctccaacctctccaagtaccagaatggaaatgggatgaaattgggatggatttcatcaccggactcccaaaaacccaaggcggatatgattctatatgggtagttgtggatcgattaaccaaggtagctcgatttattcctgtgaagaccacctatggagggaacaagctagcggagctctacttcgctaggatcgtgagtctccatggcgttcccaagaagatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtgtcctatattttgggaagacctgggataagagtctcccctatgccgagttctcctacaataacagttatcaagccagcatacaaatggcaccttatgaagcgttgtacgggcgcaaatgccggacaccactattgtgggaccaagttggagaaagccaagtgttcgggactgatatcctgagagaagctgaagctaaagtcagaatcattcgggataatctaaaggtggcacagtcccggcagaagagttatgcagataaccgtcgccgtgacctggaattcgcagtggatgattttgtgtaccttcgggtcacgccattgcgaggtatacacaggtttcagacgaaagggaagctcgcacctcggtatgtgggtcctttccgtatcattgctcggcgcggagaagtcgcttatcagttggagctgcccgcctccttgggcaacgtgcatgatgtgttccatgtgtcgcaactcaagaaatgtctccgagtgccatccgagcaggccgactcagggcaaattgaagttcgcgaagatttgacctacgtggagaggccagtgaaaatcctggacaccatggagcgcaggaccaggaaccgagtaatccgtttttgcaaggtccaatggagcaaccatgccgaagaagaagctacctgggagcgtgaagacgagctgaaggcagcccatcccgatctcttcgccagttcttccgaatctcggggtcgagattccgtttaaggggggtaggtttgtcacgtcccaaatcgactctaaaatacatcctcgaaattgtgccgagaataattaaaattcatgtgaaagcctccaacaagtaaaatgtgcaaatttaaaagtcaaataaggcttggaggatttttgtatatttcctaaaagcctaaaatgcgtaaataaattttagtggaattttcagagcacaaataataattgagaagaaataaacaaagttgaa

SEQ ID NO: 32819 - DNA, 761 bp, Oryza sativa
gcggagcgaggttgctgctgctgctgttggtgctgctgcgaggaggatccccctggatagggattggtgtagcggaccctctggttagcaccctgctgattgcggaaattcgccaagcggcacttgtgcgactccagttccttgtgcttggcttccaagcggatgctcttgtccaccagtcgttggaaatccggatagtccccggagactagacggacggacagctcggggtccattcctgccaagaacttctcctgtttctcctcatcttcccgcacatcctctggagcgtaacgggccaggttattgaactaatgcaaatactccatcacggagcggttgccttgcttcaactctcggaattcccttttcttaagggccacgactccagcgggcacatgggttcttcggaaagcggcggtgaagcgggcccaagtaataggctgcccctctggctgcgtagcctggaaatggtcccaccatagagatgcgggtccctgcagctggtgggcggcgaagataactttctcctcatcgctgcactgcaccgtgtctagctttttccccacggcatgcaaccaatccaacgcatccacggggttgttggagctagagaaggtaggtgggcggatgcggaggaactcggcgagtttagagtgttggggaggtggtggagcattatgttgtggtggattttggaggtggtggaggaaagcagtcatcatgttggcttgctgggcgaggatttgggtgagaatggc

SEQ ID NO: 32820 - DNA, 1991 bp, Oryza sativa
gcggcagctccctagcagcgtcgactcccccctgcccccctggcccctgccgattggatctgagagtgagagaggggatcagaagagtggagactggagagagagtgaaatgagaagacctagggttttcttgctttatatactagcacctccgaattgggttgggcttttactttcatgtgggctaaggcctgcatatgcgctaatgtcgggaccccatggggatacggggccggggagctagcgcccgcccccggccccggcccacccgacgggtgaataaaatggccaataacagccccacggatagtgtttcgctcccaattagagaccctaatagagtatttccccaccggggatcgggttacggggccccattgccatccctaggcgcacacccccttgggctaagcccacgacacatttacaagcccaaaacccaaatcagattcggactggatgaggtacgtggcttgttttgaagattccctgcagctcggaaggaattttgacatgggaccaaaaccatctgaaagtagactccataagctttccaacaagtactcatgggccccgaaattccttctagatcagcggctaggtctgtttgaagttgatgctgtcaggaggcccgaatccaaatccaaaacgtgtacaacttgatctcttgtcttctatgggccaaaagtgacatggtgaggtagaagtatacttgtagaaggtcttagtttggtccctaatcaacttcttcaatcatccatgcattacttacgctcggtctcttttctttcacccaagcaattacctctgcgaacgaaaacacacgaaactcaatgtgtagcaacgtttgtttaaatatataacaagtaaatctaatatagaacatatgcacctttggttgatcaatacataaggtggtcatggttatatccgaactagttgtgtcctcatcacaaagtgcggtagcctacctccgtttgtccatctgtttgtgggtgacatgttgtagaaaacaatagctttgtacccaacttgttccatagcgtgcgccagaaatgacttaagaattttgtatcacgatatgaaacaatagtagaaggcataccatgcaagcgaacaatctcatggaaaaaacagatcaacaatatgaacaacatcatcacttttatgacatggtatgaaatgtgtcatcttagaaaaacgatccaccaccacaaaactgctatcctccccctcttagttctaggcaatcccaaaacaaagtccatagaaatatctgcccaaagaatagaaggtacagaaaaaggcatatataaaccatgtggattcaaacgagacttagttttctgacaagtgctgcaacgtgccacgaacctctcaacatcctttcccatccttgtctaaaagaaatgcatggccaaaacatcttccgtcttcttagctctaaaatgtcccatcaaccctcctccatgcgcttcctgtatcaacaaaagacgaacggaaccaactggaatgtatagacgattagctctataaacaaatccaccattgatcacaaatttgttccaagtaagtccctctttgcaatttaacatcacttcattaaaatcaggatcaagcgcatattgttctttaattgattcaagtccaaaaatccgacaatcatgttgggacaagaaagtatagcgcctagacaaagcatctgcaatcacattatctttccctttcttatgtttgataacataaggaaaagattcaataaattcaacccattttgcatgtttacgattcaaattattttgagagcgaagatatttaagcgattcgtgatcggagtgaataacaaattctttaggccacaaataatgacgccacgtctctaaggaacgtacaagagcatacaattccttatcatacgtggaataatgcaaaacaggaccatgcaacttcttgctaaagtatgcaacaggcttaccatcttgcatcaacac

SEQ ID NO: 32821 - DNA, 2289 bp, Oryza sativa
tcattctaatttggtgatagccactacgcaagtcaatctttgtgaaaattatagagccacacaactcatcaagcatgtcgtctaacctaggaataggatgacgatatcggatagtaatattattaatggctctacaatcaacacacattcgccaagaatcatccttcttaggaaccaaaattacaggaactgcacagggactaaggctttgacgtacatacccgcggtccaaaaggtcttgaacttgccgttgaatttccttagtctcctctgggttggttcgataagcagcatggtttggcaatgatgctcctggaatcaaatcaatttgatgctctatccctctcatgggtggcaatcctgggggtatctcagctagaaagacattctcatactcctgcaaaaggttagtaacaacaggaggtatcgaactagcaatatcatcaaaagaaaccaaggcttgtttgcatatcaagaaatagcacatatcaacatctgaaatttcagcaatgtcacattttgttgcaagcataacaccatccttcaacttaattccctcaaccttagaactaggtgaaagcttatcctttttaggtggaaaaacagatttagccacttgctgattttcagattcagcttctacaatttcagcaggggtcaaaggtagcaaaataaatttcttcccattatgcacaaaagtgtatttattactcctaccatggtgtgtagcatcattatcatgttcccaaggacagcccagcaaaagtgaacaagcttgcataggaaccacatcgcaatcaacagaatctgcatatgagccaatggaaaacaaaaccctacaaacctgtgttacctttgctcttccggaatcgtttaaccactgaatatggtaagggtgtggatgtgtacgtgtagtcaagccaagcttcttgaccaaatcagaactcaacaagtttttgcagctacctccatcaatgatcacacgtgcacgatggttgttgatgacgaagaaaatctgaaacaaattatagcgttgcaacttgtcatgctgctgtacatacgtgctgagcacccgctgcacaataatggtcctgtagtccgttgtgtcatcacgaccaaagacttcgccatcctcatcctcaacttcttcttccctctcttcctcttccacgtcggaggtggtgatgtagccatcttctgtagcaacataggcccattgactagggcaatatttctgcacattcccaaacccttggcaacggtggcactgaatgcgtcccgtcgaggcgacagatgaggcactcttggcgggtacctgcgaggaacctttacctgactctcctggtcgtggtggagatggttttggtgccgtagaagctccggatgcagctggtcgcttgctcgctggctgggaggacgcccgaaaaaagacagccttgggcagtcccgcagatggcgtcgtgcgcggagtgtatgtgcttgccttgctcttgccttgatggtcgcgcccctgtaattccttctctgcaagcatagctaaccgaaacaactggttgacagagttaaattccttataatcaacaatgttctgaatttcctcccttaaaccagaataaaaacgacaaatagcatccttgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagtagtaggtagtaccccctcatcagataacccagcccaccacataatagcaaaatccttgaattcactactggcttgtctaactctatgttgctcgggtacaaggtgggcattaaacttttgttgtactgtcatctcccaatcaagatatttctcaacatcataatttccccaaaaagatggtattttaaacctaaccttagcataaggatcatcggcgacatgattattatcattaccttgttggtggcgagtgccacccatacctgtgcggtttgtgcgtaggcgacgtcgtagccgtgcttgccttgtagccggtgcgtcaatatagccactggaatcgtacaccgtgtcttcaggatgagcatcgtcgtcaccactcaccacttcctcattggaaggtgtctccaacgcggtgacccaatcagttagcgtggatatccgcttgtccaacctctccatgtggttcaggaagccgattttagtga

SEQ ID NO: 32822 - DNA, 3922 bp, Oryza sativa
agatagtaatgctgaataaaaatcccaagtcacttgcccttagttgctggtctacttgtgtcctagatagtagtggttacaattatggctcaagaaataaaatgacactagtaagcagcaaagaaagacttgcaggcaagcttcggcgagtttcagcaaaaactacaaaaccaaactggcagataagctcaacggagcgcgtcgtgagctcaatgcactagtggaaatcaacttttcttttttttttcttttatttttttatattttttcttttttcagaacatgaaaataggcacacctccaagttacagctcaatcggagtagatatgtggcatatggatttttctgaaaccactataaacaaggtgcaggaacttgtgagctcgaacagacaattttgcaagccaaattttggaattttggattcgccaaacccaccgaagggttatcttcggtcaattcccattgactcggaaagaatttggacgtagaccaaaaccattcgaaatgttatcttcttagctttccatacatataaagaacgccccaatccgagcacgtatgcgacctaggcgcccgttttagtgcagactggtcctggactccgaattgcacccgacgtcgacttggtttgggcctccaccttgacttggacgtcctcgatgatcctccatggctctaagtccttctccaagtgtccccttatcccctccattgttcctaatcacaacataatcattaggtagcaatctattttcgaattcatacaaagaagaacataggaacgagctcacctctaaatttaattgtcgcgcacgagctcttgttatcggtccttgaatgaccgttggaggattgttgtgtgtatccgaattagtgatgtccgcatcatacacaaccatcaaaaatcataaacaacagaattatataactcaatgagatctacaactattgtattggtcctttgtacaaataaattcatttgaacaattcaaattttgaattttcaaaatttgacaacttcgaacaaaaattaggattaataaatgattcgaaatgggaaagttatcaaaaccaaagttgtagagctcatcgaggtgcaaaatttttattttggtcatttctccatctgactctatttaaacaaattgaaatttgaaattcaaagtttgagaaattaaaatataattttttgttagtgaacgactttaactgaaaaagtcatcaacaacaaagttgtataactcatcaagatctataacttttattttggtcatttttctatataatatttttttgaaccatttgaatttgaatttgaaaatatgacaacttcaaacaacattttcaaatactaaatgattttaactgaaaaagttatcaacaacaaagttgaataactcatcaatatctataacttttatttcggtcatttttctatataatattttttgaaccgtttgaatttgaatttaaaaatatgacaacttcaaacaatattttcaaatactaatgatttcaactgaaaaagttatcaaaaccaaagttgtagagctcatcgaggtgcaaaatttttattttggtcatttcttcatctgataaaatattagtaatattgttcacaaattttacatataggtgttatagtttataaaaccacataagagatatatcaattttgtgaacaatgttactatcactttatcaggtgaagaaatgaccaaaataaaagttttagatcttgatgagttgttcaactttgctgtggataactttttcagttgaaatcatttagtatttgaaaatggtgttagaagttgcaatatgttcaaattcaaattcaaatgggtcaaaaaaatattatatagaaaaatgacaaaaataaaagttatagatcttgatgagtcatacaactttattgttgatgacttttccatttgatatcatttactacgcgtaaaattattttgactcataaattgaattattatactgcaagttaataatattgctatagttcaacttacaaatataaacatttcatatgtaaaatgaaaaaatactcatcggtgacgggctttaggtaatgcccgatagagattaagtcatgtcaactggggattagtatataacccgtcactgatgagtcatcggtgacgggcctcaagttggtgcacgtcacggatgatggtcatctgtgacgggctccaacttaaggcccgtttgagatatggaatgttatctcaatcgggcctaaagttggtgcccgtcatggatgatggtcatctgtgacgggccctaacttcaggcccgtttaagatatagaatgttatctcaatcgggcctaaactacggcccgtcactgataggtgtcatccgtgacggccttaagttttatgcccatataatatgtttgtgcgaccatatatcaatcgggcactttttcagcccgattgagatgacttccttgtgacggcccgctattttcaagcttgttagaggccgtcacagatagaaggatctgtactagtgtacgcacgagcctgtagctactgactatatgattttgtagtgcatgattatagttttcacttaatggtagtgcatagaaaattaggatgatctgccatttaagttgcttttaggttgtattcaacggtttaaatcatgccgatcatacagaccatcactatatcactcacgcatgttgttcaatatagtttagttattttattgacaatagtaagcttggattcatatcatcgtagttttttttattgttcctatgtgtgcgtactttaaatccatatagacccttctgcaagactgcagctatgcttaacttaatatcaggaacatctataatgtaatatggaaatagctttctgttgcaggctttgccgctccatgcttaacctcttttaccctaaaaaataaacaattttgtacatatattttggaataaatatacctccttcacatataccatatactatatatagtatacgatttgtccgctgcagttatatgtattgttcttcttagtaacattttcttgtacatatatagcattattgttttgtctatactaaaagtattttatgcttattgcagattccatatggcgcatgtacttatttcacagctatcatttggagattcaaacaaaagaatccatgcaagggtctccaggctatggaactttactgatctcaacgatgatacaaaaattttccacactgatcttgtcttactcgatgaaatagtaataatttacctgccaaatccattttcttatttgccttactataccaataattctcttgataacatgatttgtatttataatctgcaggggactagcatacatgcccaaatttatccccctataacagaaaagatgaaacctctccttaaggaagaaaaggtttactacattgactcattcactattagggctgcaaacagaacatacaggccagttgcaaacaacctaatgatcctcttcagtaaatggacaacacttgaagaacacattaatgtccctcctcatttccctagtattacattttcactgacaccatttgaagatgttccttcgcttgtcgagaagaattcattctacgttggtaataacatacttttattgtgttacaactattgttatatgcgtcttctgcaatgccatatcattttattaaatttttatgcaatgcaaacagacattatgggtgtgatcactgaagttggtgcagtcactactatacgtcctaagtccagaaacgctgagagcctaaaaaggacattacagatccgcgatgcaaggtttgtttagtacagctaaatatttacatttttattatttacttaatctttttcgctagcattcacacaaactatctcacatattcttaacactaa

SEQ ID NO: 32823 - DNA, 10033 bp, Oryza sativa
ccaatatgatattttcactgtcctcttatgcagggaacacgttttatagtaaatgtgactgttagaaggatatgcaatgaatattcttgctggtacaattcatgtcgaatatgctataaaacttcaaaaccatatggctctagctacagatgctccagctgttctaacatcggaataccagatccaaggttcataatagaacacgctctgtcttcctacatctttagcaattatcatccacacattgctatggccatatccatttttcatgcaggtacaaagtagtattaattgccggcgatgatgatgctaatgctacatttatccttttcggaaggatcgcacaacgcctactacgcaggccaatagaatctctcattgaagaaaatccaccaaacagtgaatacattccaagtgaaatcacgtcacttattggcagcaattttgcatggaatgttagctttacgcgggatactgtcatgaggagtcaagagtgcctacaggttaatagcattatatcctctggtgcttcaaaccagccactactccttatgtccccagatgcttcaagttcactatcgctcagggaacacaggacaccccaactagcaaatcaaattcttcaacacctaccaagaaatgcattgttgtctcagtgtcttgcctgcagtctagcaggaccaaacctaaaactgatgataaggtaaccactttatagccacccttaaacttgctgtcactcatactgaattacatccactctcacttctttcctaattttgcaagcccaaaactaacacaaaagctgaagaaaacacctcacatgataaatcttcaattgttgtcctgcttgatactactgaaaataaggtactactacatctctttcctttcagctcattcattaagacttaaccgccacttcttttacaagggaaagggacaaactgccaaagaagccaaacaagcaaccccatcattccctacagataccccagccaaaaaaaaggtgctttgatcactcctaggtgcattccaataataaagctttcttccattgtaactaacacatcgtttcaataaacagaggaatgcctacacctacagcaacacctccggtagctaagaaattgttcaagtatggtgcccagcaaaaaggcaatgacaggttactcctcaaacacaaactcacctatctacacataacaaattagcaatttaaaggcatttcctaatctcacaactcttaatttcatctacacagtgaatgagttgtcgacgtgcaatccatctcaagacttttgcttatatatatgtacaaagctatgtcccagctagaagacagatggcagttgtgaaattacccaagactaaagaaccaagatcttttgttcatggctttttgtcatgattatcattgtatataagtgttgccttatctaccttccttagaattgtatgatacaagatgctagcatctgctaccaatgctatagaacatagtatgtatatgcatgcattctagctgaatgacttgcctttatactatctaagtagttccagtaaaatgcctgccgttacactaataagctatccctcttgacacccttcttcacaaatgctcagaattcaatgcttcaaactaattcattctttttcaccacctaaaacagcaaaaaaaaaaacacagccaatttcccaaaaaagaaaaaacacagctaatttcctaaaaaagaataaagcgcgctcccgctctagtgccatacaatgcatgagcttctccctttatcctccccatcttccatatttgtactatcttattactaatgttaaaaacattttttctcataaactagttgtccaatctacgttctgatcataccgatttattcgttgtaccgatttattcgtagtaactaaattttgaaacaagatatcacatgattatattctataaaacaaaaaatatagataaaatccggcacctaaactatagttgcatttttaaaaaaaacgggtacctttatttattttatagataccggtttatgtaaaaattggtagctatagtatttaaaccttttttttataaaaccggcaactataaaagtcgatccagcacctcctccaccacaataaaatttgatcttatccacactcccattgtcgtcatctctctctcgcacttctccttcccactcttctctccatccgctgcatgtcctctccccatcttctcctttgcatccgttagccgcaccgcctcccattcccatcccccaaaaccctaaccccctcgcccgccaccagcgccgccatggtcagcttgtgctcctcctctcgcttcgatttggtttttgagatgaagggtcggtggaggagggagggggcggcagctatggccatgcgactaaacgaggctgtgtggcatgcgactggtgggagcgtgtggcgtcgacgtcaggagctggcgttcttgtgggcagactgcgaatccgggtatgatggccccgccgctgtctcccccttctcctcctctaaatctggcaatggtagcagtgatggagaaggtggtggctggtggccgggaaggaggtggaggtggagcagcctgaaggacctccgttgccagatccggcggctggcagcgaggtctatgacgagctccatgaggggagaagtgcgcaactagtactttatattagtattgattaaatgaaaaaccgcacacacacacagcgctgtacacacacgctgaacgcacccccttataacaccactgtacacgcatatgcacaaacacccactgtacagacacacacaagatgtaaacttgcagcaattcccactttcccagacaacagtaaatttatatcagaagtgcaccctcatgtgttctactgtgagcaccaggtttcggactttcggtgaacatgaattcactatggcaccttcggtgctttcccgacaacagggttggcatttgttctcgtacaccggcaattgttaagactgagttttttttaaggcaaaattggttttatagcattgaaagttctcgattttggctatatagcagcaaaagtttatggttcactttaataacactgaaaattacctcctttactacttttagcattccgtcagtagttccgtctcctcaccccatcctacacacatgtcttcttcctcctgcactctgccagtctgcctcgtatggccgaccactcttcaaggcagcaagcgagcttgacctcgacagtatagtgctgagtgggttggagggtggctggatcaggcaagctagaggtggcatctcttgggtcagcagacaactggtccagggcaaggaggagggggtcggcactcaggtgaaaccgcgacgagcgcgagggtggtgctttgaggcgagttcgagccttcgagggccgatggatgagctcgagggtggcgtgttcgggcgagctcaatggcgccaacaatgagctggaggacgttgtttccgttcaggcccaaggatgcctgtgacgagctggacaacaacgcttcgggcgggctcgaacgcgtcgatggatgagcttgaggatgacgcatcagggggagaccaggggcagcacgcccggacgaacttggaagcggcgcggccgcggaggtggacctggttaagcacgcggcatttgaacaagctctagcatggcggtgcggcagatgagatcgacgatggcgttgtctggcaagcacggaccaacatggcttgcggatagggttggcgtacatgacgagcttgtggagccagcgtcctgcgttcgcaccatggctgaccagcctgacctcgtgtatgactgccatttaggggtgacgaggaaggaacagggcaccgctggtgtttgatatcttttttttttgttgttgaaaaacaataagaagaaaacaaaactaactgaagtttggacggaatgctaaaaataagtaacggaagtaactctcggtgctactaaagtgaaccatgaactttcaatgctataaaaccaaaattgagaactttcgatgcttcagaaccaattttgcttttttttaatgcaaaacgagaccagcgatcaacaaatgattaatcgagggtaattattacaaagttgaaacatagatttatttaattttttttaaaaaaaattacatagaaaagttttacatgaaacataattctaaaaatgtgttcacaataaacaagtagtggcaaacatgagacaagatgtagtcatacagtaaagtattattataatatatggcgtgaactgaaggtattgcattagtataagtacactatattgactgccaaaatgtagggttgaatttgtaggatcatgtgcttacgataggttctatggtaaatgatatagtttaaatgaatcttcaaataaatattatatagatataccttttagagcaacacacttacgtactacggttctaggcacaacttcataagtattaagagaataaggacctaatacattcggcatgtcgaatctaagaagtcacagtcttgttagatttccgtcaacttcatatgttgattttcaaatagactttaataattattttctccttatgtgttggttttttatccgtcattatgaagttgcctgcatatttactctccttgagataatgatgtactgtaacaagtagttgcagcttcttaaaggctaagatttattccattatcttaaaaaatgtacggctaaaatcgattgaacactttaaggtatggcattaaaacctttggggtcttatagattcaccatggcatgcatagttaacatgtttctaagaagagtggaaaccatgataaaaatatgttgaagttttataaatcaaagtacacagtaattaaatcatatattcccacgtttcaggttataagacgttttgacttttgtcaatgtcaaattgctttatgtttgactaagtttgtagaaaaaagtagtaacattttcgacccaagacaaatttatcatgaaaatatattcaattatcgatttgatgaaactaatttaatattataaatattactatatttgtctataaacttagtcaaacttaaaacagtttgaacgaaaatcaaaacgtcttgtaacctgaaacggagagagtatacgataatatgaaggccattaagctcgaatcattcaccactgtcaaatacttggcatccatatggtaacattgaacaggaagatgaatacggaaaatgaaaatactgtctccaatgaatggtgcttcacagtccgaaaatgaacagtatctgaagcaggaacaagatccggaatgcctcactcagcctcgagggaggagaggcattttttgcttgggagtctacaatgtcatgaaaacaggactaacttcaaaacaagtttgtttatttgtttaaatgtacgacatataatgctaaacacagctcacaagtttgctagttagaaactatagatttttgtttgctaagtgcccaacttcttatacagttatacgaggcatgtgtgtcttcattggtttcgaaaccaaattatgataattggtttaataaaaatgttagcttgagaattccaaagttgtcggctgctattttctgaattactaagaaaataaaattattgatttgtcgttactttgaaacttcaattactgactgatagtacaattagaaagaaatttgtacgtgttatattatataacaaattttaatattaaaataagtccttattatagtgtaaattttgatttaaacagattttaaatgttagtaaatcactgtttccgaacaatatgtaaattaagagtaatatgaaaatttgatccattcaaaatatacgaagctaacttttaaaatttgggtaagatccgccgaagcgggtagccttaaccgcaatgtgatggaggaaagcccgaaagctgttcccgtccctgtcaagggagatgccaaccgtctctcctatacaaagctaaaaaagcatttcccatctcaggaccgagaccctgacccatccgcgtcgctcctcgcgcgagcgaccgggcgggtgacaaccctagcgccgccgccgccacttcccctctccctccctaacctcgccactgccggagcggctaggcaacggttcggcgaccaaggacagcggcggcagggcaactagccgaggagcggcggccctgtctagcgcgggagaggcaggtcgacgttcggcggcagctgcggcgacccgacgacgagcttctccagcgacggcgacgtggtgggacggcgaggtggggcaatagcctggacgcagtgggaggaaggtgaaggccggagatggaaggggcgaccagatccggtcttcctggatctggctgtcatcggggtggggagtgatggcggcggggtgaaggtgagaagcggcagcggcgcgaggaagaaaaccggagggggaggagcggccactctggccatctccttcttggattcagtgggggagaatggagttggatgcgcacgaggccggcggaggcggtcggcgagtaagacggtagccaacggatgtggctgtggccagcaaaggtatttgggtggcgaattgaggtgcagctggccggtgaaggcgagcaaggcgatggctggcgaaggcggttgtggccagcgaaggtgctgtcgaggcggagttggttgtcgaggtggccggagaagctgctggccggcggggttttagtggtgatggttgatggccggtggtattgccgcttggagaggtcgtcgttgggttggtcggttggtcgctgacgtggttcgttcgtttggaaagccacaggacacggtgaacaatagtgttgtcggtggcttgatcgccagcaagtgttcctccaagtttgtctggggctcctcccctcctgttgaccggtctgctttcagattctggtcgtggggagttccatggcgaggggcggggagctagctttggttggtagatttgcttggagttcgagagcctcaacactgtcagcgctttgtttttcttgcgtcggcaaggtgcctggttcggtggagttggtgcatgagacctctgcaacgcaacctgttgatggtgtttggggtggagttggagctgcttggctgggtgtggcaagctgggcaaagaaaacccccttgctccttttttggtagtttcgttggggttactgtgcagttggcttcctggcgtttctttgggtaggtgtgttgggggaagtcggagctgcttgtcggtgacaagctcggcaacgataaccctttcccgctttccatggtagcgctgtggtagccagggttgtcgtagttagcagggagagcgagccggggcgaatgtcctgctcgatcttaggctagagccaacgatggtgacgcctgtgtgcgccgttttcctgtggtagccagggttgtcgtagttagcagggagagcgagccgggcgaatgtcctgctcgatcttaggatagagccaacgatggtgacgcctgtgtgcatcgtttctgtgctctactcgttttttcgagtgaaaaccttgcaccgattttcggacggatgttgtttgcgtttcgaagctatcttcctccttggaggctttgtcttgaagaccctgccctacgcttgtctgtggtctgttcataggaagtcggagctgctcttgggagcttggcaacgatgacctatgttttatcctctagttgtgccgtcgcaagttctttatcttgttctccgtgtgggttttgcccggtttccgccttcaaaccgtgtttatgtgaggtttttgggcccggtttccctaaaaaactgggccaagtttctacttcttaaaagaaaacaggatctccctgtccacttctgaggattttactaagaaaaaagaaaatatacaaagctataaggatacctgtcaaagagtcgccggccggcgtgtctgtttcattatgacctgacaattatggcaggaaaagattagctggggtcaccaaagagatatgctgtacttaatgaatataaaatttctgcatattatttgttttcgcgtaagcatatagccagccaaatgtgacatttcaatgcactaatttttggtatgatccaattttggcaatcttatttgtttatcggtacattcgattttttttcagccatctgatttgttatttcaaatggttaagagcaatttcaagatatggcatctatgctactctctcgatcctttaatataaggggttttgatattttgcctgtactatttgaccattcgtcttattcaaaaaattttgaaattattttttttacttactttattatccaaagtattttaagcataacttttcattttttatatttgcacaatttttttaaataagacgagtggtcaaacaatacaagcaaaatatcaaaatctgtattatgggacgaagggagcagttggaaattaatatgtttttacatgccacaggacggcagaattattttaaaccatttgctgatgtcgtaccagaaaacacaatgttgcatctactcctctgtacaataaagattcaaatcctatcttcaggttcatctctagaatttgaatttatgagacagagggagtagataactagattggcagttggcttatttcatttctgataaggtactaaaattgtcaaaaagaatttttttttacaaaacaattatcgtttcagaagggtacaaattggtttgtccaaaagtaattactcgtttcagaaataaattcgtttgtcggaaagtaattatactactcgctatgctttactggtacagaaaagagatggaacggttgaaaagatcaccataaatgaatctgttcattctttatactaggaacattatctttaaaacttattacccatcacttcaactatggtagactatatgtgagagtttgtgtggaataacttcaactatggtagactatatatgagagtttgtgtggaatatgtgtataagtttaagattttgaattttaatatgcgtaggatacagttagagccaaactatgtctaggtcttttgttaaataccgaggcacacatgttgtaaccataagacaactctagcatagtgtgtacgactagcgtacaacttagcccgtggagggtcgtaggtttcggttggacatcgataacaaatctctttctacggtttgtcttcaatattgtattttctacgatgtttcttctgtgtttttagccccctgaatttataaattctcaaaataatacgagtgtagttgaaaaaggtgtaaaaaaactcaagcgtccgtacggctgcgattatatacagccaaatgcacggtactgacactacaccatggatttttgcgattttcggaattgctgaagcctagagctaaaataactcaattaactccgactgttccatgttactattatctaaaaactaaaaagataagcccgcacgaacgcgtggcatcttattcattattttaagaaagtattgaaagaagtcatacctcaccatagtcaccataaattaccttataataaaaaatatgtccgcggtgaaatagagcacaaactttaatatcctaaatgatagaatgtctcccagattcagacaaaaatcactttgtcccggttatatataaatttgtatattgctaccacgaattattatcattgttttaaaaaatgtttgccaatttaatagatgtaactgatttaatatatgaaattgtatcaataccaagaaaacagtcataatatattattaatacataaaaaatatatctccagtacttatctaagtgtttatttccaaattcatatataaatattttaaaaatcctgtttctacctattaataggttaacaccgctaaaattaagagaaaatcccttctatacctctgaaatttcagctaatcccttctacgtccctgcttacttcctcctatacctctaaaatttgattttgatctcttccatacctctcccttcagatgaccatt

SEQ ID NO: 32824 - DNA, 11907 bp, Oryza sativa
aaaaatataaacgtttgccgcatcagactattatagtaatgagtttgttgtgtgatgtgttatttatcacaaaatttatttttagataaagaaataaaaaatatgtatttattttttaaaagaaagtcataaaaatgataatcattcttacaaagataggactaccaatgctcacaataatttttttatgaatgctccagatcaaaaatatccattgtcctattagaatttcaaataaaaattttaatttattacatttgttttatcttcaaaatttatatcaaaaatttctgcaccaattatttactctcattagtttcataaatcatttttcaagcttatgttcaaacctaaagcatcaagggaaaaaagatatttgcaaccaaacataatagtgaaatgaaggaaaatataacagtaggggcatggaagggatcgagttgaaatttcaagggtatagaagggatcggataaattttagggatatgaaaaggattgagtgagttttcaagggtacatagggaatttactttaaaattaaacatgaatacccaatccgaccataggctccaaggctttcttctatgcttccttgaaatatgggtcctgcctcaacgtagccgtgcatgtaaagaccatcatacaacataactttaatgcttagttcactatcgacattggcaccctcatagttggtgtctttcggaaggacaaagagaaaatagaggtaatcaaaacatgtgtttaattaaaacttttgagtcgatttgtaatatagagtagacattcatggtaaggatatattattctcttttgaaaatgagctaggctcattattcgacactacttcaaaatattatagctaaagagacaactcaccctgaatatctgtagaataccgtctcattgtttatatttacatatagtttaagtgtctggattgttttcaacatccgctggtcataaatatttcttgagacagctttacgaacttatttataattgattcattgaagtgcactagcagtcacatcagtggggtgtaagacagcccatcaattatgcccgacgtattggagttcctcgactataacaaaatatatcatcagtggtgcgtatgttactggattgttcatttggtgccaaaactatttggcaaagaaaaaatctagacgtgtgacaataattctagtgatgaattaaggggttgtaatgttgtattatagcaaaattacccgcttcaaatatttttggtagtttttttcacatctctatggcaatgcttctcacttctcagtaccaatcaaataacacaaattggaatttaaagagaactacttgaaaaaacagaacataattaaattatgttgtttcaattttttctctggcgaaacagttgcataaaaataggagaaaaaagaaggattgaagtccggaaggtaagagcatcaccaacaaattagcaataatctatttctaaaatatgatattggggtttcctaaaataaaaataggaagtgaaaaaactttttcctccaagagatagcctaaatttaattccgaaaaattaaaagtgggacctactgttaaactatcaactgaaattcccgttttttctcctttcatgtgcacagagagagatcacgatgacccgcatgcatgctcccaacagaaatttcggcgctcgcgcgggaaggagaggagaagcacggagaaggagagagaaacgcgtgaacgagagattgggagttgctctctcacccttaaatccacggaatgaaatatatggagatgaaatatatgcaaggcttttaggaatatgttggatccaatttttatactaaaaaccatcaaaatcagttttgggaatgaaataggatgactgttggtaacgcaaccatcaaaatcagttttgggaatgaaataggatgattgttggtaacgctgtgcacaaaattttactgaaggggatgtcatgcgcatgagatttgatctaaccattaaaattaatgagtccaccaatttaacttaaaaataatggttagatttagctaatttattatcatgccacgtgacgatctaggagtttttgaaggaatgccacgtagcgatataaaagcgtttgcagtatgttaaatgaagttttagtatatactctctcgattccattttgattatcacgtaagcagagggtgtggagagcaagcataaccaaacttttatcattttgtaattgattatcattggttaaggtgatacatattttcgtgtcctctgagttacatcaaatttaaatattacatttagttgcaccaatagaaattagtcttggttggttacacgcagcacattaaatgatgtttattcactatttacacataaaaaaaataattgttagagaaagatcattctgagaagacctaaaaatgcttgggtgatcatcaaattgaataaagggagtaatagactaaccaagtaagttcaatggattagaaaatatatatgttaacttcttagctgaaaattttaaatttctcagaaaaacatgtagaatataaaataaaaagtccaagcaacaaaaaaaaagcctccatttatctataaggctttgttccatagttattcccaacttcacctcgtgtttccatgcgtatgcttcccgcgtattttaaaacattctatacaaaaattgttttaaaaaattatattagtttattttaagtatttaagcaaatactgaattaattatgtgctaatccaccgctatgttttccatacgtggagcctccagtaaagaacacagcctaaagtagccggtagaatcaccaccactaataccagataaagaaatattgtaaccatcattttgtttaaaatgtggaaataaatatctcattcacggattctcaggattcacttgccgtatattcttgtcatttacaaattctaattttttagataaatgaatcattaaaccacacaaaacaagatctacctagccacaaacacacgattttcagtgacgccttcaaccatctccgctctgggccagcgcactgctcctgctcgaaggcctatcgttgccaccgctcaccactcagcgggggttcctagggtggctgctagctggcgcgtgtgcgccagcagcgagcacttctctcctataacttctctatattagttaatacttaacactaataacgggtaattagagaagattcttaagatttttctttcttttttgggatatttttttactaacagattgaaaatttttaagtcagatttgaaaactttcgatttaagatttaaattttaaagtcaacatttgaaaactttcagctcgagatttgaaaacattcaacttagattcaaaaactttcaactcaagattcgaaaactttcaagtccagatttaaaaaatttgacaactttcaacttgagatttgaaaattttcaactcgagatttgaaaactttcaagtctacatttgaaatatgggtaaattggaaccatgctattataaatttgcaaggtttgagatatgccatcggtatctcaataacatgtaggacccacatgagtcaaagacatgtgggtcaggttggcatatctcaaattttgcaaaattataatggcatggttccaattttcccttaaaatatttgaaaactttcaactcgagatttgaagattttaaagttaagatttaaaaattactagtaaactaatcattagtaaaaatagaaaactaatctaatctaaactaattacgattttttcccctattcatacggcaggaatagcgaacagcaaaaaaaaaaagaataaaagaagaaaatggcggcgtcaaaaaaataaagaaaaaaacagagaagaggcgcgcgcgtgggccttgtgggccagaagtacgcgccggcaacgcgcgcgcgccaattagcgattccgggttcctatcgcgcgcgtacgcgttagcagtttagctggcacgcacgctagctgggcccgtccatgcacggttctcatcaaatgtacatgttgggtaactccttgtaaaaaagttatatatttttttttatttttttctgagcgagttgggctgatattaaatattcgatgcaatttattgttttgcattagcatgctaatatgttacacatttactatttttcaatattaatatagtaatggccccattgctatcacaacagagtcgcccatattgcgtgataccagattaaatatagtactataaaagttcaacaaccaactctctccttacatccttacatccttgctcacgtttttttattatgaaatataattccggcatttgctcaacgagctacaaccaattatatattacaccaattcatcttacttatatgtaccaaaatatgtatcgctagagaaacaaaaaccttagacttaaacaaggtagtatagtttggttggccgggatgtgtttcagtaatttagatttattcgatcaactagagaaagttggggctttctccataaattcttaattgatgttgtggtatgtgaactagaaacaaactattttgaatatgttaccttgcacgtatagagaagaatatgttttcttaaaggcaaattttactacaagacattgcgacttcgtggttttagctatagcacaccgcacgaacttacgttttgggaaaacactctgtaaacgtggttattacgaacttacttttggggaaaaacactatgtaaacgtggttatttatcagcggacaccatatctattaaaatattaatttttgattgaataggagagataaatagcgtgaaaggttaaaaaatgccccttgtccgctcatcacgaggtagtggcgacctgctgcattgcttgatgcttctctgtctctcgatcaagctagctatagctcatggacacatacaattaagcaaaacaggaacaatcgcactaaaaacaattaaagcagcagcagcaaaacgccgcgccgccgctggtgaacgtgtcggtgctatctccaacaggcgttgcgttggtggagagcaagcaacaggccgggtcagcagcaggtgaccatcgtggggtcagccggacctcgtcatgcacgtacggctgcttcatcgatgcctacctggagcgcggcctcgcccggccgcaacctcaacttcgcgtttgatcgacaggcctgcggcggagccggcgacggcgagaccgtcctggccacggacgccatccagttcgaggcgctcggcaaggggggattccacgcgatcgagctacgaggtgttgctcgaggccaccggcgcgacaaggggcggcggacgtattagttattgcaggttgctcggcgtctacctaagagactaagaagaagcacgagggaggaagagtacggaggggcaatttggtcacccgcataaaaatatggcccgcttattatttgaaatgcattattttaatggacgcggcgtgcgctatcaaataaccggaaccggctcctctgactttacagcagcacgtcacgccgtaacgtagccatcgcgatccaccatccaagctgatccaacgacgctccatctttgctctgtgtcatcgatgcaactcccctctgttaaaatcgtcttcttatcctaactagcattttggagggaaaataaaatggtaaccatgtttgccgccaatatacagatttcttcactctgcttatctgttatgatcgagttatacgagggaatcgagttataccaggaaatcaagcgaggatgttccattgaagaaggcgatggtgccacgtgaacactcgaagcataacagcataaactcaattagttgaagaaaatgcttctagaagcattgagaattatatacaaggatatgagttcatctcgagctacactgaattgctgaaggtatagttattcgccggacataattatcttgcatattcaaatgtttcataaagagactataaaaactgttgttcttttctaactcatgctcttaaacgatgcagggttatagttcagagcttttatatcacgacatgacttgagtttagagtttactagtattagaagtttcaatcttagctatttttcatatattcttgtcagaaattttgagggttggttatgttataagatggatgcatatcagaagtttcattcttattctgttatttttcacatctcttgccagaaagaaatacatgatcgtaattaagtaagaagatgacagagtgtgctaattaatgtaggacaaggagcaaagacggagcatccttggatcgccctgtacggtggatcgcgattggttacgttacggcgtgacgtggctccgtaaagtcagaggagcctgttcccaaataaccacattcagagagtgtttttgtcaaagtgagtccgtgtggtgttttacagttaaaattacgaagtcgctattttctaaaggaaaatttgccattttaaaaagctccgactataaaaattaaccaaatcaattagtttattattttagtttttctttgttgcaatacaatgatattttaattactagtacgagaacaatcgtaaccatccttttgttcctaacatggaaagatgtcattggcggattcccaggattctcttgccgtatatccatgtcttttaagtacgtattataattttttggtggagaaaaatcattaaaccacacgcaacaatatctaccaacaaacaaatcaaataaatacatggccggttcttaaacttgtggggtgatgtcacttaggtccatcaacttaaaaattatatatttaggtacgtaaacttggtataatgtaccacgctcggtccaatcgtcctttgatcatgtttgaccgccaacgtggcattccacgtagataacacttctgtgctcagccccctccacatatatcttcgcacataacttgccctgaccagtgcatttaaacctaaatccctcaaaatattcctaaatcggctagagtttctatagtgaggttaacggaaggaggccgagaggtagcgccgtagcggctatggcggcctcagtggtgggattagcggcaggaggcagcgcagtgaagcggggttagcgatggcacaatgcgactggattagtggtgggaggcagcacaatgcagcttgaacgctaggcatctccatggattttctaagcgtcctcgtcttgaagtcactggaagaaggtattattgatcaagtgcccgttgtgcatcgataaggttattttggagcgcagagcaatgtcaattgctaattgggaccgcattttctatacatgcaaggagaagaatgagaggtaagaacgatttgaggattttttttttgagatactagtgtcactatatagctataaggagatatatgcgacgtgttgtgatgtggagggggctgcgagcaaaagtgttgcctacgtggcatgccacgttggcggttaaacgcagtcaaagtatgtttgaaccagtatggtacattaaaccaagttaacggatctaaacatgtaattttcaagttcatggatctaagtgacaccaccacacaagtttagggaccgtccatatatttcactcttgttcttattaagaataagattttacctcggttttcgttagcacgtttttcaaactactaacggcatgattcgtgcctataaaaaaataatatatgaaagtcgttttaaaatattaaatatatcaatttttcaagtatgtagcaattaaaactcaattaattctacgctaatagctttatcgttttacgtgctcgcatttaatcttaatccaaagcagaaacgcacctccttgatgccccttgtccttgtggcagacgtcggacgaaacgccggtgatcttgcactgggcgaacaattgctgatcgctgtcgaggttgttgctgacgctcgcgagcttcctggtgttgtttctggacatctcggcgaccttgcagaggcactccggatcgctcttcaacacctccgccaccgcctcgcagcatggcgttagcatggtggggtcgtcggagacggtcgcgcatggcatgaggtcgtccatgcacgacgccgtccccggctgcagcgtgctcgccgccgctgtgaccggcagcgctggcagcggcggtagcgccgccaccggcacagttgtagccgtctccgatgccgcggcgacggccgccgccactgccattgctgccaggaggaaagggccgatgtgttccatgattgctgtttgtctgaggtgtggacgagagtgattgacgcgcgcggcagctggatttcttccggtatatatacagcagttcataaacgagacaacgtgcgatgaccgatgaccgttcattccactctgtccaattcaggctcgggccctaaatattactatgcgtttcaatttaaaccaatacgtttcaatataattaggatctctagattttgtttttcaaatttcactctttaaaccaatatgtttcgatataattagaatctctagattttatcgttttcaaatttcactctttctgctcgactgaatcggcggaaaggaaacgagtcgttttcttcttcaccctgacaaatgtccgatagtaatcacaactacatcaaagaactctatttcgtgacgacaatgtgaacgtgcatttgtaggcaatagggattccattttttcatttagtaagacaaactaaattgttgcaatgattcttcatgtacttagctgaaatgccactacatatgtacgtgggtgagctttgttgacatagctttggttgtcattggttgtgaatacttcttagtttattgataacgagacatagctaaagaaaggagtatcttcctggtatagttgcaaggcaatgtagataactcaaaaatcggtgctaatagagcttgtccctcgcaggtggaccccccaccccgcctcgtggccacatcgcctcccccggccctagcactgatttatcttcatgttgtgaaactgttgctttcccatcttatttactcgctccgttttcatgatacaagattttctagtattgtcttcattcatatgttcatatggatgttaatgaatcttgacacacacatatgtctaaattcatttatatctatatgaatgtgggcaatgatagaaagtcttacattataaaacggaggaagtatgtaattatgtgtgatgatatagtacacagaagctgaagaaaaatggtgcacagcagctggatcggtctgcttggcctacaagcggcttcttctccatacaagaacgaattaccatggatcgattagctaggccaactgccaacaagaagattattttcgctccagattttattgctagtgtgatgatcaaaagaaaacgtatcgtttgacgaagtggagaattatgtgccaacccaaagaaagggggtttaggaattcatgattcagatatgaaaaacatcgcctttcttagcaagtggttatttcaactactcacggccgatggtgtctggcaacaattgattcgtaacaagtacttgggctcaaaacttgtgtcacaagttgagtttaaagctggggattcacaattctaggccagccttatgaaggtcaagcgtgactttttacattttggcaaattcattatgagagatggtgcccaaattaatcaggtttgggaagacaagtggttgggagaagcaccattgcgataacaatatccttgcctatacaatatagttaggaataaataggatactgtagcaaaagtgctacaaaattaccctccgaatgtatcttggtgaagggatcttattgggccaaaattagtggcatggaataaccttcttccacaaaccgctagcctagtgcttactgaggatcaagataagtttcatttggaatttaacccaaaatggagagttttcagtgaagtcgcattatcttgccttggtacattcagatttgccaaacataaacaaagtaatttagaaattaaaaatcagtggccacagaagccatatcctaattggtcaggatgtcacaattattatatatgctcctctgtttacctttttatttttcatttgtgatcatttaggttaccttacattcatgcaacatggaaaactttaatctgtcaagcagctttatggtttaagagaggtgggctgctgatagtgatagctcagtacgggtattcctccgcgcgtgtatatagtcctaagttaatttcctggggagggtacttctccgtatttatccccgtttgtatggtcatgacgggctatcataaggaacttggcagtcaggggtggcttctcgaagtaccagaagggcatcggaaagagggtattagctaattaatcttatagctaggatgtatgtataatatgtatactagaagtataggtatatattcttttctatttttctttcaacttagcttagatagtttaatataagaatgagtagtcttataattgtgtgtcattctaccctatgaattatattaacccctacttagactatggttattacaagtaatatataaattatttgtacggttttctgtactataatcttccacgggattaaacaaatacgaaatccttggaatactttcgggtgaaatgcaacaatggtatatccgtgcgcttgcggataaactctgtaaccataatataccaggagtatttctgtgccattgttgagaattatatttctagtgatgtcgttaagaaatactaacaagtatttctagcaccgttgccggggaagatttataaaagagattaccattactaaaactttatatttacctttgtataatcactgtcctttgcaggcaaaccttggttgttttcacttttattgtggaaacagggtagtgcatgactgctttcaacttgccagaaaacttcaaagaaaatccattggatttctttcgaagcgtcaagccgcgagttgtcgctccgcagaaaactcacccgacaaagaaaccaatcataccagcgccaccaactttcaagattatggctgacaagaccctcagtgaattcgttgctccctctgctgacaacgtggccactgggctgcaaatcaacatgggagatgtggatttgaatctgaagtccagcctcatcacgatggctctggctagcccgttctgcggcaagcttaatgaggatgccaatagtcatctgcaacagttcctagagatctgcaactcatacacgatgaagggggtcagttctgacactgtcaagctgcgactgtttccgttttccctccttgggaaagcgaaacaatggttttatgccaaccgtgctatgatcaacatctgggacaaatgttcaacgacattcctatcaaagttcttcccgatgggcaaaaccaacgcccttcatggaagaatttcaagtttccagtagacaagggatgagtccattcccaaggcgtgggaacgacttcaggaatacgtggttgcctatccttgtcatgggatggacgactggctgatcctgtagaacttttataatggactcactcccacgtctcgtgatcacctggaggtggcagctggaggaacctttttctcaaagacggtacgaggagccgtcgatctgatagagaaaatggtctccaatatgggctggagcgaggaacgacttcagacccgtcagcgaggcatgcacatcgtcaaggagacgggaatgcttgctgccaagctggacctcctcatgaaacgcttggatgaccatgagaagaggccacaaggctccatcaaggccttggactcacacgtcacgtgtgaggtctacggcagcacgggccactctgggaatgactacccagaaacccgtgaagatgtgatgtacatgggcaataacaacggattt

SEQ ID NO: 32825 - DNA, 2736 bp, Oryza sativa
tgttacttgagaagcaccatctggaagcacggctgatgtagaagttcagccagaaaagaccgtgccgtaggagtacggacacacgattgctgccatttcctcagagaagcaggaaactgtcaatagacaagcagttcgctcgttttgttgaggtgattcagaagatccacatcaacgtgccattgttggatgccatgcaagtaccaacatacgcacgttatctcaaggatttactcaacaacaaaagaccactcccaacaactaaggtggtcaagctgacggagcagtgcagcaacgtcatagtccacaagctcccagaatagaagaaggatccggggtgtcccatgatcacttgcttgatcgggacacataaattcgaccaagccctctgcgacttaggagcaagcgtaagcgtcatgcccaaagacgtcttcgataagctcaacttcacgatgttagcaccaagaccgatgcgcctacagctggccgactcgtcggtccgctaccatgctaggatagcggaggatgtaccggtcaagattcgggatttcttcatcccggtcgacttcgtggtgcttgacatggacactgaaaaggagatgccgctcattttggggcctccgctccttagcaccgcggatgccaacattggtgtgggaataggaagcatccgtttccgtatcaacaggaagaaagaaaaatttgagttccagccgaggaccgaacaatgctccatggtccagataaaatacgggccaaacccgtagaacatccaagtggtcgaagtggagcaacccaagacggacaacctagtgaagttcatgcagaatttcctggaaaaggaaataactattcccaggaaccgttattggaagatgccggtgaaacccaatacactggccaaaaagttagagaagccggctcagaggaagccgtctcccacaccaaaaccaaagaaggtgaggaaggaaaagcaaaagacgcccgctccatcacctccggaggtgggtggaaaatctgtgaactaaactgaagggaggtacggtcttgcacgttggacccaaaatggcacgacttcaccagcaggtaaattggtatgtaccggatatttattttcatcaatttgaacttttgcatcacacaagttttaatttcaaaatttgcatttaggattgaattttgaggaaattacttgaaatgaattttccagagcaaaccaaaataaaattttcaataaaaattcgctgtgccacgaccacactgaccgttgtaatccaacggccgaaagtagggctagttgggcccaccaggggttcggcccaaccagccaggccaacgatcgggtgcctctttctttgaggcaacgactagtgggccccacaggtcagttgtgaccgttgtgggtgcactatataagccaaccggccaggagagtgaaatccattccatttcaactcattttcattccctcttcaagctttgctctcaaagttcattcaagcattgctagtttacctcaaattcaaacacttagctgcataaaacaagttgctttggtgaagctaaccagcgggtgaaacttttgttatgttaaccccgcgaggttagtccattcttgtttcctttgtgcagaatgaggaggcgactgtctggtgatttaagaagggaccgggctctccgttaagtcatcatgacgagtctagcactcattcatctgcagacatctcgatggaggatgctgacgttccgtaacgtctcttgagcgacgccgacctcgaccttgtcggtgatcaggaaaaacaagcctactacatgctgaaggaccgtgagtattctcaagctagtggagtaagaacaaaatagaaatcagagtccggaagtcttcgggagagtttgggtacggctctagcagctctccttatttcttttgtaagacttgtactttatttagaatactcttctttatacaattctagtattgtagtactttcaaagtatatgaatgccagctttactttatatctgagttatattgattatactgctagcttatctgggggatgcaatggtacgggtatattgtttgcttgtgcaattactctatgtcatgacgatgatattagagtagtatctggtagtttaggcgaggtgtctaaaatactgcgtatcattattttgggttataagctgcggaagagaggtgggttgctgatggtcacagctccgtacgggtattccttcgcgcgtgtatttagtcctggttgtatggtcatggcgggctgtcgtaaggaattcggcagtcaggggtggtttctcaaagtaccaggagagcatcggaaaaagggtattagctagttaattttatagctaggatgtatgtataatatgtatactagaagtataagaatagattcttttctatttttttcctcttaacttagatagtttattatgataatgagtagtcttatacttgtgtgtcattctaccctatgaattatattaacccctgttagactatgttcattacaagtaatataaaaattatttgtacggttctttatactataatcttcccacgggagtaaacaaatacgatacccttgaatactctcgggtgaaatgctacaattgtatatccgtgcgcttgcggataaactctgtaaccataatataccaagtgtatttttgcgtcattgctgggaattatatttctagaaatgtcatttagaaata

SEQ ID NO: 32826 - DNA, 1245 bp, Oryza sativa
  unsure (1)..(1245): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttcttgtattgccacgcgtattggggaaacccaaacttccatggaacattggagcaaatgccccttgttcgtccacggtgttcttcatttcccaatgctttcgtgaggatgtcatcctcgcgttttggtgagcagacctcttgagaggcctgtctctcagcattcagttcgacctggggtacaattaggacgcgttagacgaagaacaagatatagcataatgaaacttattctatgtgttcaacttacgattttctggtacaccgcttgatcttcgggatttgggaacgaaagagttccgtctctattctttttcacccttgcccttgcccaattccttgcccgctggaccgggatatcaccaagcactggctgggtgttagattccgctgcagcttcatcctccttgtcccattctgcctgtttccctgcgtagcctccggtgccaagccggtgcgggtcaaggttcctggcctgcagatcacggtaggtctggcttttttcccgagactcattcattgatttggcggcatggaactcatcccacacgggtttggtgatgaatgggtatttcacaaatggttctggctgggctgggttgaggacgtacaccgtgaccagcgttgtcttgaaatttttccaacaattccccatcttgcggatagcctgccgcttcagtcatagctcggcctctgcagggtatcggaagctttccttgaactgcctccatgcctcttctttttcttcttgagggaccagatcgatgtggtccttcagaatagtgaagttccgcctccctaggactctgcatatcgtatggaactttttgacagctttcgtcggagccgtcggatacccaagatcgtccacctctgttatggtgtagacttccttaggaatcttattttgggtcctaggattccggctcgatgtagtcccagtagtggtcgtcgacatcggttcgccttgctgcgacatgtcctatgtcactgttgtacggggagaaagtactttttaaacacaaaattgcatctacacacattctcttatggtttgatgtacctctatctcctacctacgttcgcctcatcgacgaaaccatagcatccatactcaatagggccggagcagccgggaactcgacctcgacatca

SEQ ID NO: 32827 - DNA, 3578 bp, Oryza sativa
gatcccgtctgctccagccctaaggaatatggatgctacatatctgctgacgaggcggatgcagatagaacacacaggcaaccaaaacccttcctatccaagagccctaacattatcatcagcaaactcctagattgcgtcaaagatcatttcgttatggaacccttattcccatagatacagcaaccatctttggatactgaatttatgggaatggggttccataaagaaatgaccttgaaaacaatctaggatgttggtaacgataaaagatttctagaaatgttgtatttgaacaaaatgttctgtttaccaatttgtcttggtcggtaccgtgcaggcagtaacccgaccaaaccagatttggcaactaggacacttcgtattctccgaaatgccataatttcagtaacttcatttaataacagatttctattaatatacatcccatttccctcaaaatgacccaaaacagcccatactacacaagtcacatatatattattttttacctaaaataacacaagtcatgacatataataagtttggcctcagttttgcttagaaattatgcttcaattatcaccatttgcaactgcccccacccccaaaagaaattaagaacaagtgtagagggctgtccttatgcaaaaaagaaacagccatataaaaacatccataattattcaaccatcacaacccacatcaattcatccatcccattggaccaaaaatatcccaaaaattttgcaaagaaccatataagaataagtctatagggtctgtccttatgcaaaaaaagaaaaagatgagccatataaaatgatctcatactgccactcccccccaaataaaatgaacaagtgtagatggtctgttcttattgaaaaaacccaaaaatcacaagtgtatatggtctgttcttatccattaaaaacccacatttaaacctaaacaagaacaagagtgaggccggcccaaaaatgcatccattttgcaaaacatcccgtactgccactccccccaaataaaatgaacaagtgtagatggtctgttcttattgaaaaaacccaaaaatcacaagtgaatatggtctgttcttatgcattaaaaacccacatttaaacctaaacaagaacaagagtgaggccggcccaaaaatgcatccattttgcaaaatatcccatacagccataaaaaacataccaaaacacatttcccccaaaataattcaaccatcacagcccacatcaattcatccatcccattggacccaaaatatcccaaaaatggtatgttcttgagcaatcatcactggccattcatccatcatagcccacaatatttcatcatcacagcccacatctaaacaattttcatcacatcccattctcccccaaattcacaaattcatccatcacagccatataaaaatgtatcagtagctaacacatatagaaatgcaccagtcatcacagccatataaaaatttaacagtagctaacacatatagaaatgcacaagtcatcacagccatataaaaatttattagtagctaacacatatagaaatgcacaagtcatcacagccatataaaaatttaacagtagctaacacatatagaaatgcacaagtcatcacagccatataaaaattcatcactagctaacacatataaaaatgcacaaatcatcactagctaacaaaaaaattcatcactagcacaaggcatcatatgtagacattagcatctaaacattgaatcaacaaataatcgcactatcagattatcgaatttaaacattatcatcgaatcatcaaatcatcacatataacatgtacacagcaaatcatcacattatgcatcatcatcggtgaggagtacctaccttgcacggtggcgggctcggtgaggaggttgacgtgggctcggggacggcagtcttgggcggcaccgggctcggggacggagtggaggaaggtgccgggctcggggacggcggtcttgggcggcgccaggctcggggacggcgtggagggaggtgccgggctcggggacggcggtcttgggcggcgccgggctcggggacggagtggagggaggtgccgagctcggggacggcggtcttgggcggcgccgggctcggggacggcgtggagggaggcgccgggctcggggacggcgtggagggaggcggtggccgtcggggaggccggatcttgagcgggcccggaggaggtagcggcgtggaggaggtcgacggccgccgggcgtagatctggagaggaggatgtgaggcggccgtggtcggtgaaggacccgtggatcttcgagggaggaggaggcgacagcgttgaggacgaggaggcggcggcggtcgatgaagccggcggtggcggtcttgggcatggaggaggcggtggatctgggagagtgagagagtgagaggcggcgtcggcggcggataaggacccgtggatgaggattgactaagtaaaccctagtcaatcctcatctctatcgggcagactactatacccgatgcggatggcactcatccgtgacgggcgttagtattatgcccgatacaggtgatacctatccgtgacgggcattagaactaagcccgatagagatggaataatctctatcgggcatagtactaaagcccgtcacagatgacttattaaaatatttttaagttataaaaatcatttataattatcttctaccagatttaaaattgctattacatttgttatcacatataattaacaaatgtcttatttacatagtttaaaattcctattaatattttaaattcatataattgacaattgcctttctcacatatagttaaaattcatattactttttttaaattcatataattaaaaattggctatctcacatatagtttaaaataacaagtataattttttaaaaccacataattaacaaatccatttcttcaaatagttttaactggaatggcatgaaacatatgcaattcattcattaaggctccaatacaaattaaatacatcattcacagtgatatgccttccaaatggtgtgaacgaacgtaagccacttagtctttgggatcatcgtcaaggtcgatctgaggtctgacatgaagattcttgttgtattcttcttcatcgacgacgttgtccacccccacaattcttcgcttgccatccctaacaacgtgcatcttcttgtttgcagggtcttttatgtagaaaatctgttcggcctgcttcctagtacgaatggttagtctgcgtatccaaccttggccaggtccactaatgtgaagccttccttgtcgaccttgacacctgtgcggatattcacccaactgcaacgaaataaagggacttttaagttcagatagttcagctcccatatctgctctatgcggccatagtatgtgctcgatccagcctgatcctgatatgcatctagatggactccactgttttgcactgtgctctcacatcttgtgtgacggtataaactgtgtatccattgatatcgtacccttgccatgtatcaacctcccaagata

SEQ ID NO: 32828 - DNA, 700 bp, Oryza sativa
tctgttctgaacgtagaacttcagaattcccatgtacctctcgaatggccacatttctctcataaaagctggcccacatatttttgtttgcttcactaggtgaacagtgagatgaaccatgatatcgaagaaagctagtggaaaatacatctccaagtgacacagggtactgacaatatcggcctgcaacccatctaggtcttctggatctataatcttctgaccgattgcattgaagaaggcacaaagccgttggatcgtgtgacggacttgtggtggtagaatgcctcttatagcaactggcaagatctatgtgattagcacgtggcaatcgtgagacttcattccaaccaacgtacttacttattctcgcgcaatagcccgaaggaactttaatatctgccagacatgatagcattgcgatcttctcatccttcgacaatgtgtggcaagctggtgggaggtacactcttcccgtcctctcatctgtaataggctgaagttcactgcgaatgttcatctcctatagatcgagacgcgcattcaacccgtcctttgtcttgccaggcatattcaacaatagccccagcaagctatcgcacacattcttctctacgtgcatcagatcaatgcaatgacggacctcaagatcttcccaataaggtagccgccaaaatatggattttttcttccacatcct

SEQ ID NO: 32829 - DNA, 1164 bp, Oryza sativa
accgagccccgccaaagggtagccgcccacaatcataccaccatggaggttgtcgtcgccgtggaaacggcttgctgtccgcgaacctcctccaccactgctgcctctggccgtggaggcgccaccgccgttagatctggaggggggatgcagaggaagaggatagggggggggggcagggatgcgagaaaggtcaaaagagagaccgccgcttgttgtagagaccacccgcggcctccccttgggcgccgccgccccaccaactcccctctcaccggatccggcggaaggaagggcgccaccaccgcgcgccgcctcctctcgagcgccgccgcctgcctcctgccgcctcccctcccaccagatccggcggaagggagggcgctcccgccggcgggacctccgcccgccactgcccctcgggcgctaccaccgcccacggctcccggcacgtacagagagagggaggggatggaggacaaggaggacaaaatggagaaggagaggagctgaggagataaggtcgactcggtgaggataaggtcgatcaatttttattcgttgaggacgcacacgaatcaatcggctcggctcggtcagtttcgatgggtgttggttttttataatatattataggtgtcggtactttaaaaaccggtactatagtatattataggtgcaggttattttaaaaaaccgacacctacagactacaacattggtgccagtttttctgttgaaccggagactacaatattggtgccagttttttctgttgaaccggtgcctacagtgcttaaaggtgtcgatcttttatttttcattgtgcggaggtggaaaaggcttataggtgtcgattttaattgaaccggcacatataagactggtctctacaagggttttttatagttaaaccaacacctatgggtttcttggggatgcaccagtagcccgatagatgctggtgctagctaggctagaactgttatctatgatatcacgtaggtgcgggttttgaaacagaaggcgggacctacggggctgctagctcattcctaggagccccatagccatagatacctattctatgcgataacgagcacctataatcctacagcaaaacattggctgctatgaatgtaccgccattagcagccataaaat

SEQ ID NO: 32830 - DNA, 513 bp, Oryza sativa
cgtgatggagtatttgcatgagttcaacaatctggcccgttatgccccggaggatgtgcgggaagatgaggagaagcaagagaaattcctggcaggaatggacccagagctgtccgtccgtctagtctctggggactatccggatttccaacgtctggtggacaagagcatccgcttggaaccaagcacaaggaactggagtcgcacaagcgccgcttggcgaatttccgcaatcaacagggtgctaaccaaagggtccgctacaccaatccctatccagggggatcctcctcgcagcagcagccgcagcagcctcgctccgcgcctcgacctcaattcgtggtgcgcgtcccacagccgcagcaacagcagaatcaacaagggactcgtgcgccccgtcctcctacgccaactgtgcagcctggtcaaggccgcagggacgctcaaggtcagcagcgtctgtgcttcaactgcttcgagcctgggcactttgcggataaatgcccaaagcca

SEQ ID NO: 32831 - DNA, 1701 bp, Oryza sativa
tactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacacaaagatatattttgtagacggtattattgtccaaaacctcaattagaatgaaaccgaagggagtaatataatttccacttaaaccattgtactactttgtactattattttcaaataatacactattttaaaataaagtttacacaattatattgtgtacctatcaaataaataatttaagatctatattaactaatttatacgtgcactcccattatttaaatcatccgatatatttttttttacattggactatcattctataataatgcattgtttcaacataaagtctacaacattatattgtgtacccactaaattaacaatttaaaatgtatatcaacgaatttacacttacactaaaaccggtggatccgttatttaaatcatcggatctattatttgctaataaataaagcatccaaagctccctttttggctcggtgcacaatgcacgtctgcacatttgccttttgcacacgtgacaaagcgtcgtgtctgaggcatgatcacgaccgctgcagcgctaccgctttgctacatgtcaaatcatatatggagataataaattttgttaataacatgaaaagaaaattaaaggtgtgatgcagcgagagaagaattaagcaccgtgggttgtgtttttggaacacttagttccatttaagctgaaccaagagttgattacataataattataatgtattatgttatgtcgtatttgaattttgtactatttgttcgtacaggtgaaagaaatcattatattataaatatgagcacaatattaaagaatatcaatagaactcttctaagacaagggagtttaagaccctctttttttttgattccatagtttggattttcgtttgcacgcttttcaagtttctaaatggtgtcttttttaaaacaatagtttaacttttagaagtcaattcattcgtttataccctcaaatagcaatcgcataaatcagataattcatcaatttcagttgtcctaaacccgcgactcatggtggacaattggggatcgacggatactcaaagtcataatatgaatatgtaagagctactatgaataactgtaaataggtgtcaaaattaattgctattaattagacatctaatggcttgcttgccatataattactttctctctacgtgtatataaacatcgacgaagctggaacaaatattaccatatgccccatacatatatattaagcggttaatattgtaattacatgtgttaagtcctttaaaatttcttaaaatgctctcaagctatcacgtggtgctctaataaattagagcaaatattagaaattctatcaaaaaaagcaaagcatatattacttgattttcacttaaatcggtacgtccaatattataaaccgttcga

SEQ ID NO: 32832 - DNA, 9921 bp, Oryza sativa
attttcccctttcttgttttttttccatgcatacggcttccctccctttcttattatggcatgggccttcatgagacgatttaatcacaagaattttgcatatcttgctctcgaatttttcatttgtggacatactacacgatatgtatatggatggattgcatgataattaattaactagtaatagtttcttatttactcgagaaaaaaacatgattcaaaagtggtaagtacttaatccatctcctactcaaaacggttttttagataccttaagaaaaatagaaccctaaattattataaaataccatcatcccagctttagtttacccttaatcttacaattttgacaaaatataagtacccgtgcatgcgcgtgggccatcttcctagtaactttaaaaggaaatgctgactggattgccacgcgtacgccaggtaggacaaaaccgctctggattctgttgaaggggggggttaattcgtccggtataaaaagtttggggtgagtgatatctggttttcgggttaagggggtaattcggtcgatcgcgatagttcaggtgctaattcgtactttttcctttatttatttgtgtagagagtaaatgttcattgtggaatgttctgcatgcatacatgcaaccaattaagattaatttctattagttaaactcacaatgtttaaagtgtgaataaatttttgttggacacgaagtgacggagcacattgattaatgtggattaatttcaaaatgatggatattacatttttttttattttgtgcactttgcttagaggatgatcaaattagaatagaatagagggagcagttaaatgtgtatctgctcctgcataggaaaaatactccctatgtttcatgttgatcatcatataaccaatgtccgaccggcggcgtgtgacccacatatgccttcatgtatgtcgaggaggagttgtctgccgtcgtcggtagagacgcatttgagaagtacaccgtttggcgcttttttgtataaatcgttaccgaccatacaatagatctttgctttacgggttattttctcggcctctgtatcgtcctcgggcaactcctcgctgctgatgaatttgattaatgggatgcgccagtcgtctgtggtttcgatgtcagcaacggcgcgttctgcctcgatgacctccgagctgatgtcgggggtgttcgggccaacttcgccgctaacttctttcaccgatggcttcgtcaggatatcgagaaaggtgtcgggctcgagcggttcttgtctggacgcgcgtcgtgctaggtcgtctggctcgacgttgtctttgcgatagacgtgtcggacctcgatcccatcgaacctcttctctaacttcctgacttctgcgagatattttgacaactcggggttagagcatttgtagtctttgtgcacctggtttgtgactagttcggagtcccctttgacgattagtcgcttggctccaagtacggctgcagctcgtatcccggcgagtagtccttcgtattctgcagtgttattggttgccctgaagttgaggtggattgcgtgcttgaattgatctccggagggagatgttaagataaatcctgcccctgctccttggctgttgagtgcgccatcgaacgccattgtccatgtttcattgtcaccttggttgtctgatttgttatctggcatagtccaacttgcaacgaagtcggcgagtacctgggatttgatggcagttcgcggcacaaaatggacatcaaattggcttagctcgactacccatttcgcaatgcggctgacgacgtctttgtttctcacaacttcgccaagggggaaggaggagacaactgtgactctgtgggcttgaaagtagtggcgtaatttccttgatgtcatgatgattgcgtaaagcagtttttggatctgtgggtatcttgtctttgcgtcatggagagcttcgctgacgtaataaactggtcgctgtactttctctctctcgacgataatgacggtgctaacggaatatggcgtggcggcaatatagagaaataattcttcattaggttggggagcaacaagtacaggggggtttgataggtagcgcttgaatgcaataaatgtctcttcggcttcctgtgtccatacaaatttgtcttgtttcttcaacaaagcgaagaaaggttgtcctcgttctcccatcctagcgacgaatatgcttaatgctgccatgcaaccggttagcttttgtacctccttgagtcttgtgggcgacttcatgttctcgattgctttgatcttctcgggatttgcctctattcatctgccagagacaaggaatctgagtagcttgcccgacggtactccaaacgtgcacttctcaggattgagcatgaggcgatatcgtcggagtttgtcgaacgttttcgcaatgagtcgcttgtcttggttttgacaacgatgtcgtcaacgtaagcctcgacgttgttgccgagctggttgctaagtgcaccctggaccgtgcgctggaaagtattcccggcggttatcagtccgaaaggcatcttaacatagcaaaataccccgaacggcgtgatgaacgctatcttctcttcgtcctcttttgcgatgctgatttggtggtagccagagtaagcgtcgaggaagctcaatagctcgcaaccggctgttgaatccaccaattgatctattcgagggagaggaaagtgatccttagggcacgccttgttgaggtcggtgaagtcgacacatattctccattttccgttggccttccgcaccataactggattggctagccactctggatgaagtacttctctgatgaagccagctttgagaagttcgtcgagctcttctcgtatggcttgtttccggtctggtgcaaatctctgcagtctttgcattactggcttggcatcgggtcacaccatgagtttgtgcccaatcacctccctggggacccccggcatgtcggacggctgccaagccaacacatcggcattatcacggaggaacgtgatgagcgcgagttcctatttctcgtttagtgtcgccctgatcttgacagtcttgtcggggttagccctggagagtggaacgatcttgatggtgccgtccggcttcggcgtcttatttggcttgctcactttcttgggtggctcagtcgtggcgggtgggctgggtgtttgctcgaccatgtcgaggctccgcttgtcgcactgcaccgccagctttgcgttcccttgaataatgattgttcccttcggtcccggtatcttgagcacttgatacgcgtagtgagatgcggccatgaacttcgcaagtgcagttctcccgatgatggtgttgtaagctgtatcgaattcagcaacatcgaaggtgatctgctctgttcggaagttgttggcttggccgaaagtcataggcaacgtaatcttacccaaaggtctagacgatgattggggagtaattccatggaagggttgatcggttggtgtcaactcactttgcggaagtcccattgcgtccagagtgctggtgcagagaagattgattgagctgccaccgtcgataagaactcgcgctaccttgatgttctgaatagtgggttcgaccacgatcggatatcgtcctgggatgacggaggttttggggtggtcttcctctgagaactctattttctgctcagaccacttcatcttgggtgcagccccctgccacgtcgaacagacttcacgttccactttcttgtattctcgcttggaggaatacgttgtggagccgccgaagatgtgtgagacgtggaggtcggagtctggatacgcagaatccggttcgtgaggaggcatctcttcgttcttctcgacaacgcgtactcgcttgcctttttcaaacgccatgtgcttctcgagcgactttttgaaaccaatgcaatcctccagagaatgtttgtccgttttgtgtatggggcaccatgatttctttgtgtcgctgccttgtgggtctgggcgcttgggagggttcgcgtattctgctgcgaggacttccgcttgagctttccttttcctatttttgtgatttttcttcttgcttgactcagatgcgtctgcggctggtttcttctctcccccggtcttcggtttgtcgttcttgcgtcttagcgcgtcatccacatgggcgcatcactcaacgatctcgaataatctccgagtagttgtgatgcgtcttgtcggcaactcctgggtagtgtagcgatctctgacaccggacttgaaggtgcgaattacagaagagtcggtaatttcgggaattgtgtttctgcactcgttgaagcgccgaacgtattccctcaatgattcccccgagttctgtgttaacgcgtgtaagtcgtcttcgatcgcgtggtgcttgtatgttccttggaaattggcgacgaattgttgccacaggtctgcccatgaagagattgagtaaggaggaagatgcatcagccatgaacgtgcagaacccttcaacgcggttggtaaatagttcgctaacgcgttgtcgtctgctccggcagcatagagcactgtcgagtagacttgaaggaattcttctgggtcggtgctcccatcatactttttaatggctctgggtcggaatctctcgggccatcggacatcacgtagggaacgaccgaaagccctacacccagcgttgggggcggtgggttgtcggcggtcgcgtgaccttcgtggatgtctgtctgacgatgaagaggatgcggatgatgacgatgacgatgggtcgcttggttccagcgtacggttacgaggatgatgacctggatctcgggaatcctctcgttgtctctcgctgttgtctcggcgccgatctccatcgtcgtcgtcgttgcggcgacggccatgaccagtattgtctggcccccgttgttcgcgatcgttgtaatctcggtcctcgtttgggcggtttcctcgatcatggcgccgtgaagagacatgacgccgagagcgatttgcgtcgtcccgtgtgcgtcgtgcttttcggcgaccgttgatttgatctcgaagatcgccagtgccacgaggtggaggggtagcctgtcgaggtaattccctctgctccggatcttcaccattggcgtcgccgattcgtggctgatcttggtgtgctgcggtagcggcttcttcaaacgcgttgctgaggttggtcatcgattcccgtaatcgttctatccaacacttgaggtcgtcgttcagaacgggatcgtaaggagtttccctcagtatagcttgaacagccctgatgtgctgggctggagtagtcgattgattcgccgcttcagcgttggcttgcgctgacgtgccaacgccatcgatagccaatacctcccgcggcgcacttgttgtcgatgacccatagtcctcgaggagatgtaagaccgatggttcgtgaggatcgtgtcacgtcccaaatcgactctaaaatacatcctcgaaattgtgccgagaataattaaaattcatgtgaaagcctccaacaagtaaaatgtgcaaatttaaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagtcttctttccccccctttccctcgtgggccggctcggcccaactctccctccctctctctctcctctcctccgcggcacatcggcctcctccccgcgcgcgcgccgctgacaggcgggcccgcccgccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtgggggggattattccccgcgattccctctcccgtttcccccactttcccctctctctctccctcggattcgctcggattcattcccgaaatcctcgccggcgtcatcaatggagccgagatctccgcgcccgtttcctccctctccggccgctctctctcactcccgacgctatataattgttccccgtgcctctctcctccgtttccgccgctcgctgctcgctctccccgtcggattcgtgctcgcgccgttgtactctctctccaccgtcgccgccgagctccggttcgccgccgtcgtcgctccggacttcctcccgtctcggcgtcacctccatcggcttcgccgcgtcgtcgtcgacctcgtccgccccttcatttcgcccgccgaccgccggagcaccgtcgtcctcgccgtcccgaaccgcgccgccgctttcctccgcttcggccgccgttcccgtcgtcgccgtcgacccggggtgagccgaggaccgcctctttcgcttccctcgcctctccgctctctcggccgccgctccgtcgcgccgttggtcgccggcggtgaccatcggggcgcgggcgcgccgtctcccgtcggccgtgccggcgaggccgccttcgggcgcgccccgcggctgccaggtgggcccggccgtcagccgcccgcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggaatttattagagtaaaagccttttcttttccgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaagtatagactttgggaaatattcatatcacctggatactctggaattgttggattattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccataggcgggattgggtcggtactcttgtctatggctaggatgggttggaaactatgtcacgtctttcgtctgtataccgtggtggtatgtggcacgtggttacacgtgaggaagatgtgtcttgtgggcaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtgacaagttggtatcagagccccccttgaccctaggacgagccgtagaccccaagccttagcaatattttcaaaaataaaaatcctttgttatttgtgaaaactgtctagtctctctctgtcttgctgcttcacttatcatcaaaatctgacctttaaaatgttgtttctctttttgtttttgtttgtagatggccggcagcgtcacccgccgtggtttggacatgactggcttcgtcctggagctgcggggcatgtgcgtggtcttagggtacccacatggagtggactaccaggccaggccgcttccggatcaggagggagacgacgcggagccccacgctggttgggaggtcactgctgtgatcctctctggctctcccgagcggacttcgctggcagtcaccgcgggtggagattccttccccgccgcttgccagaacgccgctctcctcgccatcggcactcttcaccagcgctacccggacgagttgcagcactcgccctaccgctaccacccccgtcgcggaggagcctgcgactacgccaccttccgggatgctagctcggaggatgacgctaccatcgtgcacctggcgcgcatggtggaggcgtacgacgcggctcgtatcgacttccatcagatggtgcgccgcgggatggtcgagaacaacatgaagatcctggagctgcaccaggagaatctgcagctcaagaaggacctcgacgcggtggaggcgcagctgcatcagctcaagatcgcccagggagagatctgccgccccaagcgccgtcgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggagggtgcgctgttgctcaccttccgccctggcccgtcgcagcggtagacgagcagttagtaggcttgcgcgtgtgttctttctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttcagatggtgacgaccagaagaaatgctg

SEQ ID NO: 32833 - DNA, 10201 bp, Oryza sativa
atagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcgggattgggtcggtactcttgtctatggctaggatgggttggaaactatgtcacgtctttcgtctgtataccgtggtggtatgtggcacgtggttacacgtgaggaagatgtgtcttgtgggtaaatgtcacaccctaaaaattcaaataatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgtcgccgccgctttccaaatccggccgttcctttccttctccggccgatttgttagaggggaaatgatctccgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctccgagcccctttaaaaggacccccggtgtctcctctacccgtcgccaccctcgccttcgcctctcgtcgccggaagagctctagcgccgtgtgccctagcttcgccgtcgccgccgccgcttcagccgtgctccgccgtcgctccagctgtcgccgtcgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccattccttctccgccgccgttttggtcaccggtgtgttcgccgtgttgtcctctacgtgctggtgccctccgttggtgccgtggtgccgccgttcgccggtgagtgtgcgccgcccgagccgtcttctccgccgagccgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacactgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgtagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatattgttttatttaatcctgctgcaataaaataaatttaacaagttgattttataactttcttttgaaacctgttgttaaaaagtacaaaatttgtaactttgttttcaactatttcaaattatcttgcaagtttggtttactttatttacttaccttttactttgatttctaaactttattcaaattaatccaaaaacttgtgctattaattggatagatgtcttaactctctcctttcacttgtctttagatgccgcgctacaagcctgagtacctgtttggtgttgaagggtttgtccaggagttgcgtactatgtcctttgtcattggatttggaactgcccctttttatgcccagattcgtcatgatcgtcatgaagagaggtgccgtgtcaaagtcaccttaaacagtaatagtgaagatattccatcagtgatgttcgaagctggaggaagaaattatatccatgcatgtcaggaagtggcaaggatcgccataggagagctccgtgaccgctacagtgatcagttggccgatactgagtatcgctaccatcctcgccaaccacagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagctagaagacaaggtggatcgcttggagaaggaattagccgcattgaagggagaagcaccgccgcagaaggccaggattcgtctcaccgcaaggaagagaactttgtttgtccctcgttatcaattggcgccaaagatccgcgtggtggagaaagaagttgccccagcaaatcctccggtcatcatcataagtagtgatgaagaagaagaatctaagcgcaaccattccaagattgagtgggtagcaacccaagatgatgaagacgagccttcaattgacctccgatgcttggaagaactagagtgacttgttaagtcgttgtcttagattgttgtgttagtttgcttgcttaaagtttgcttgtgtgtgtctcgcatgtgatttacatcagtggtgggatgtaattgcatgtgtttgtttgcttctgagtgttaggaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgcagcaacgggaatggtcctaacctcaacaaccccaataacaacaacaatggagagaatcccactcttgctcaagttcttgctcaacagacacagcttatgaacatgatgatgcagcaatttcagaatcagcagaaccaaggaaataaccatgtacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatctagctccacgtcctgttgcagttccagcacagcaacaacctgccaagagggagcaaggcaacaagcccgtggtgtgtttcaactgtggagatccaggacattatgctgacaaatgtccgaagccccgacgcgtgaaggttgtccctgcccagaataactctgctgtaccaacatccaaggctcgtgtaaatcatgtcgctgctgcagaagctcaagatgctccagatgtgattttgggtatgttccttgttaactcagttcctgcaacagtgcttttcgattctggtgctacacattcattcttatctatgagttttgcgggaaatcatgggatggaagtagaagaccttagatgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttatagatgatattcttatctactctcgaaccaaagaagagcatgaagaacatcttcgccttgcattggagaagctacgagaacatcaactgtatgctaagtttagcaagtgtgaattttggttgtccgaagtgaaattccttggtcacatcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagtcggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtatgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgtagggatttgagttttgaagaaggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctactgaagaagctaatattgagcagatagaagtccaagaggatttgacttatgttgagaaaccaatccgtatcctggaaacaaatgagagaagaaccaggaatcgagttatccgtttttgtaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctaaaaattcaaataatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaaaaatccacatgtactgttcatgc

SEQ ID NO: 32834 - DNA, 9143 bp, Oryza sativa
gttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacagtaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcaggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacagatcgatatcgattaccctaacgaatcgatctgaggctggagtcgctccttgttccttgccgttatccctgatggggacgtatgacttaggagacggagttttcatggcgccgaggaggactttgcagctcgagaggtcgtgattctttgtcttgtgaataggacaataaacatcccgagttggagaagtacactgaatttgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctgatcagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataaatgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggctcacacgaacggacggccgagatctaaccgatccaagatggacggccgagatcgatcgggtccacggcggttcacggcggacggccttgatgacgccagcaatgacgtcaccgacggcggcggcggctcggcgaggcagacggctcgggcggcgcacgcttgccggcgaacggcggcgcgagaacgcaaacggaaggcaccgggacgaagcgggcggcacggcgaactcaccgacgaccaaaagagcgacggagaagcaacggacggcgacggcgacgaggaggaagcggcgggaaccttcgggttgacgacggcgatgaagctccggcggtctccggcggctgcgaaggggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggcgacgggtagaggagagctcgggggtccttaaataggtgcaaggaggcggcggctaaggcccacggcggcggagacggcgaaggaaagctcggcttggagagaggaaaaccgatccgattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcgggccccacctgtcagcgaccgaacgcgcgcgcgcggctgcggactgggccggctgggccgaggagggagagaagagaggttttgggccgactttcggcccaaagccaaaagaagacttttaaaacctttttcaatttaaattatttcttaaatgcaattccatttactaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaatataaattctattaataatttattaaataatttataaatcctgaaacgaaaatcaggatgtgacagaattccacggtctttgcaggcgcgaatttcagcacggacgttgagaaaaacccagcaatcttgaagggtgtgtttcttggttttgtggataggacaccaagacctggtggcttcggaagtcatctttgtcagcccgtgatttatgtcagaaggataaggcttggccgcatcagaatccttcccgagcttgggtgtagtcggtaatccgttctccatttcgacgggtggatttttcgacatggagttgccttggttcgtagccactgcattctcatttccagtcattggaggaccggttgagatcggcatcgtggtgtaaaccgggaagacaatttcgccgacatgagtccataccagcattgttgaagtagggagtgcttggctgaagctggtgttgacgttgttgtcgacgaagctggatggcatagtagtagaaccttgagtaccagatgcctctacctggcgcgccactgtcgacgagtgatactcgtagaccggatatagagggtattggggtacgctggtacaaggatctacgtagtacgacatcgaggaatcaaaagacaagagttatactggttcaggctccttgataggtaatagccctaatccagttgatatgggattatatgctggaaaacacgggttacaaagggaacgatggaacttgtcggatccggcgagattgtagtcgagtggattcgactagctctcgatgacttcgctcctcgtagactccggcttcgtaggctgtgtgggttgtgttggctctgagattcaatgatctatgccctccccggggggtcccttttatatcgcaagtctagagctctccgagtaggactcgaatatactaggcccaatacgatacgtagataacccagatctatccaagaaggactcttcccatttgttgatttcatgaaaggttttcttagaatatacaggaaatatccgcgtacgcgtgggtatgccatgtcgatccgtaacgtatatagaagggtagagggtatgcctgacccgtaaccctgacagatcacgatataaccctgtctctaacgtgtagtattatcctatctctactattataagaattgaagatatttccgcggtccgtcagctatgtttgagtcggttataaaattgaagatgtttttgtggttcgtcatccgtgtttgagtcagttttaattttatgttttggtattttggtacatcatccgtgtataaatcggtttttaagttcgtttgcttttgaaaatacatatccatattttagtcggtttttaagatcgttcacttttggtatacaaaatgaatcatataagaaatctatttaaaaaaactcgcatgctaacttgagacgatcggacttctaactgcagcacatgattttctatatatatatatatccaagcgaactcgaacagtaaatttcattttatctaaaccatataacaataataatattaaaatagacttcacccgttgcaacgcacgggtatttttctagtttaattatacatgcaaattaagtttgcatgcatgtaaattaagtttttgtttcttgtgcatagggacagttgaagtgtgcatgttttttatttttccccatcacatactcgcatacaatgaaatataggaaagttaaggcttccatggttttagcgagaaaaacttatatgatgactaacagagggagtaaacaacagtgcagatgcaatttgcaactaattgaggcactaataaaaatattttttttctaaatacatggtcctgccttgcagtctggcaaaatttagttcaattttcaatcgtactcaacgtgtaaaatgcactcgagacccttcattttaccttgaaagatcagacaaaactaaaaaaaaaaaaatcccaaatcccttccatccatcttaataccacaatattgcagacgaaatcaaacagggctcagatcagggattcgctgtgcctgacttgactgccctgattaccacgtgtcgaaacatgaattcggcaataataaaagaggtagcgcacgagacctaaaagtggatggatgcagagataaggatttagacagattcagtaccttcaattaagaggtaataccctactcctgtttggggatttgaattcgctgggtgtagtatagatctgacgatctagttgtgtctcctgcccctggagggcctcctgcccgccttatataaaatgggaggcaggattacaatataaaaaccttaaccaatacggtatcggtttcctaaatctactttacaatcttatcaaaccaggactttagcccattccataatatacagggaaacgtaatacccaagtcatgatctgttacatattccatagatataagttatctcctataactagtcggataaccatgccgtgtgggtatagggtacctgtaatctccacagcacgggagatgcctcggacgtcgttgaccaccgaggggcacgcgttgctcattttcaagcgactgcctcgtcgatggccggaggagaatacgggttctaccgacggaggagatgcgagagcatcgtagccacaccgccttgtcgttgccgatgccgccactgcgcactgcgcgagtttggatggagaagccgtgtcaatggttcggatggagaagaaaacgagtctcagcccgatagcctaacgggcctgatggcaaaaaaaagtccgtttgacaaataaaaaaaggaaggaaagagtccaaatacgctagattagatagaagtctatatatagcaccctaaaatttaaaactgtacatccaatcccttactttgtaaaaccgttcatattaccccctaaggtggttctgtgtagtggtttttatctaatttatatgtaaattggatgagtttgatcacgtgatatacacattggacatatatatacatacatatatatatatatatatatatatatatatatatatatatatatatatatatatatatatatatatatattaagtataatatatattacaaacaagtatcaacataataatagtataatatcattgtataaatataaattgatgacttaccactgatgatatgcaaatatattatattagttatttaaagttgttcgtttaaactttcaaaataagaaaaatcaccttacggggtaatatgaacgattttacaaaattcaggggtagggttagaactctagttttaaagttcaggattctagctaaatgaacgaactttcatgtagagtttacgggggtatttagacttttttctatattattctatatacatgatttatcccctattcacagtcagatagcccagccgtgtgggtatatagtacccataatctccacactatatctatcatgccgttgccggttatacagcccctcaccggggttaaccacgagaggccctctatcttgccaagcttgtcgtcgcctcctgcacacaagtggcgaggcgttgtcggggttcggcccctccatcaccatccttgttcgctgcttagagagccaaggcagtctctccggcggcagcaaggtggaggagaggggagacaggggcggcttgggcatgtgcatggacaacgcgggaggcggatatcatccatccacataagtattagatactccctccgtttcatgttataaggcgttttgactttggtcaaagtcaaactgctttaagtttgaccaagtttgtagaaaaaagtagtaacattttcaacccaagacaaattcattaagaatatatattcaattattgatctgttaaaactaatttagtattataaatattactatatttgcctataaacttagtcaaacttaaaacagtttaactttaatcaaagtcaaaacgtcttatatcctaaaacggatggagtagtaagaagttctcatttactgatacgtaacaagcaataaccgattgtgtgtccaccctttgcgtgtcctgaagtgcttagtaggttctaaacaaaacaaaataatataatccacacaaccattaagatatcaaagtcttcacatggaagtcaactgtatcgaatgatcagatatgttaatgtagtgagacgtgatcagcaatatattgctcaaccagcttagctaacatggacagagtggactcagtggtgatcacacgttctctcgttcatgaactgatatataatatactctatatatactcgaagaaatcctgcggcatcaatcgcgctctcgtcacacccctcggacatacagcaatcatggaacacatccgctctttcctcctagcagcactggcagtcgt

SEQ ID NO: 32835 - DNA, 2064 bp, Oryza sativa
gccctcgacggcgatcagcaaatgttcgcccggtgcaagatccctggcgcttcctccaccatctgcgacaacgggcaagcaggtgcgtacttagtcgcaaatcctgctatttattcgatttgtttacgtggaggtcttgctttgtttggtttaatgcatttttcataaaaaaaaaatggtgctccgtgttttgcgatgggatatatgttaaatttcatagaaattgtttgttaatattatcaaataacttgagaatggtcaacaaaaacatttgatgaccatcttttttttttttgagggaattgagcattctatttgcataccctccgtatggttacttttttttggataatacttcaaaaaattgcaacaatcaattggatatgaatctacgctggtgttaccttgcattcggctgtatataatcgcagacgttagatacaaccatagattgacgcttgagatttttcttttccttttttcagttaaactcttattatgtgagaatttaaagcttcagtggtctcccataattgaagtgctaggattataatttttaaagataatgtacctatagtataaaaaatgaaagaagtgcatttctggtgatcttttcaaccgatcgattttttgtactattatactgaagtctaacgagtagtatagttactttcggataaacgaatttctacctttttgaaacgagtaatatattagtttaggacaagcgaatttgcacccttctgaaatgagtaattattttgaaaaagttttttttgacggatttcatcaataccatatgtcagaaaaaaaaaatcgtaactcgtgcggcaacagaaattactaactaatgtcgtactagtatggatgcgatatcttgatattactctgaagcttttgaaataatcaaatcaaatggctaaacaaaaatctactatacatactggaaaattacaaaaaatagatcgggctgaaaaattagaggattggaagttcaaaaagtggttatatatatgcttacgtgaaaacaaattaataatatgcagaaaatttgttcattaagaacaacatatatctctttggttgtcacagctaatctttttctaccataattggcaggtcatggaacatcggcaggctactcctcgacaggtatgcttatacttccttcgtttcagaaggaagttgtttgacttttttttttaagtcaaacttaatttagcaacatctaaaatatattttgatactatgtttatgtttatgttatatatgttaaaattactattatattttctataaatttagtcaaatgtaaccgggtttgcctagaaaaaagtcaaacgatttataatatgaaatggtgggagtagtatatatgtataatattgcatgtatgggatcaagtgttcatatatattactcttaatttacacaagacacacacataaaatttggaaaagtgatatataacattttaaatctgtctatacactacaataaggacttccatatacattattataatgcacatttagtgttttcctccattcatttccaaaccaatggaaaaatgtaatttggtgtgcagcaagctagcatatataaaccaatgtaacaagaatccagtttctatctagctttcgatcgataaggcatgcagtatcccatatcctgagcattaacagttttagcaataaacgtcgtacatttaaacaaccaaacatgttttgaagatagtcctgttttggtgaattgtaggctcccaagcaagaaatgcctcacctcactcgaggttgaccgaggcattccggatctttcttctccttcaaatactgttcattttgggagtgtgaagcacactttggaagacatcattttccatattcatctcccagttcagtgcatgtaaccacatatgcatgttagttgtttgaccgaggtgaatgattcgaagacaatggtcgctgtctagttttatttactatgtactttggatttatgcaagttccacattttttcgttgagggaattatggatacactacctgaaaaactatatctatat

SEQ ID NO: 32836 - DNA, 1187 bp, Oryza sativa
gactacaatattggtgccagttttttttgttgaaccggtgcctacagtgctaaaaggtgtcgatcttttatttttcattgtgcgaaggtgggaaaggcttataggtgtcgattttaattgaaccggcacatataagacgggtctctacacgggttttttatagtgtaggtgttggtttaaccaacacctatgggatgcgagaaaggtcaaaagagagaccaccgcttgtcgtagagaccacccgcggcctccccttgggcgccgctgcccaaccaactcccctctcaccggatccggcggaaggaagggcgccaccaccgcgcgccgcctcctctcgagcgccgccgcctgcctcctgccgcctcccctcccaccagatccggcggaagggagggcgctcccgctggcgggacctccgcctgccactgcccctcgggcgctaccaccgcccacggctcccggcacgtacagagagagggaggggatggaggacaaggaggacaaaatggagaaggagaggagctgaggagataaggtcgactcggtgaggataaggtcgatcaatttttattcgttgaggacgcgcacgaatcaatcggcttggctcggtcagtttcgatgggtgttggttttttataatatatgataggtgtcggtactttaaaaaccggtactatagtatattataggtgcaggttattttaaaaaaccgacacctacagactacaacattggtgccagtttttctgttgaaccggagactacaatattggtgccagttttttctgttgaaccggtgcctacagtgcttaaaggtgtcgatcttttatttttcattgtgcggaggtgggaaaggcttataggtgtcgattttaattgaaccggcacatataagactggtctctacacgggttttttatagtgtaggtgttggtttaaccaacacctatgggatgcgagaaaggtcaaaagagagaccaccgcttgtcgtagagaccacccgcggcctccccttgggcgccgctgcccaaccaactcccctctcaccggatccggcggaaggaagggcgccaccaccgcgcgccgcctcctctcgagcgccgccgcctgcctcctgccgcctcccctcccaccagatccggcggaagggagggcgctcccgctggcgggacctccgcctgccactg

SEQ ID NO: 32837 - DNA, 1418 bp, Oryza sativa
catcctggtaaggccaacgtgggtgccgacgctgtaagtcgaaagagccattgcaacactcttaacgtccgtggcattccacccgaacttagtcaacagatggaagccctgaacctaagcatagttagtcgcggattcttggctgcgttagaagccaagcctaccctgctcgatcaaatccgcgaggctcagaagaatgatccggacatgcatggactcctcaagaatatgaaacagggtaaagccgctggtttcacagaggacgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagcatgaagcgggagattgcagagtttgtggccctacgtgatgtgtgccagcgtgtcaaggcagagcaccagcgaccggccggacttctccaacctctccaagtacctgaatggaaatgggatgaaattgggatggatttcatcaccggacttccaaagacccaaggtggatatgattctatatgggtagttgtggatcgattaaccaaggtagctcgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctgaatcagatcctagaagatatgctccgcgcatgtgtcctatatttcgggaagacctgggataagagtctcccctatgctgagttctcttacaataacagctatcaagccagcatacaaatggcaccttatgaagcgttgtatgggcgcaagtgccggacaccgctattgtgggaccaagttggagaaagccaagtgttcgggactgatatcctgagagaagctgaagctaaagtcagaatcattcgggataatctaaaggtggcccagtcccggcagaaaagttatgcagataaccgtcgccgtgacctggaattcgcagtggatgattttgtgtatcttcgggtcacgccattgcgaggtgtacacaggtttcagacaaaagggaagcttgcacctcggtatgtgggtcctttccgtatcgttgctcgacgcggagaagtcgcttaccaattggagcctgcccgcctccttgggcaacgtgcatgatgcgtctcatgtgtcgccactcacgaaatgtccttcagtgccatccgagcacgccgactcacagcaaattgaagttc

SEQ ID NO: 32838 - DNA, 872 bp, Oryza sativa
caattttgggtccagttttgcatcttgtcggttgttgccgggaccttgaaaaattgaatcgtctcgtcatcgggtttccgtttttgtgatttggagaaatttttatcaaacggttttggagttgccgtactgtgcgcgtgcggggagtactgtacggttgaagagagactccagattagatcagatctatctgtgactatctgtattatcctctttatagaattgttaagcagcggatctgagatatttttataaaaacggaacctacatgatatgagcaattcatttttgagatgatccaattttagttttgcactttgcgtttgagtccctgtaatattcatatttacatttgagtccctgttggaggtcagtggtcagtttttgttgaaaaaaaagtaaaaaaaaggaataaagaaagaaagaaaacgcagaaaggtgcaaagaaaaaaaaaagaaaaaagccgcacctaaaaaaaataaaaaaaggggcagaaaggtgcttaaaaaaagccgcaccaagaaaaaaaatcattcatcctttgagtatgttatcagagtgcagagttgtgcattgattcatatctagtctttagaggtgtcgggtgcttgcttgagctagagttgagtctaggctaggccagcacattgactagtactttgaactattattcaactttgtattttcttattagcacaattgtgttcctttgctgctatatattgtgcctttcaagctccacatatatacttctggtcaacaccgctttgatccttgcaatcgccacatcacgtccttcaaggtgtcacgaaccagccaccggttgtaccatccttagcattgctggtaagacacttgtaagaacttggta

SEQ ID NO: 32839 - DNA, 567 bp, Oryza sativa
ctaggaaagatgctattgtgatgtcttcaactaagtctgaattacaaaacgaatgtattgttgtgcctattgttttggatactaatattttgctggcatctgagaataaccaaggtaatgagaaagagaagaaagacgaagaggaaaaagacttatctatagctccatgcatgcttgaagaatgttcaattgaccaagcgctgataatttctgaagatgagaaaaaaggtaatgataatggtgctacagctactcaaggtatgcatatttataatgtgccaactatgtccactacttatgctacgttagagcaacccatagtggaaccgattgttgaaatacctttgtcacaaaacaatttgcttgatgttacatgtgataaagaagagttgtgcgatgcttcacttatatccatgccacaactagtgaatgagcatgttagttctatagtagagccactatgtgttgagtttaaacatgttattcacatgctagcgagaatgaagagcttaaattgctatcttctttaaatacttgggttatattcaatttgatgatatttgtcca

SEQ ID NO: 32840 - DNA, 3177 bp, Oryza sativa
ggcatgctgacgaaagaagagcgagaagactatcgaagcttcttgatggaattccgagattgcttcgcttggacatacaaggagatgccaggacttgaccctcgtgtcgccacccataagctgcgattgatccccaatttcggccagtgaagcaaccaccaaggcgcttaaggccagagttccaagaccaagtcatcgccgaagtcgatcgactcatcaacgtgggttttatcaaggagatacaatatcctcggtggttagccaacatcgtccctgtggaaaagaagaatggacaagttcgagtctggggtagactttcgcgacttgaatcgtgcttgtcctaaagacgactttcccctaccaatcacggagatggtggtcgattcaacaacgggttatggcgcactgtccttcatggacggctcatcaggttataaccagatcaagatggatccccttgatgccttcgacacggcgtttagaacccctaaagggaacttctactacactgtcatgctgttcgggttgaagaacgccggtgccacataccagcgtgccatgcagttcgtcctcgacgatttaatccatcattcagtggaatgttatgtcgatgacatggtagtcaagaccaaagatcgcgaacatcatcaaaaagaccttcgcattgtctttgaccgactacgtcgacaccaacttaagatgaaccctctcaagtgcgcctttgccgtccaatccgttgtcttcctcggcttcatcatccgtcatcgagggatcgagatcgagccaaagaagatcaaggcgatacttaacatgccgccccctcgagaactcaaggatctgaggaaactacaagggaagctggcgtacatccgacgcttcatttccaacctctcgggccggatccaacccttctcaaagctcatgaagaagggcacaccctttgtgtgggatgaagaatgccaaaatggcttcgataatatcaagagctacttgcttaatcctccagtactggcagctcctgttaaagggcgcccccttattctttacattgcaacgcagcctgcctcgataagcgctctcctcgctcaacataatgatgaagggaaggaggtggcttgctactatttaagtcgcaccatggtcggtgctgaacaaaactactccccaattgagaagttatgtttagccctcatatttgcattgaagaaactaaggaactacatgttggcgcaccagatccagctcattgcaagggcggactctataaggtatgtgctaagtcagcctgtgctcactgggcgactaggtaaatgggccctactcatgatggaatatgatatcacttttgtgccgcagaaagcaattaagggccaagccttggcagaatttcttgctgtacatccagtgccagatgactccccactcatcaccaatctaacggatgaagagattttcaccgcagagcttcaggaacagtgggagctttactttgacggagcctcacgtaaggacgtcaaccccgacggcacccctcgacggagagctggggcgggattggtgttcaaaactccacaaagaggtgtgatctaccactcgttctctcttctcaaggaggagtgttctaacaacgaggcggaatatgaggctctcatctttggtcttctcttggcgctctctatggaggtacgttccttaagaacccatggggattctcagctcattattagacaaatcaacaatatttatgaggttcgtaaaccagaactggtgccatattacacagtggcccggaggcttatggacaagtttgaacacatcgaggtcatccatgtgccacgaagcaaaaatgcgccagctaacgctctggcaaaactggctgcagcgttggtctttcaaggaaacaatcctgcgcaagttgttgttgaaaaaaggtggctccttccagctgtcctaaagctcatccccgaagaagtcaacatcatcacgactaattctgctaaagaggaagactggcgtcaacccttcctcgattacttcaagcacggctctctacctgaagatcctgtcgagagacgccaactacagtgatgacttccctcatacatctacaaggccggtgtcctctacaagcggtcttacgggcaagaggtcttacttcggtgcgttgatcggaatgaagccaatcaagttctccaagaagtccaccatggagtatgcggtgggcatcaaagcggaccaaaaatgtaccatagcatccgactggcagggtactattggccaggcattatggcggattgcctgaagacagctaaaacctgtcatggctgccagatccatgacaatttcaagcaccaaccgccggctctgcttcacccgacggtcccttcttggccgttcgatgcctggggaatcgacgtcatcggcctcatcgatccaccttcttcaagggggcatcgcttcatcctcgctgcaacagactacttctccaagtgggcggaagctgtgcctctgcgtgaagtgaagagcagtgacgtcatcaacttcctcgaacgacacaacatctaccgcttcggggtaccacatcgcattacctccgacaacgccaaagcctttaagtcccagaagatctataggtttatggagaaatacaagatcaaatggaactactccaccggttattaccctcaagcaaatgggatggccgaagccttcaacaagaccctcggcaagatcttaaagaagacggtagacaagcatcgaagggattggcatgatcgtctttatgaagcactatgggcgtaccgagtcacagttcgtaccccgacacaagccaccccatactctctcgtctatgggagtgaagctgtgttgccattggagattcagctaccatctctacgagtagcaatccacgatgaacttactaaagacgaacatattcgcctccgatttcaggagcttgatgccgtggaggaagagcgcctaggcacccttcaaaatttggagttgtatcgccaaaacatggtgagagcctatgataagctcgtcaagcaacgagtcttcaagaagggcgagctcgtactcgttctgcgacatcccatcgtcgttacacacaagacgaagggaaagttcgagccaaaatgggaggggccatacgtcattgagcaagcatatgac

SEQ ID NO: 32841 - DNA, 13837 bp, Oryza sativa
acactgtgagcttgccaacatgcattgaccattgcattgtctggtgctccacgttttgttttacaaaatggatgccacatcccacaaaaaaaaattaaaatggctttccacatatcacactgagctggtagaagaagacaaggcaaccttagaacacctctacaggattcaatggatgaccatgacagactgtgcttacaactaaacatccttcacgccaacacacaagtactacgggtgcatatttccgaggaatagcaaaaagacttgattgggttacttcctagtaacaaggtccccacgccttcatgtccttcggtgtgcttcagacctatggagataccaagccccagggaagactataggagaagagtaagaaagggctacctacctcaacacaagttgtggttcagtgtgcagccacttgccatccctgtgaggcatgtcaacaagggactttacaaaagaaatgggcctgcgaggattacatggcccacaaaggggaatggttgtcctccaagttctaaggatgccaagatcccagatcaatctcaacaaagtcgtgatgatcttaactcaagaaaacaatccaatatcaatctcaatgaagccgtggtgtcatgaagccgcgaagcaaaaaaaaaaagaagaaacaaaaagatccaagcaatcagtgatctccactgcattctgtcagaaataggaggatagccattcatcatcctcggcaaaaggaaaaggccactctcacagccgttcccctataaccctatcttaattcagccatacctaattctctcggttcgatgaagcacaataccaggggcatgggactcgtggtggtacctagtgaactgaaaggctagagcatggattttcgctgccttctgaaagtatcaccatgtatgctactcctatacacaagcacactaggaagttaggttgacagggagcaatcgtcatggtcattcggtgattcccgcgacacgttcttcggcaatcttatctgacgctaccacatagccagtgttcagtgggaaagccaatattttaaaagaaaaatcaacaaaatcattttcttgctgggtttctttctatcaactcacctggtttgctcgactctagcaaccatactctagtttttttttctcttttcctctctcgttttccttttcgtgatgcagggttttcgcttcacgtcatttggaggcaacataacactctgaagtcgccatcgggctatacacctttcaacctgacgggtcggcatcacaacagtcaagtggtcgcgtccggattgataagatatttctttcttgggagcggggcggcgtaccaacgcgtcagcgccaagccgtgaaacccttcatgctgatgaggcaggcaccgtgatatatcaacggtttcaatcggtctgataaaatgtcttcaattgtggcatgggtctttttcgctgcgagtaggagacgatttcaagttattttgttggctggcacctatacttggtcccgacaaaattcctttaattattatttgaaggcatggatcttcgcctcgagacctcaggaggacagcttatacctgaagtcatttttattcttcacctattctcaaagcgccagactttctgaacggtgctactaccccacatgggttgatctattatatgaagcaacttgtacagaaggcaaaccaggaattgatggaagagatcatgcatgcagctgcatgagtacagaatttgtgtatggcactgtagcatggtgatgatgcgtcgtcctctgattgctcggccacattgccacaggatgggtttgttaaaaaggaattatcttaacaatgcaaactgctggctggccttggctcaatatgttgccgccgtgataatcaacagaagttcatatgtattcatgcacttataaattacagccatatattcccatatatcagctctcgggtcccggcaggatcttcagcgggttctatatgcgacggtggccgcatgcgagcagtgccaagtattcggatacagaagggataatacatattagcaagttaaaaaaaacgaagaggacaaaacacaagcactccatatatatcgatgaagacaataagacagactcaaataataaaacaagtactcctaattaatgggtgcatgataatgccccaactttattcaaagattaaaaactagctagctgatcatctaaattaagagcgcttctaatgtgctttacatgactcgaaaataaaatcctaattaaggtaaaccaaggagaagcatatggaggctattctgattcttcgacgtactaccccaaggcgccgattctctacgatatgatagaatggcggccacctctggcggcgcggccactgcaaggcgtttcctctcttcagcaagatgccccaaatagaccttcgcctcgtcacgacgctttatcagttgcatgacgccgtcgatggtactatcataaacttgccggttcttggcggctgcctcctctgattccaaacactggtgctccttctccctcgcatctttggctttcagctcgtgttcctccgcctctttcttccaggtagcccttgcttgcttggacttctgaagatccgcggccacgtcttcacggccactcttgaggaggtcaaggtctagtagcacgtctgaacacgcactctctaactttgctaaggaagagcgcgcctcgccttcatgagcagctaaagttctcccttcaaaggttactgggagctctcccttaagatgttgcacaagtgcccccaagtaagacatcaacttctccaagtctgcggggcgtccaagctcgtaactattttcccatgcagcggtggcagcaccaatgtactctatggtgccctccttgttcaggggtttctccatcaaacaatcttggatgcttaatagatcctcctccaccatgcgggcattgcgacgttcaatgggcgtggactttggaagctccagcgtcggcaattcgtcagtcgccgaactcacagagttaagttggagatagcgaccgcccgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaagagaaagcagaggagaatatgacctctattaggagtctaatcatccttaccttcctgatgcttttgagtcgagggtcccggagttgaagcggcatcagccgtcggcatcacccgagaagagcggacaggagcattagcagccagcacaactgaaggtacatcgtcaataggtaccggagcaacatcggaagaggcagtagctttaagtccacccaaagcagttgcctgctctatcgtatcctgagttgcaagtatgttctaagagacaggttatcaaaccagtatgacatagaattttaagagaaaaaaaaagaataggggaaacacggataccttgccagtgccatcagaagaagaagaagaggaggaggagtcgctcaactggacagcatcaagctccatgtcgggcaccacagagcggcggcggcggcgacgatcatcgcttgaagactccgtggatgacaccctctcgtaaactacggggttttttcctcgcttctcacgcatggtgcggtccagctcggggtgtggagaatcttcaatacgcagaccctttttagaagatttcggcaatggaagtctgtcaggacgagcagttctctccttcttatgacgccagtcacgcaggaattcgattgactcgccgtggcgtttgtatcctcctcgatcatctctacggaccgggatcttcgcgatatgctgggaagggttgtcacccttggtctccttctgttgcttgccaccggatcctcccgggcgcttatcttcgacagtgtgtctatctcctgccgagcgcctatcccatgttactcgcctgtcccccgttctccgcccgtctcgcgggacacgctctccgctgccccggtcgctggcgccacgctcgcctgcacccctggatgctccgtcttccctggccatctcaagatggttgcctgatgaaaaagtacaggatgatcaagaagcgtcctaattccgacggctaaagaatcgacaatggatatatacctgtgatggagttaaacacctgaggcgccgtattgcataatcaatgcacaggcatgaccagcaatatataggcttcatccaaattactcgtaactgcaaaggatttggagtcttagccgatgacggtctagctttgtttttctttcgccgcacggccggagataagcttcagcatgggagtcctttcgtcgcatgactaaactctaccggacatgtatcgcatgagccaacacgacaccaagttaatttcgctcgctccacgatcaaaatttacttggtgggggcatctgtttgatggtattttggtgattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatactgggaatatatatacttggattagtatatgtgcatgtataattaaccaataactagccgtgtgaagattggctggtgaggcaatcacgcgcatgcatgcatgtactacagtagacggtcgtatgtgtgtgcacgcctgggtgattaagcaacctatgcatatccgagtgattaatcataggctcgacccatggccaaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaataaggatatgaacaaataacaaactgatcgatcaaaccttatctgcaacgaacttgacgcggaggaaacgacgcgcggacgcggtgagcaccgaccccagacccctatataaggcgtcgacccctcggcagccaggggcattcacgaactcatccacacattcattcaccaatgcatctagcatccacaagccacctatcatcaatgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgcgcacggtgatccgatcatcagcaagcgcaggagaggagcttgatggctagtccaggtaaaagctagcaagattgttttgttttctttcatatacagcacgcacacatccatgcatagggatccatctgcacgtatcgtcgtcgccggggaagtcgcggtggccgattcatctacgcatcacagaagcctcatcgatgccggtgtctgttcaagccgacgtagtgctacttgtccctggactcgacgctgctaattcaagccgctggtgatgcatctacccgaagctgcgacctggccgagataccagacatccttgatttgcaagcttcaccgcactggagcgggctaaccatggaggaggtcgtcgggaagccgccctgccggagcgcgccgaggatcgccggagctgctgccgactgccaagacttctatcagttctcatgccggaggtcaagcatcacgcatggcgtcgaaaccagcggatgacgatggaggcaagtatggctgcagtacagaggaaggacgacgggaggacggcgagccagtgctgttggatggcaacaagctagctaatgcatgttgattaagttaattattgtggcaacgtggccaaccaatcggaggatgacatgtcatcgctgctacagttccatgcacaaaccaatgcgtgggctaaagaagtcctgttggtttttcttatttgtcccaaatgagatgccgagctttgattaaatccggccgccatctacatcaaccatcttcaataattcctccctaattcttctctaatcgaatctcgatgcaactgctgtgacgtcaagtcgttcaagctacgtaactccatgcatgtcttcaccaacaatctacatcgacacgttattcaagaccgacgaggctagacgacggagggtgggcgaccaacaccggcgcacggaccgacgaggccatggatcgctgtcggcgctcacacacacacacacatctacatcatcatcacaaccatgcatggagaacgcgaagcgaagacgacgagacgaccacaagcagcttaatcggaggttctcttgcaggcctagacctgcggaggtaattaactgggagcttcttgaggccccaggaaccagaagaccacatcgcacaagtcagatctgtccaatgtcagattatggagcgcgcatacatatatattacattgggaatttgtatttatgatcttttaagattaataaagagcatgttccctatgttttgtttacactgtgtatttaggtacactggcacgcccgcatatatatgtatctctaaacaaacgagatctcagatgttattttccaccctaaacataaactttaacaagataaattaatatatgatagactactttacaaatatacaagatcaaatttctacaagctgtaacgaaaaaaaaattaaccatgaatatacgttaactatatatatttaaatttgtttttttataacttgtagaagttgaattttaacttgcatatttgtagagtgatatattacatattaatatattaatatatgttcttaagtttttaaaatttctttagctagctcagtttgtttgtatcgatgggcttagtaattagccggatattgctcctgcgagatggggcaaagtatcgacctgggatccgcccaaagtgggtgcacgccgccgtcagcgggtccaagtcgatcgggtcggcgtcgaggaggccaactcgtggggtgtcttcgccatcgcagtggataccggcgatcctggccgaagttgacggcactgcacggcaccacgcccaggcgctcactcatcgatcggcaggtaactgtcaaaaactccaacctgcagcttctcctgctgcttactgatcgatgcatgggccgatgtgtaagagtacgcgccacatcgagatagctagctaactagagcttgggccctgaattttcaggtggttgaatgaatcggttggcgaagacgacgatggcatcaaaggcagaactacctctgtcttgaaaagtatatgttcccggtttagatatggtacttcatctgtcccaatataaatgcatctaggagaggaggtggtatattttataactacgaatctagactggataagcagctatctagctaaatttgtagttcttggatatgttacatctatactttgacggaaggaatagtaactactacaccggccggccagccgcaggagaagatcgacctcgtcgctgcagaatcctcctgagattctgatggaataatttcgtacacagttcaagattgttcatatatacagtacgtgcaaacggttcaagctagctgctgcctttgatggaagtgaacatacaaatgtggttggtcgttggtaattaagctgttgccttcttctactactactccagctgccgtcagtctcactcagtcctgtacattcatctggcgggcagcacaggctgtaacaacataaatagtcaagcacggaagtaattgaaccggcgaaaatattgcgaccgatgttgaaagattgtgtccattaacaaaccggctaagtacatactataccgtatgagataatgaaagtcctgacctatttgtagtaggaaagtaacatgagctgcaagctttgaagggaagtgggagtacacataccttaaacttcttcttttattatcctacagtataaaacactgcacaaagccgaccagagtgctagcttttgcatattgcaggtagtacgaaccaatggttttcagatgaaaacaaccactcaatatacatctctacagtgttttgcagcgtttgccacatctcaatcgctttgattgggacaccactccaactggcctgtaggcatagtagcatacacctgaaagttttacattttaaccctctttaaaaacataattttgttataaacctcaattaaggatacagacccctctggaggctcatctgtgccgaggttaaatgtctttgcgccaaataagttggtgccaaaatccagccctcgaagctagtgggtttaggtcacctgcgaaacaactttcctttctcttcccatctctctttgaattgtttgctgtccaattttgagaaaactgacaaatcaatgtgtcctattcatttttgctattttttttataattacacagtataacgcagatactcacaatacacgcacactcatccctctgaatgcacgcacgcaaaccctacccctatgagtatcttcgaaaactggactggcaaatccatcttggagatcaggtacgtcgcctaccattgaaagcacaaggccgttcaattctagaaaatttgcttctatgggagtcgaatctagtacctaaggtgctaccgaggctcttgtaaccactaggctgtatgctctttcgcctagtttgattttattgatagaaaacttaatctaagaggaggatgtggttccctccctcctccacgcccttgttccaattatccgcggctaaattttgaaaaagagttgacaaatcaatgtattataattcatttatgataatttatttttatttataggggtaagacttgaatttgggataatatagtaagaagtcagtgaaagaggctggcaccatggaactggtgccaaggctcaatcccagagactgagagttttgcattgagatgtctaacatcagcgacaatcgccgagagttaggtccatttctgtaataagttttttaatacgtctgcatatgaaatatgtttttgaaaaaaaagtccagtatagagcacagcaacaaagaatcaaatgtgtactactactctataccgtcatatcgtactactccctccgtcccaaaataagcgcagccatgagtttccgtgtctaactttgatcgtctgtcttatttgaattttttttataattagtattttattgttattagattataaaatataaatagtactttatgtgaccgatgctttttagatttctcaaaagaaaattaaataagacgaacggttaagttggacacggaaactcatggctgcgtttattttgggacggagggagtacttgagattcagtggcactgtttcctctcctttttgcgacacagccattcatatccttggcgtgaacgagcaaagcatggcttctgaatttgtcagtagtttatagtgcaacaacgtcgtccttcatctggatctgatccctgaacccatcaatcatactctcacgcccccgtagtacatgccaccactgtggtctaggagtactgttcatcctttactactccagcttataattatcatgcagttcatgatcagttcatagacaggacgtgtgtacaggtacagcaacagtggcgagattttagccggagaaaagctctatatcgagagaggcaaactgtggccatcgaccatggatggatcgtcgacgtgacgacagtaacgagagaacacacacacgagctgctgctgctgctaggatcgatcgaatggtagggatcgggcactaactgaggtaggtgaatcaggtttaaggattcacatgagcgttgctgccgccataactgtccattctcctttgtagatgcacggtcccgttcgtcgtcctgtggccgtcagcgacaccggcatggcgcattcaaggcctaaagcatggcgctagctgagggagctagctaccacagctagaattcgatcgcataaatgttcaggaaatgatccagtggttggggacaaaagcatgcatatactagccgctgcatttgtctagctctacctgccctcatcttagtttcgttcccattagttaattattagattcgtttatcaatattcagattagttcgggtagcaatgggccctggtgtttttctgggaccatatatattccaaaccccaatcaactgaatgctgaaactggcttaatggcgccaagccgattctaatttgtgaacacagtagtatgcacatatcacatgctaaaattttggcatgcaattgggtaaattagccttcaaacatagcagtgctaactgggatggattttacattcaagagggtgttctctcgttttttttacatgtcatttaaatagttatatatatattttaaaaaagacaaatagattaatatgtaatatatcacttgataaacatgtaatttaaaatttcacatctgcaagttgcaataaataaacaaattaaactattgcaacttgtagaagttaaatttgacttttttttttgtgaagtgatcggtcactattaatctatttcatcgattttttttataactattttaatgatatgtaaacaatgagggactggttgcttgaaagtttaaaatagtttctcctatgctagctcatccaaggtggttggagaatgttttgtctttcttgtcttaaaaaaatattaggtagttgaattcaacgtggatcctatttagcacagctgtgtcttcggcacacactttgtttatgaaaaaaaaaccttttattgaaaagttaattttcatctgaaaatttccatcttagactttaatttggcatgggttttataggccaaaagtgtagtatgcagcgaggcacgactgtgataattagccatctaaaattgattgttctagtcaaattctgcatacccatgattgcaattcctatacatcaacgaataccagaagtagtagttccaagaaagacaatctgagatctactagctaagctcgatcacgtgcagcggttgcccaaaaagcctagcagttgagacagccacaactgcaaggaccttatcgtcctagctactgcatatgcaaagctgatggctacgtaagcgcgacctgcatatacgttggcgcctgcctcatcatcatcagcaattaatcagctcgcctatttgtggcaagctcggatggtcagagatcggtcgagtggtacaagcgcgcacgcggcacgcatgtacgaacggcccctccttgccttcaaagcgatggctccatggcacccgtccacgacacgagctcgatcagctcgcccccatgcaggtcgcggatggcgaccttgatatcacctgtgctcggaattaatcgttcaacatcccgctataatgttactaccattaccattacttatatgtgatcaatcccaccattctaattctaacatgtatatataatagtagtattatggtagaggatatgaacccctctcctgtgaccctgcctccggttgcctcctccatctatctctcccttcatgcacgcacggcacgatcgatcgatgaactcgagatcttaagatctcactggtgaaatgcctggtcccggcgaagaaaaatctcgagcttttgagattgtgttaatctccctcgatcgcactgtatcctctcatcggatctctgagcagccaatcggaagcgtgggggcatcgggacgcatatatatatatatatatagacgaataatatgatcgatgtaccggcactctttgaattgaattttggctctgctaatttaactgaagtcgtagattcgagggatatatatatgcacatacacgtacgaatatacgatcgagcgtgcatgtgatcgtaattgtaacctggtcctcccgtttttatggcaatggccaggtttgcattttttgtgccattcattgcgctggtggctgccatcgatcgatcggatcgaacgaatgcgagttcatcatgtgtacggttgagcttttgcttcccctctgtccggtctctctctagcgatttttttttcgcgaaaatacaaaataattgcacgttaatatattagaagaaaattaaaaaattttgttgcatgacgcaatcaaccagattagcctatgctaagaaaagagaaaaaaaaaacacaaccaagaaaaatggaagagactactacaatgactaaacgcaactccaatcagctaggaggggggcagagccacgctacgctcccaagaaatccaaaaaaagcttctctctcgcgatggttcagccccgaccgcgccattcaaatcaacggatcgatgcgcgtacggacgtgtccgtccatccatcggttggtcagggcaggagcacgtcctcgtctcgtcgtcggatcaacggcgatcgatcgatcgatcgagcgcccgggcgagggaggaatggcggaggatgtggtgagccaggtggacttaattcggttttttgctgtatagctagcgttaatggaagacgtgtgacctgtaactctaactcgcggtgtatttggttgattgatgggattgaaagctagctagctagcgaagcgatcgatcgattgcaatgttgctcgctaggtaaccagacaaatatggggcctgctttgttagcttgtccggtttacagtcgtacggtgtacacgacgattttaatagtgtttcgatcaacaatattatactagtactatctccgtcccatattacttatctttttgagtttttgtttgtcaatgtttgatcattcgtcttattcaaaaaaaatctagaattattatttattttgtttatcatttgctttattatcaaaagtactttacatatgacttatctttttttatatttgcactaatttttcaaataaaacgaatggtcaaacgttgcaaataaaaagtcaaaaacgtcacctattatgagacggagggagtagctagcaaccccgtattgaacacatactagtgctatgaccttagatacatgatatgcatgttcagattcgtagtactagtatgtgtcttatattttgggatggatgaataattaaattacttgcttttgtatttaaatatatgatgctgttagctttattcagtcaaatttgtcgaactttaattttgcacttagaaccatcaataattctaacaataattggtctgaaaatataatccaagtaaatttacagtaattttattatttattaccgttgttctaaacttctaatcgaaaaatgatgatcagagaatcagagttacacaacaaagaacgaataaaggtaaccgtgccatctcgttcctagtagtaataatgcacagtaattaaatccatcatgccacaggcctagcagcctagctatatgatcgatcagattaaggatcactggtgtctcttgtgttaaagttactgttttatctctggggggagctaggtatagggagataatatcgctagttagatcgaggaccacgtacgagtatacgtaaatagactgcatgcatcgatcattcaaagatgggcacgaatgcatgccaatggcgtggtgcgcggcttctgaaatctgaatacatagtaagtctgagctctgaccaagacatgcgcaagagtcagcgtgctcagcgcgggggggggggggggggggg

SEQ ID NO: 32842 - DNA, 11449 bp, Oryza sativa
tctctgcctgcagctgtgcagcctgcctggttgcatgcatgcatccggcccctgactatattattacgtccgcatacttggcatgctgcgctggctgcgctgagctgagctgagccattcggccggcatgatgcagcagcagcagaaggcagagcaggagagaagcccatctagcagcagacgtggggatggatggatggatggatggatggacgcagctggcagctgtgtggctagcttgatctgatcacggagcctggccgtgcagcgcagtgcagtgtgcgtgcccgggcggctgctgctgcgagtgactgagctgagctagccagctaattccgccgggacggacggagacggcgcgggaccatgcggcgtgcgtgcgtacgcgttggaccgcgtggtgtgcgcgcgtgctgcgtccgtcgatggatgcaaaccatggctgactccaccgccggtatcgttggttagttgcagttcagcagctgggcgctttttacatggcacacatgcgcacgcgtgccctgcgacgacgctacacgggccgtgtaacacggcacccacgcacgcacgcacgcagcaggccagggcacggcctcgtcgggcccgggcgtcagctagcggttgggtgggctgaaatccagcgcgtccacgcatatggatttcatatgggcttcggtgttagcgggttggttttccccccggaggccgtgaagtgtgttgactgacttgaacttgagaggggaaaatgtacaccgaaggtccctcaacttgtcattgggataaaaaacgtcctcaaaccgcaaaaccatatacgcgaggccccttaactatacaaaaccgatcacccgatgtccttaggtggtttcgaccccggttttgtcctacgtgactgctgagtcagtgcgggactcacgtgggccccacctgtcagcctgtccaggtcagccactctctcttctctcccatttctctctctctctctctcacttctctcctcttgggcaagccagggcaggtggggaggaggtcgccggggcgcagcggcgggagcacaaggcgacgcggcggcgggctgaggcggctcgtcggcggcggcagaggaggaggaggcaacaatggggaagacgaaggggaagcagcgacaggataagttctaccacctcgccaagaagcagagctaccagagtcgcgcggccttcaagctgctccagctcgacgcgtggttccgcttcctgccgacggcgcgcacggtgctcgacctctgcgcggcgcccgggggatgggtccaggtggccgtcaaccacgtgcctgtgggggccttcgtcgtcggcgtcgacctcgtccccatccgcggcgcgcactctctgacggaggacatcaccaccaccaagtgtcgcgccgcagtgcggaggctcatggactccaacggcgtcgtcgtgttcgacgtcgtgctccacgacgggtcacccaacgttggtggcgcgtgggtgcaggaggccaccgtgcaatcgtcgctcatccacaacagcctaccgccgtgtcgcctcgtgctcccgccgtcgcatcggtgcagcccacctccgcagcgctagggggctgccacctccacgtcgctagcctctgccaccaccacgtactgttcgccgcgcgctcgccaagcctgccgccaccgccgctcccatccgctagagggagagatgaacagagaaagagaaaggggaaagagatagggtgaggtggacacccgacatgtggggcctatgtggctcccatgctgactcagccgccacgtagaccaaaaccgggtcaaaaccaccgaaggacctcgggtgaccggttttgtatagtcaagggacctcgtatgtctggtattgtagttcgaggatgttttttatcccgatgacaagttaagggaccttcggcgtactttttccaacttgagggcctctgttactacaagtggagcagttgatttggagtagttttgactgaatattactccctccatctacttttgatagtcatatttcatcttgacatacataccaagaataagtgattctacttatcatctatttaaatatgctactagtcatttctcgtaaacaagcgattaattaatatttacatttctcaatgcccatgtagccaatcttgtataaaagaatggagagacgtgcattaaatctaagaaagtcattaagatgataagttgttggattgaaatatgcttatcaaaaataaattttttagatctagaaatataactatcaaaagtagatggagggagtagtaaataaaagtccttagttgaactgaaatttcaatccggatacatgtaaaaaaatcaaaaaatgtttaataggcctataattaccagattattgagcggattttttttttcagattatatacatgatataaacaaaccttaaaagtaactcgaaacaaatggtctaagcaaatataataataagaaaaattgagaaaaaatatttttattgtgtgaagcaaataatccattacaacggtacgatagataatctgaaaataaccggatcactggtttctcctgtgtgccctctgcatgcagagtcaaattgaattgttctcgttgagtatttaaattaattaatttagttagtatccaggcgagccaattaagctaagctatcagcaaaaaattaattaaacgagacacacacatgatgagtccatgcatgacgcacaagctaccttagccgctgcgtactagctccctcctactaatcgtcaacatttctagaacaaaataaaccccggacgcaatcctgaattgacacgactcatgaagactcccagcctctcacgtgtgacgatcagagaatgatacataagggcataaggcgatgcgacacatctaggccaaccagctctggctaagcacaaagctgattcccggccgtttcaacgacgaagtttacaggctgaccgcgaaaatccgtctgaattcaccgaattgcagtggaaatttccacggcgggttcacgggaaggcggaagactactgtgcgtgttttaattctggattctggaagcccctgttctggatatattgtagcagtaccgtgtatccgtgtctccatgactcgattttacattggtacatgaattgatttggctagccgatcacttgatttgtgcgacatgtctcttttaggtttgagaaagtgaagcgtctattcaggtgcattcagttgtttgtatactattactatcggcaaaaaaaaaatacccctacatatcatatcagatatatatttaaagtattaaatttagtctaataataaaataaattacagattccgccaggaaactacaagacggatttattaagcataattaatccatcattagcaaatatttattgtagcaccacattgttaaattatggcgtaattaggcttaaaagattcgtctcgcaatttcctgacgaactatataattggtttttttatctaaatttaataatccattcatatatccaaatattcgatgtgatagcgtgaaaaattttgtttaggaattaaacaggccctaatactagtgtatgtgtcatgtatatgataggaagatgttctgactgctctgctattatagctttaagatgcaatagtctatcttagggcggtttacattgcacccaaaataaatcttaccaaattataacaatgccaaaattttggtaaggttgtaatattaccaaaatttttaccaaattatgacaatgccaaaattttggtaatattattttggtaagtttataatattatcaaaattttggcaggatttcttatgtatttatcaaagtttgacaataaatatagacactttttagcaactttgataaaaaatgatatggttgaaaatgacatcaatctgaatagcctcttattgaaaaggtagtcttgcaacgttgatatcacagggatactgttcttgttgggaatttttcaaacatttaccagtgtaaacgcctccataaagaggcatttctcgacgtttctatctcgatcagcaagaacaaagcaaaagcaaaaaaaaaaaaaaaagtcgattcgagaatagaccacggaaagaacgaacagttggggaaaaaagaaaccgtggtcttttgtatctcagcttttgcagagcctggacgcacaggagcgagctagctacgcagccgccctctgggagcagcaggtacaatatcatactattatctaacaataaatatagtttaatgagataaaagatacgagagaaaagcagcggcctacagcagcacagattccaagacgcagtatgtttatgacatgtgggatcatatactaatagtgtagtaagcaactattgtatgaattagctattagattggctataggtgaattggagttagtagtgggctatactattgaacttgctctgagattaattaacacccagtgatgacgagtgatgcttgctttatctaccggccgctgtcgctaagggcacccgcaatagttatctataggctctctataagatatccatgtcagcatattttactacttgaaagagattaaatgaagagagagagtaaagctatctactaacccgtagatagtctatagagaaaagcgaggcaatggatgagagagttatagatacccatgtagacatactattaatgtggtttactattaatctagtctattgctgagatgtatatgttttatagagaacatcttactttaccattgcgggtgctcttaagtgcgctgtcaccaacttcacctggccttttctagatcgagttgtacaggccaggccagtttcgatcgctgtatatgccccagtctcgtcgatttcctgtcactgtttccccgaccaaattaacgaccggtttagtcccttcttttattctttcccggcggcttgagaaaaccgtgaataatctagctagggtgcatgcatgcatgcgctaaattacctcgctgaggtgtggctatgcgtgagcctcttattgtcagttctagtacctccggtttagtcagagcaaagtaatctaaactgattgattagctgggagatgatgccacttaacatatattcctccatcgtgctgacttctgaccgatcggctgagttgcctgtcgttgcaagttaactagcattcttgcataacaaggaagtaaaattaactcgcgtttcatcttatcagctccatccttagctccatataagatgggcaaaattattcttgttctttttttctaaaatagtatattaattggcagattacgttccggaagctctggcaggggctgggcagtggcggccacaaggtcagcgctaagcttcgccacctcagcaccagtttatttggcgctgaccttgaaacaccttctccgcgagagcctaagtccacgatcttagcgccaaatcacctagcgcttaggccgagcatgtcagtgccagtacggtcattatcgaaccttgccacgcgtgccgatggttggagacgactgtcaaggcctcggcggtcggcgctaaggtgttcaatcttagcgccatcgggtgtggcactgagcacaggtccattttataagatagtttttagtaagaaactaatttgaaataagttttgaaaaaggacaaaaaaaaatgtgaaattttcgccgatatcgatggcccctcctagaaacatgtgtcaaatgtcaatatatccactgtacaacttccgttatatacccgtcaatccccgaccacaggcacacccgccagtttgcgggtcagaatatattcggaaatgtcccggcctggcggcgcggaacgaccagacaggtcacaggtcagaattgagaagccacggcgcgggccgcgggaccaaaggaacgtgatgtgatccggtgaactccgcgaaccgcgatgatgatggtgcacgatgatatgttgtgccatctcactcagcagctttcgtagccgccgcccgcccggctgcgcgcgcgtgcgtgcgtgcgcggttgctgcgacaccgcaggaggggaggaggaaagctaagcgatcgagagaaaaaccacgggcgcgggcgcagtgtggtgtggtgcggagcgcgcggtttgattgaatcgtccgtgctctctctcgccggagtacgtctaccgctgctcgatcgaccacctggctagcgttggatgtaggcggcaccggcaaaatcatccgtgcagccgtgctccgcaagacgggccggggtgggggtaagctgaggcttccaggagttcaagttgttcaaagtcgtaacgggaactaaagtggggaggcgaatatgcctttcctactgcctacactacacaagccatgcatgccacggtctctcgtcattttttttttctctctctaaggaaaagataaacactttgacaaaaccaaaaccgctgagtgtagccggagaaaatggaactgattccgaggaaacttctatagatcactgccttctaaacgaagccgtgtaaacttcaatctaattattcggacgacaatgacatccacaccgtttgctcttcagcttaattatcgcagccagtatttaaattttatatcctaattttaaaattgattttgatggtttttttattctatctattttatttttcgccaagaacacaatataaaaaatacacataaattattatctaatcgcgaatgagggttacggaatcagttgtagacaaaacgataggaccgaaaataatcttattaagagggtattatcctgatgtatacttgtagacgcatgaaacaaccatgaaaatgtccaattcagtcattcagaaaacaagcgaattagtacgagctaaccatgttcaacggcgagagaaaacatcaagtaaacaaaacaaaatgagaaacaaactacaccccgaaactgagctttcagcagcaacgtacacacacatcactgctgatgaatcaacccaacctcgtccgatcatttacattgtgtacaacacaatacggaaacttttcaaaccttccaaacctcagaaccctctagactctccccccctccaaaccttcttaaaacccctcattcccatcacctcagcacgtacgaacgagagtgatcgatcgctagctcgccgagatcaccagcctcctcgtcttcttcttcttcttcctctcgatctcgaggagggtgccatgggtaccatggttggccatgtcgcgccgggcgccggcttcatcctcatcggcatgtggcagctgttcaaccacatccggctgttcgcgctgcggccgagctcgtacgcggcgccggtgtggttcccggtgcgcggggtgcgccacctggagctcatactggtgatcgtcggcgcggctatctccatcctgatggagctcgtgatcgggccggcgaggcaccagccgttcgacgacgacgggaccatcccctccaaccacctccacaacttcgagcacgcgtccatctcgctcgcgctgctggtctacgccgcggtgactatccacatggacagggccagggcgcccatgcgcgacgccgtgtcgcagctggtcgccgccgcggcgttcgcgcagcagctgctcatcttccacctccactccgcggaccacatgggcgtggaggggcagttccactggctgctgcagacggtgatcgccgtcacgctcgccaccacggtgctcgggatcccctgccccaggagcttcgccgtcagcctcgtccggtcggcgagcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaacccttttcatcctttgaattttttttgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttaggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaaggagaacgttcactaaaaaaaaattcagccagcaaggatttgtttctgcatgcgggcagtatgaaaatccgtttgtataaatgacgagaggttttgtggtctaaaatcacatgttaaaataaccatattttcacgggacaaccgcttctaaaaatcaatttttacatataattgtgaaattgcatgtaaaaattaacaattttcacgtaccttttgatagaggtggttgcccaaaacatatttataaatcgatgttaggtagcctcatgttaaaaccgcttcgtagtagtgattgcagtaacgaacaacaaggttgttgagctgaggagtgtggatgtaccctcatttccttttcttttttttacaaggagacgtaccctcatttcaaatattctactatgtccttttcgaatcatttggttttacaatttatgcaagtgaatataatggtgaaatccatcttcttagcctcaaaacgcaaatcgagaacggggcacaacgcccttgcccacaacaattggattagggacatcgatctgctgcgcatcactggagcggaccacccgcgccaatacatccatctttggacgttgatccatctggtcagcccgctttccgatcagagggactccaacatttggaaactgatggctaatggattctactttactagttcggcgtacagactataattcgttggtgcggctagaacaatctccaactagaccatttggaaatgttgggctccacctaaatgcaaaatcttctcctagatcatcattcaaaacagagtttggacgacggatagactacaaaagtgagggtgggccaatcaacgcctctgtccactatgttgtgccgtgccggagtcggcgctacttctacttgcaggacagggatagatctccagctgcaagagtggggggattgtgaaacgatcgaagtctggtggtacaaaatatggcgcacggcgaatcgctcaagaaaagccctaaaatcaattatcatcctgattgcctgggaaccatggggtgagtgaaatgctagaattttcagacaagtagcttccacgcccgccaccatcatcaccaagatcaaggaggaggcgcgaacttagatcacagcgggagcggaaaaactaactgagattataccggcgggagagtagacatttttgtttgcaatgggcacaatgttctcgggccctgtaaataactttttttactccttctctattaatatagaggtggcaaagcttttgtccttccttaagaaaaatacgggtgaaatttgtactgtactatctccattcaatgattcaatcataatagatttgggccgacgatcagcctggcgaacaaatctactggtgaaatttaatcgtgacggtcaatgaccataagagaattggaaatgtaggtacgtgtacatttcagttagatttctctcatatttggaactcataattaaaaaaaaaacaattctagggatgaatcaaattgagttcattcactcgttccaaaacaggcccatatcacacgttatgggctcccaatttcttcagttgcccaactgtactccatacagacttcaatgtgatcgtgcttacagacttcaatgtgatcgtgcttacgagaaatgccaggtacagtccgccgacgagtcaattgacagcaaccaattgaagcgtgcacgtttcagcgatcaaatcaaaggagagaacgttgcgattgtccatgtccatgccgttcgtacgttaatcgttataggcgattgtgccccaattctgggacaggaattaattttgatcagtctgaattttggcggggtgccatcatcagtccacaccatctgcaggcactgtagtgtagtctgtagctcatttagtcaagtctatactgcattgtaatacagtatggtgcagcactgcaacatatgttgatctggaggcagacgctacatttaagatatttgtcacatgccttgcttggctgcactttgcactgcaaacgaatcgcagtggcagtgtctgatatttgtacagttcattcaaggagagattaaaattgttctggcccaggttcacgaataaaatagggatagacgaggaaatattctttcctccgcctattttggaggtgaggtgaagttaaaatctgttaatgatgggctcttaccgtcaagcgtcactgtatcagtaaaaatgttgcaggatccatatatttagatgacttcaggggtcactaacgccagct

SEQ ID NO: 32843 - DNA, 16396 bp, Oryza sativa
acaaaaatattctgctgaaaaatttgtacatatttttattttataaaatttaaattgctgggcaaagtcctggcaataatttcagtcaaaaaaatattctgctgaaaaagcaactcgaaaagaaatagatgtttcactctgcctttttattccccatctgaatggctaggctgaatttatgtttttatttttataactgatagcatcatagtatatgatttttagagttcttatgtaactatttgcatttgcacccaatagagatgtcaaactgccatttcttgccatctaaagcagactagcaaattaactagaaggttggagtggagtagctggcagtgaacatggaagctaggatctagctactaagagcaagtttaatagtatagccaactactggtatcaaatcatctatagtcaatctaatagtcaatttatacaatagttaactataaatatatattacatcactaataattggtcccgcatgtcatacacacacaatgttttggagttcgtgctgcaggtggctacaaatctgtaacccgcttgtcttctctctcctctcttatctcctccacgtaagcttgtagccgacttatagtctattattatatatgctctaatataggcaaccacgtgccaaagtaggtcgtgaacaagtggtgtgtaattaattgccaccacctatgtttttttatttatgatatcattgattttcgcataacggttaaccattcaccttaactaaaaatttaatataaatataagttgagattatagttttccaatgataaaacaagtaaaaatagatatttatattttaattaatatgaatggttatatgtgacgtcaagactcaattacgttatacattaaaaaattaaaaaatagagggaatacttattttgtttcgtattataagatgtttcggattttaaacatattcatgtatgaatccatgtatatatgtgtttcatatataaatatatgcataatcatacagatgttaatgagttagactataaatcaagagaccaaaacgtttataacgtaagacatgggagtagtatattaatgtattatcaagagatcgaatgaatgttgagtactgagtacagactacatgcacaaacaaattcagcacgcatgcaacgttggaaaataaaaatatcccagatcgaacaatagaggaagaaggcaagcaagcgtatgatcctgcttagctcaaaaggatgcgatgaacagtgcgacagcggctatcagcagtaagcacgcatcagcaaacggtcatctcgcccctagcaagttgcagttgccgtagtgcattgactacacagtggagatgtttttttttttagtaaagaccatcaccggtctctaaacttgtaccgctgtatcatcgcggtccctaaactcgtaaatcgaccgttcaggtcctcaaacttgttcaactgtgtcatcccggtccctcaaattgcatatcactcgtttagattctccaacttgttcagttgtgtcacctcggtacctaaacttagatttgaatatcatctgggtcaaataggacggtctaaagactttatatttaaaaataattcataactttttcatgtgaactctaataaaaacaaactttatatcaaacttatagccttgacgcgatctacaactttatagttgattttttttattttaagtcattttttgtcccaaaatgtaattttaaaattaaaatttcaaaatctataaacatacaagttggaggacctaaacgagtgatctgcaagtttagggaccgggatgacacagttgaacaagtttgaggacctgaacggtcgatttgtgagtttagggaccgggatgacacagcggtacaagtttagggaccggtgatggactttactctttttttttttctcttgaaaaattgtcccttgttcgttacatatcacctaattaaatagaatttctttataaaaattcagcaaagtaaatcaattatatcacttcacaaatatatatagatttaaattcgacgtatacatgttaaaaaacactctcactagtatgtgaactattcatagccatgcgtgtttgtacgttttttttctaatttgtattatttggacttgtctgttttattgagttatggagtatgtcacatttatctatggctgtgtttagttcccttcaaacttctaattttttcatcacatcaaatatgtttggacacatacatggagcattaaatgtggacgaaaaaaatcaattgcacagtttgcatataaattgtgagacgaatcttttgagcctaattacaacatgatttaacaatgtcatgctacagtaaatatttactaatgacagattaatttggcttaatagattcgtttcgcagtttacatacagaatctgtaatttattttattattagtatatgtttaatattttaaatgtgtgtttgtgtacgtcaaatttttattgccacatcaactaaacacggtctgtgtcaacttatcaatttttggacatagaaaaacaaagtgacaacggagaaaaatgaaaaactcttcctacgcactgaacagtgtggcagagagatggaagaggttgttgatcaagcaaccgccgtagcttgatgtgaacacgaagcaatattgtcagttggcgagggatgcactgatgactatgctagtgcctactagtaaccagtatactcaatgatacttgtgttataaaatccctaatgctaaaattcattcgagcacaaatcttaaagcaaatcgaatgctgaaaatttatatagtgaaaaagaaaatgaaataatagttgtaagttaggattaatctcacacaaaatctatatatcgtgcactgtcgtacaagcaattccactgcacctcttgtgttagtaaaacccctaatgctacacttgtgttataaaaccctgatgctagaattaatttgtccgatcacaaatcttgaagcaaatcgaattttaaaagtttataaactggaaaaggaaatgaaataatagttgtaagttaggattaatctcacgcaaagggtctcatcttttcgcttattcttatacttatcagctaaaatttaaattttcaaccttaaatttggagctaatttaaggtttttttcatcgaagtttattttttagtctttgcttttttattgctaagtacacgtatataaaagttttatttacaaattactttttttacaaatataccgtttaatggctccggaaaaatatatatcgtgcactatcgtacaagcaactcctctgcacctcttttctttaaaaaaaaaaaacaaaacatcatctgcgtgtttactcaacgtgccctcgcgccatcaacacaaccaacgtcccattgccaccttttatacttctaccttcttcagtagttcatcaatgtcgcgagcaccccaagaaacgtaggatcatccaagcaaacccgccaccacctgccggccggccatgggcggcggcggcggcggcacgccgcgcagcagcatcggccacatccttcccggcgccggcttcgtcgccgtcggcgtgtggcacctgttcaaccacgtcaagctcttctcccagcgcccggacacctacgtcgcgccggcgtggttccccgtgccgggcgcgcgctacctggagctcgccctcatcatcgccggcagcggcgtggagttcgccatggagatgttcgtcggccactcgacgctcctccccttcgccgccgacgggtccatcccttccgaccgcctccacaaccacgagcacgccatcatctgcctctccctcgccgtatacgcggccgccgcgctccacctcgaccgcgcccgcgccccggcccgcggcacgctcggcctcctcctcgtggcggcggtgttcgcgcaggagctcctcgtcttccacttccactccaccgaccacgccggcgtcgagggccagttccactggctcctgcaggtggtcgtcgccgggtgcctcgccacgtcgctgctcggcgtcggctacccgcggagcttcgccgtcggcctcgccaggtcggcgtgcgtcgccttccacgggctgtggctcgccgtcataggcgccatggtgtgggtgcccagcctcgtgcccaggggctgcgagctggtgcgcgaggacggccgcgacaccgtgcgctgccgcagcaaggagagcttcccaccgcgccaaagcgctcggccaacctgcagttcgggttggtacctctcgttcatgacggtgttcgtcgtcgcactctacctgtacgtgagcaacagggaccccgccgcaaaggaggcggcgtacgcgccactgcagaaaaccggcgccggagacggtgacgacgacggcgatgacgacgcgcacaagggtggcggcgccggcgtgcatgggttcgctgcgttggagataaaggtttgattggcaaaattgtaggacagaggtttctgtgtgaaaaggattttgatcgctcgggggatatccctttgttttttacatgtcacttaaatggttatgaaaaaaatttaaaaaaattgagaagatgtattaacatgtgatatatcactctataaatattcaagtaaaaattcttctacatctcgcaacgaaaaaaaaaataaatttgactctgaatatacgttaagtagctccggtttaatttgttttcttcgttacaagatgtagaagttaaatttttacttgcatgtttgtggagtgttatattacatgttaatacacattctcaattttttttcaaatatttcataaccatttaagtaacatataaagaacgaggggatatcccctcgagggattaaaatagtttcccgtttctgtgtacagttgcttgtattgatcgatcaaagtgcaatgaatttcgtttgaagaatggtgaagctcctataaaaattcatgattggtttggaatttggaaacatattgtacatatatatgaatgtgtttgtgtcgtgctgagatcatgatttttgttttttggcgaaagagagataatgaattatttgtacggagtatgtgatttgctatccatcatcatgacgtgtgcccttagaaatgtgaaggtgtacgtccttgctccgaagccaagtcatatgatgaaccatcgatctaagaccatattagttccactgggcactactaatgcttaataacgaggaaataagcaatatatttgttagccctctgaatttctgaaataagcaaaaatgcatcttatacagtaatttttttaattactggattttacatggatttttcttctaatgtaaaatgtcataaaagtttgttttttattgctagtaattagtggatgactcgattatttttctagattagcatactgctgttttagcaccaatcttgatgtcaattcaatgcaccacaaaccgacgtatttttaaggaaaaaactgtcgccactattttagcgtttccgtttgagaatagggttagcgaaatatgttaaaccaataggacgcgtgggagagctcagccctacaattaattttacaattaatttatcgaatatctcatatccctgccgtagaaaatagcaatgcctcagagtcacttgtgctatatactcactccagtttcatatttttttttgatgttttggataagattaagatcaaaattttctaactttgagtatcaataacttcaaaaatatatttaatttaaaggcactagaataacatatttgtcttataaactactacaataaaattaaaattatatttatttattgtacataatataataaaaaatagttaaagatatttattttagagactgtgttattatttaaaacgttaagaattatgaaactgaaggtaatatggccatgctaacactaaacacattgcaaattacaataggcttgcatggccaaggaacctttagctaatagctttctgaatggccaaggaacctttagacgagtaggttcgctcctacatgaattccacaacaccctccattcctccaataactagtagcttttggcggcatactggcatgatgatatccatcgttgatcatgatgtgtattctttattgactccccacttgtagtcattcatatgtgttattcttcatttctttccataaggcctgtttagttcacaccaaattcccctccaactctcaactttccatcacatcacatcacatttaaaactttcctacacacataaactcctaattttttttccaaactaccaatttttctcaaatttctccccaattttagaaactaaatacaccctaagagtatttgtaacactacatcatagactatagccatgcatgtagcgtccccttagagttgagggatgcagggcccacagcccttctgggcacatgtcagcctccagtactatacatacaatactagggatcttaattcagagttgagccttgttggtagaggacaacacacacaaagagcaagggggtgtcatgtctcgtgtggtcttagagggaatcagcatgccttgcagaggagacgaatgctttaatttagtgagattaggtggagagatcgagcatggctgagcataccatcacaaaatgagaaatgttgtgtagaacacatatttaatcatgatatgtgtcacagatgcaatgaaagaagaaaccgaaggcaagccaagttaaaagaagaacaaattaaatcgaacgcaaagacatgaaaaatcaaagacaagtaggagctcataggccaaatctagtaaggacatggttagatgcagtactacaacgccgattgcgagaagtgatggatgagaaaagttcacggtaaatcatgatgggtgatggaacttgtaaagggacgttctcacctaaactagcggttaacggtgtagccatttagggggcgtggagaaaaaacaatgacaacacgttgaagctagattgctttactactactactccatctattttatattataagatatttaattttttcttagccaaacttctttgaatttaactaagtttgtagaaaaaatatattaatatttttaatacaaaacaatatattaataaaatatagttaatattaaatttaatgtactaatttagtatgacagatattactattttttttataaatttgattaaataagtttgacaaaaaaaaaaagaaacggagggagtacttcacaatgccaactagagccgtgtttagttcacccccaactatcctcaactttcaactttccatcccatcacatcgcatctaaaactttcctacacataaactttcaacttttttttctaaaattttaacttttttcaaaaactaaacacaacctagctgtacagcaaaggttagcttgaaaggcaaaataatgtgtcgttttttaggcggggaatgtgtcgtgcccagaaacgtctttcatactgctgtctcacatgtgatctgtactccaaccgtgtccatcctgaattttgttgctactaaaactcgtaaactcggcagcaccggaatggccaagcaggacacgcatgacgcagcacgcccacgctgagagtcgtgcagtgcgcccaagcacgaatctcgagggtggtgcatagaagctccccgcccaatcaccgcccgccacgtcgcatccccgttccacacccttcccttcccttcccttcccttcgccaccgctttgcttcctcctctcctcctcctcgcttctgcttttatcccactcccactcttcctcgcccccaccccaaaaaccctagccgccgccaccgccgccgccgccgccgtttgctcgagcatgtactactactcgctgcgaggtggcgcgtgcgtctaccttgtggcggcgtgatacgatacgacgcgtgcggggggaagggaagccgaggtttgacttgagtggtgagccgggcatggaggagaggccatagatcgaagggaggcgcctccgccgccgaaggaagcggcggcggagaaggtggatggctccccgcaaccccagccccaggcggagctgcggctgcggctcccggcggagatcgactgggaccggctcgacaagtggaggttcttcgtcctcggcgccggcctcttctccgccgtctccaccgcgctctaccccgccgtcgtcctcaagacgcgcctccaggtcgccccctcgcccgcgcacgccgcggcgtcgtcgctcccgccctccgccgccgccgcggccaccgccatcctgcggagcgaggggcccctcgccttctaccgcggcttcgccacctccctcgcgggcaccgtcccggcgcgcgcgctctacatgggcgcgctcgaggccacgcgctcggccgtgggcccgacagcgctcgccctcggcgcgccagagcccgtggcttccgcggccgcgggcgccccggcggggctcgccgcccccgtggcggcgcaggtggtgtggacgcccgtcgacgtcatcagccagcgcctcatggtgcaggggaacccgtgcccggcctcccgctaccgcggcggcctcgacgccttccgcaagatcgtggccgccgacggcctccgcggcctgtaccgcggcttcggcatgtccatcctaacctatgcaccctccaatgccgtgtggtgggcgacctactcgctgtcgcagaagacgatttggagcggaattggttgctacctgtgcgagtacggtgttggtgtccaagaaatcgatgccggggaaggggattcctccctgcagccgggttacaagactgtcatggtggtgcagggagtgagcgcggcgatggccggtggcgcttccgcccttgtgaccatgccattggacaccatcaagaccaggatgcaggtcatggatggggaaggcggcgagccgattacggtggggaggacggtgaggaggctgatcaaggagggtggatggggagcgtgttacagggggctcggcccgaggtgggcgtcaatgtcgctgtctgccaccaccatgatcaccacgtacgagttcctcaagcggctctccgccaaggggcatgagagcagcctcccctgacgagacgaatagatgatgcaaataggtgaccttgctttgttactttcattcctttccaatgcttgtttcatcttttaggtgttgcaaagagttgtttgtagatagtctttgtttgctcctctaattaagctaagcaaatcaatgcaatccactctttcagaatgttttctgtgctatcaataggttttgccttttagcttctgaatcttcacaacggagtaattcatgtatactgaaaaattcctgtccatctatataaacggctggttctccatgctgcaatgttttactataagaaattaagaatcatgctcattgtattatagctacaacctaaacaagcgaggtgatttggaaattgtgatggcactgatgtggccactaacagtgttgcacgttaaatccttaactctgttgaataacagtattgcattagcgagtttctttaggatgacaaattgaattattcaatcaaatgatttgcaaagacgctgctttgttactgaatggtagagtaaacatgtttaatgttgccatccaaagctggagctgattctggtatagtggcatgggctattgttgcctattcgctgctctgcaaatccaacttgtcatgcaggcacctgttccatagtccataccactcttggatggacaaaagctcatttcattctcttttctctgtccctattctgaagccacaccaggaatctgaatacgttgagtggcacacatacagactaggatacagtactaacttacacagatgcttttgtgcagtaagttgcaagtgatctctattccacacatagcaatgaacaataggcacaaggtatgcatggattggattggtagaggtgttctcatacgccctagtgcattgctgctcctggaaacatggaagatctgctcatcctttttcaatgttctcccatttgatgttttatgccttttctgatttgataagtatgctaaagttagtgtggctgaggaagtcttttcttcgaattaataaatactcgcagttgatgctgttccaactaaatgcattcttgcccgtcctagtttaatgttgattaggaattagtacaagcaaatctcccattttaataattataaacttttgcccatgatagtgaggcgtgtgtttatccattgtttatgctatcattatcttgatgatgggtaggcagaaaattaggtagccttctttcctattaccctgtttcttaattgttgctttgatttggatgagttcctctcttggttcctccacttctactcaagtctactactccactccgtactacatatcagaggatactcttggacttagattggtaccgctgccttatcttcatctgctatcaggaatagtaggatatgccttatgtttctgtatgttttgattagttgattaccacagtgccccaactctgtaatcctccaaatggtgcttttgtatatggtaccgaaccaaaatcttttgcttgacgaaaatgtgtggttgttggctaatgaaaacggctttgatagaggataatcccactactactttaaccatccttgctgagtgaggattagcctacccaaagtgattcgcctgctgagtgctgacctagattaggacatgaaatgtcagtacttaattagtactactactacaaccactatgagccgttcaatggattccaatgtccctttgtccactgtccgtgcaattatggtataggcatttggcttacctatgcttgattctgacaactgattagcgtaaggtagaggtcttattagcaccagctaagcttggcttgttcatgcacaagccctttccttttcatatcttttctggatcaaagcaagatgagtttagttctgagctgacaatactacaatcactgggtttcagaccacagaaaatttttttcaggaaacattgtgcttgcttccatcagtgatcagtcaccatgattagcaccaggaagaagccgataatagggtctccgactccagctccagatgtgcgtgacatggacgtattgctatctgctgctttgccttttttttctcactactttttgttcactcgcgtagccatcaatacatcacgaagtggttgcgagccactggagtgccaacttgctttctttatctgttggccaagccacactgagcttgtgcaattggtcagtttattaaagagaaaatttgcatatggccgatatgatattttgtactattgtaataccattgtctagctaccatctaaaaacttgcgtttggtgggcatgacatttcaatattccatatttcacataagctcgtgaaatgggacaaaaaccaatttcaatttactgatgaagagaaaaaaataccaagtactggtgtatggaacttggaagaaacacttttggttttgcaaactacaggttcagggaatatggaatttctaattattatttttctaggctaatcactctacgatagtcttgagttcctcaacaaaagcttcctgtccaaagcaaaagccaaaaccatgaaaaagaacatgtgaatttgccacaacaagagcctaaggttagtagtaacaaagctttaaaattaagctcacatgcatgcacaatcagtatcaactgagacggctgctgctgcccgcaaagggcgtactgttagtgccaaatgtacaactctggattcattgttcgttgaagaaccacttgtgtgtgtcgcgaggacaagttctttttttcatctcagagatactgttcatgtatcctcgctcggttttcttcccaccatagcctggcatgcatctcgctgaacctctctcggctgcaagcaagagagaataattaagtctctttccatgatcatctgctagtagctagcaattcagttgcttccaaattcttcgatcatggagattcaagcaattagcattaggctgttcttgaaatcagattactgaccttttctactttgtcaatttacggattaccaacaagacaatcctatttacaaagaaagacgttacaagaaggatgggagacaaacctgaatcgaacacgccggagttctctgataccaccaggcaaagcccggatggtaatatatacaccaggctcgtcttcctcgacccactcccgctcttggtcacttgcattgctgatggacaccgagagctcaccagatctgtcgacctcttcaggagatgagctcgtcctcattgatgcgtccattgacgaggtttctgtcttggctccacttatacttgacagcttcggtgttgagaccagccccactgaatcatagcactggtgtccatggtggtggtggccaccattacagtagtggtttgaatgatgctcaagagaatctgatgaagatgaacccactgcaccaccacctgacaatggtctatggaacgaacgaggtaaccgttccttccccagtggtggtgtcaccgggctgtcctcctttgagctctgtaggaaaagaaaaaatagacatggaatcatgtcaaagtcacattactaactgcaataactagaatggtaacttgggggagtgctagtgtcgtcacctcgtcttcagattttggagtagcaggaagaggaacagcttgatggttaaatctctgtacattgtaaagctccataactttgtcataattttcagcccaccatctttgtgcttgccacttgttgaacatctcacggctataataaaacaattttattcaccaaacagaatcagcaaggtaatgttacagctacaaacaatttatatatgatttttttttcagatatgataagaaagcattcatacgcaaatatagattgccttgcttacatttggattcacatactaattagttatacattatctcatttagactagtttcctgcaagccacgctattatacgaagtaaataaatgatgatgtatattgtgaggactgatgacattctgtgcgcataatcaaacaatgagttaagagataaacagcatggcataacttaaaactactaaagtacatgatcagtcaacaagtagctggaaggttaaaattgtacgaaaatcaaatcagagaaatttatacacaatcagcctacaacatacatcaacgaaacaatgattaccatgaccacttgcattagtttcaccaagaacttatgcagagaataatttacaaggaacgagctttgaatggcctgaatagaaaaaggaagatgatatttaaaaatccattaggtgaatcagatgaattcattttcaatagtacagtccaaaatcgatgacattccacgcttcagttttctggctcataatcatgatttaagcctgccttacagtttcctaagttacatcttgctctacagatttctaattggtcatgtataatttacttggtactgtggtgactatgacagattcaactcagactaatagttgcaacagaaatccgcaatcaactgcacaagtggctatgcccaagaggtaaattggtagtctaaaagcacattaatcaactgaccaaacgtctatgacaacattagcagccaaaccaatgttaccaaacccaaccatggatccactcattaacaaattttaaaatgtccctacttgccttagatctagaactaataataaagtaaataacaagaacactgcactcatcttaagatccagcttgtgttccatcaataaagtagtattctatatctaataccagtgggggctgatcaacgtagctggccatgaggaactccctccaagaatattattttaacagtataccctgcttatagacaaatcttaaaacaaccattctaaactcaatctgaacactacaaatttataatgggcatattttcacatgcacaattttcttttatagtgtccagattaagtctgcagtggtagtttttaagatctcattacaagtgcagcagcataagaaccaaaagtccatccattaggaaagctgctgctaatcagaggtccaggttggatggttcccctgataagccggtgtggagggaccctattacatattaataagaccagaagcctccaaccatttctcaataacaaacggccaaagaagagagagcagaagaagttacgcttctttgtgccattgctctctttccatatagcttctttattgactacctagatgagatgtggcttgtgggcctttgctgtctctatcccatgctaatactacctcttcctggagcagaagcagcccctaaagcaaatgaatgatatagataaagtacaaatgtgtgagctggacttgcccccacatagtactggtaaatttaaagtttcatagagcctgttgtttactagatcttctagccctataaaccctccagggtgaacaactgacatgatcccctaactttaataatgtatggcttaaaattctgagtctactaactggacataacatgcatgctgacacatcaggatttcgacctggctgcagcacatcaggggttaaatcttaaatgaggtccattgtcatagagttgacaatcaaggtatcactttctaatgtaatctccattaaccctacaccagattgttcccattatgagcataaccagccgtaaaatctaaaataataagggatttactatttagcgaatacgtaacggctatgaggttgcataggagtgagggaaaaagtgaagttaatatacagggtagcatatccaatggtacgggtgtgctttttatccaccctcgagtaaaaataggattccagttaagtaagaaattggggtgtacaagaattttaaaactcacacccctccatccagtgtttaaaattgacttacggcaatcagtataagctacctcttaatgaaattttccttttcaatagataaaccaattattccaattgaatggccccaaagtgtggaccagtagtaaactaaaccacgaaaaattattgcaaaaggtaaagaaggaatagcaatgttgacagagcaatcggaaaaaaaaaactaaaacatggctagttgaagtatgaagatttaaccattctattgggctgttctccataaattgccagtgccccgaggcaatgatcaatgaaaatttactacctcatccataggggcttgggaaaaattactgcctcatccataggggcttggttgattttaactggctatcaaaagtcaaaactactcgcttttgtccagtttgcttcttgactaaagaagcaggttcagaacaaagctcctaagcatgacatttcgcccccatttacaccgcaaagttactatctcaattcaatatactttgatctaatttatatttagcacgaccagaattcaatcattcatacgagcgcaaactaaactttcaatcatatatgctaaggactaatgcaaataagtagaattttcagtctttcactgatcaaagaaccgagttatgcactggaaatgcagaatttagctcgagcatgctcaagaacacacctgaaccggatgcgtttgaggtcgttgccgccctgtggcagcgagacgaaggttatcagcacgccgggctccacctgcgccacccactccttcgcgtcctcctccttgccgccgccgccgccgccggttgacaccatctcgtcgtcgtcgtcttcctcctcatcctcctcgtcgccgatggggaagtcggagcgggcgctcatggacggcgtagcgtccccgctcgacagcgcgccgccgccgccgccgccgcggaagcgcggcgtcgaggccgccgagctcgtggcgcggcggtacgcgtagtggaaccggtcggagcccgaggccgcgtcggggtcgccgaagccgccgccgccgccgcggtggtggtacgggtggtgccggcgcgaggcccccgccgccgacgacgagccggcgcagggcttgcagtgccggtacgcgcccgacgccttcaacgcaatgtccttgatctgaaacgaaaccccaaaacaaaaacctcccgtcaaaatcaagcccgatctggttgattacgacctacccgaaccaaagattcaaacattcaaagagcttgaacatcccaaaaaaaaattatataccacgatcaaaacgaagcaaaatctgaacagaaaagcaggaacccttcagaaccaaaaccatcatcttctcttttcttttctttttcattgaattaatcaacaggataagaaaagaagagcttcaagcacacacagtgacagtctcgactctcgagagtgaagtaccgagaaccccacctgcgcagtgagcgccttgatggccagccgcgtgctgggcg

SEQ ID NO: 32844 - DNA, 7667 bp, Oryza sativa
agcatcccctccgcctctccggtgacagcaacagcaaggtcacaggtggcagaaccgcccgggcaagcgccgcgcgtgagcttataatggcaggggagggaggcggcggacccgtactactcctacgcctcttcttcctcctctgatatcgagcttggagttaagggcattaaaggcggattaggatctggtgcttaatggcaggaaaaggcggaggagcccaattggggggggggggggggggggtttatttatgagcggcgcagcggctgctcacagacgttactgctgcctccattaaacagcggtcgatcgatccatcgatgcagagttctctgacacatctcatctcggatgcgtggtggggctcacgtgcgcgcccgtgtggactgtcaaacaggaagttgtgtgcgggttgtgacagtaagaaacctttttgtgtttgcaggtctcttgcacgttagtgaaaaaggaaagaggaagggagagaaattggtggtggtactagattttggtttatatggattgagtcactgtaacaatatttatctccttttggagaagtagatcctctaatgtgatcatagacatgtggttatgtggatgatagggttcacgtgttaacgatcacgtctctccgatatgagaatggtcactgcatccccatccatttcatgtttggcctaataacgtgaaagaaaatagagataacgatgaagaggatgattctagcaaaggcaaaacttgaagatagcatcttcgttgctgcacacatctctaacatctttgctgctaagcacgtaataatcgcacggtttatcatggtttttaaaaaccgcacgtaataatcgcacggttccgatggaatagttaatatggagtagaagcatcagccgccccgtaaacttcagaaatactactccagtccggagacggcctaccgggcggctggccaccgcaactctgacgtctcgaccaacaggattccttcggcaacgtccctaactcccaagcggccaagccctcaatcttacgaccttttttcttttatctcgtatcccgtgtgcccgccgcccgcgcgtgggtggtcgtcctccatgctcatcccatcatcagccccgtgcgcccgcgcgcccgccgtccgcgcacgcaccgtgtcgccgccgactcacactacccgtcgccgcggcagcgcggcagccagccgtcacgcacgctaccggccatcggccccctcgaaaaccgaccgaaataacgcgcgtcgcgtggtcgcagcccacagctaagcgcgcgcggctccgccgcgcggccccatcgcctcgtctcgcccacacgcggctgacaccgtaatcctggccctttttcctggccgcgcgcgcgcacgcacgcacacggtgggaggcgaatgatcgacggcgggcacatgcgcgcgggccgggaggcggctcgtgccaacagcagggtgggctcggtctgtctcccctccccagcttgcgcttgatcaggagcagcggctgccgctgctctagtggtgacaaactgatgctccaagcgatcatcgctaatgatagcgctccaaagctacacgctgtgagttgttaacgggttcttttccgggtggggttaggtcgctgattgaaggctaatgcagctctaacaactatgctcattgctcgctgcctttctcgtcttatttggaaattattttttcgctcatcttgtctgcggctaggcgtgcacgcagacttcttaactaaaagagtgatactgcgacactgcgcgtgtttgaattattgattggaacgaaggtcatcgatcgattgatccaacgaaaaggagagtttggtccgttctggagtagtagtttttagctgggcatgtaccgtgtgcaggcaactttggagttgtggaggattcggcccatcatcgcatgagcacagccgccgaaaggccgaaacaaacatcgctagtctttgggctgaatttctctcctgtctggattagccatgatggcagcgctctctcagtctctcgttctctctctcgatctcgacatgctacgattaatctaccagttaattaatgaaactatacgattaatctactagaagaaaatgctctagtttgattttttttcctttctggaaagaagacataatgccctgaaagacttttcttttttcataaaaactctttcatgtaaccatattcgagtaactagtatattctagtcaaaatgtcggggagatcatccattccaaacttctagtactagaagaaaagctaaacattataggcaaaataaaatatgacttagcaattagtaatcctcaagcaaatagaataatagataacatgtctaacacaaactatttacatatattcatttagacagcaacctgatcacgccaaaccacacatttccagaaggttgcttacccataccacacatttttagcgaggatgaaatatccaggaaactatcagaaatgtgaccaaatactgcgtcataaaaaagaatctgcaggcagataaatggaaacgaaaaaaaacttccatcagctcaattgtaaaaagaacttattccagacagtggtgtcagtgttcccctaaaataacctaatcatgttggaactaggatcaatgctacaaggccggcccactgccgacgcctttgtaaatgcagacatgctaacacttaacacctttcccgtgtggaacaggcaacaacttaaaaaaaaaaagaaaggtctttttcacgtcgcaaccatggcttcaaattttgctccctagaaaacgatttgtgtacagtgcatgacagggacagccaagatatgagcattaaaatgtggaatcgactggctcacaaatcgtgtttatgctctgaaactgtcaataaaatcacgaaaattttcaggctaataatgtaacgtcagtgcttaagagaaaaaactactgtacttttcgggtcagattctttcgctgacggaatcgccattattatttcccccaagccaaccaacgctgcccccaccgcctctgactgacaacctggccccacgaccccagtcaccccatccgatcccaggtcccccctgtcccctgcaccgagtctttctgcaccgccccctcactttccacctccgggcccacacgacagtaacccaggggacccacgtgcaccgggttcacgggccccggtcgagacccccggtgcgccggtggcattcgaggaggctagcctctctctcctccccgacctcacaagcgcgaaccccgcggagccgccacctctctcgcctccccgcctccgccgcgccgcctagggtttccaccgcccccgggatgcgcgcgccccctcgccggtagcctcccccccggttcccgccgcctccgccgccgccatgtcgctgctgcggcgccggaagcagccgcagccgccgccggagcagccgaacgaggacagcagcaacggctccgacctcgacgagaaggggaagaagaagccgggatcgtcgtcctcctcggcggcgcctcctccggaggcggcggcggcggcggcgaaggaggcgacgaagcggacgagggccaggtggtcgtgcgtggacagctgctgctggctggtggggtgcgtgtgctcggcgtggtggctgctgctcttcctgtacaacgcgatgccggcgtcgttcccgcagtacgtcacggaggcgatcacggggccgctcccggaccctcccggggtcaagctgcagaaggaggggctgcgggcgaagcaccccgtcgtgttcgtcccgggcatcgtcaccggcggcctcgagctctgggaggggcaccagtgcgccgaggggctcttccgcaagcgcctctggggcggcacgttcggcgacgtgtacaagaggttgccttccctctcctccgcctcttctctctctctctctctccccctcaatctgtctctcttgaattaccacgatcatttagtgcccgtaaaaattaatttatgcaagtaacgttggaggttttttatccgagttatggagcattgatctttagttagtttgtcattggttgtgtctatatcggtttagatgttgctttcatcattcgtgctctactttctgcttttgtttgttcgtcagtgttagttttagaaatttaatgctgtgatgctttaatttgagaagtgtctgttacttttttgggtgcctttgttgtgtgacttgtgatttacgatttcgggaatgagattagcttatttcaatcattcttggttgcaaaatactacactttctaagtgttacttttaagtgttgtatttcgtaatatctttgagctgaggaataagtatttgtcccaattttgttgaaatatgactatgttgaatgagttgggtgctaaatacaaagaatgagtattcatcttcctggtcagctttgtactaattgcttgagatatctcaaattttctcgaccaagaaaaaaattgaaatgttggcgtagctgtttctttcatagtttcatttgtcttcaaatgttgtaaataatcagtatcaggaaagtaggatggtgaataggcaagaggtaaacttgtgaaactggatcatattcttgcttttctttcaccatttgatttcactgtttactattaccagcaaactcaaagtggtgatgatttgaccagatatagaaacagaattgatcaagagaaacaatatgcttctatattgcgtgctttcagggtttttagaagagaactgcaatttgcatgaaaaaaagaacttttggtatggtttcttacaggcacgccttataggtttcaactgagggaatctgactgttccgttatttaattattcttttcttgaaagacccatgttgcctactgtctgttgaacaacttgggatttctgaacaattttcctcctagtccttgcttctaagccttgtgttgttgagctagagctgtccatgtatatatattgacagttagtgaagttgataatttacatattaaaaacaagacctaaatgtttatactttacggcgtagcttcggcctaaaagaatccatacaaagaatagacaatataggacaacacactgcaatatttagcgtaataacacgacttgactccttcatgtggtattacttttgtaattattttttattgtcataacagcaattttcgttgctttgatgtttttgttgatggttacaaaactacaatgatatatgggtaagtgattatgcatcatggtgtgtttaccttgtttgatacagtattacagtcaccagtacagcctgttaattctgaagattgtttcttttagatttttagtttgtctttccgcagcccgtttctcaagaaaacctctagctaggaatggcatgtctcattgttaggcttgcatgctaggcctaattgaagtgtcccttggccaaagtggtgtgattatgccatcgtgatagtcgcaccacaaggacgaggagagaagggagaaataagtacttttgtttatttcttgcttgccggtaatgatcacagtagactcatagtgggccttttttcctaatatatatagatatcgatttggttaataccctgtctagctaagagataatataccaaataaccagatagacatattcctaagtaataaatatgtccctaatccttgcatggtgatcacttaaacatggtacattaacaccaaccttaggaaggcatgattactattctattgctccatcacatgggccttaataggttgcacacggcattgattagttcactgttgctctttatgtttcatcctttagtcattgaaccattgttctttagtctagaagttgggatgccataatgacctattcttcttttgttagtgtaatgcacttttgctacgtgtgctgcacactaatacttgggctgcgtatactcccactttctcattagttctcttgaaatattttcaggcctttatgctgggttgaacatatgtcactggacaatgaaactggattagataaaccaggaataagagttcggccagtcacaggcctagtggcagcagactattttgttcctgggtattttgtttgggctgttttgattgcaaatttagctcgtattggatatgaagaaaagaccatgtacatggctgcatatgattggaggttatctttccagaacactgaggtagccatatttaatgcacttagatacatggatttcctttgatgcttggctatgttctcctcagaggtttagactgagttaaatgatgcttgtctgtaatgtaaattaccacctgcaggttcgtgatcaaactttgagcaggataaaaagtaacattgaactcctggtagcaactaatggtggaaatagggtggtggtgatcccacattctatgggggttctctattttctgcattttatgaagtgggttgaggctcctcctcccatgggtggtggtggtggtccaaattggtgtgcaaagcacatcaaatctgtaatgaatattggcggacctttcttaggagttcctaaggctgttgcaggacttttctcatctgaagccaaagatgttgctgttgctaggtaattgaaatcaaaagtctgcaattctactgtacaattgttagtattatttgaggttttactatgttgaaaccaaattagttcataatgcagttgtttataggattacgtacttgtcaattcaatttataactgttatgtgtaacaacatcctctagcttgaatataagtttgattaatgctctgaggactatcagttcacaacaggatttggcacctctgcttgtggcaatccagttacctaaccaatggagtattttttttctcaaaccttagtcacatatataatttgcttggtatcatcggaaaatctcagagttggaaaataccattatacgtgtcactgacatgtgggtcccacatgtcattgtcacatactccatccgtaccataagaaaccaacctagtaccggatgtgacatatcctattactacgaatttggacatatatatgtccagattcatagtcatagaatgtgtcacatcctatcctagattcattttttatgggacagagggagtacgatggtattttgcaactcatgtatctccacgatggtatcttttaaattttctccatataattattatataactgtgctaataaaagaattttagtcagtactgaagttgtcaatactgtatacactactctaggtactgtacgatttgattataggtcaatacctatgatctgtgataaagtttgtgggaaccattgaattacttgatttagcttaaaaatgccattgcataaatcctttcggtaattgtgtaactatcttcttgatactttattgaaggtgaaatataaagaaaacatgataccgttttcaatatatcaatgaaatgatagatgatagaactaggcaccttcttaatgctaataattatgcttgagattgagaaataagtaactgtcgaaaatgctaatatagagatgtaacactattacaatgtgccatctgaaatattgtccttagttcaagattagagttgtaaaaccattacttgtagtaatatttacttctctggtttcacttgaactataaattttttgctgtgta

SEQ ID NO: 32845 - DNA, 39486 bp, Oryza sativa
  unsure (1)..(39486): unsure at all n locations
tttctaaggatgctaacgggaagaatgaggttcatccagaacctgttaagtatggaagaattgtctctttcggtaaagatgtagcagaggctccatcttcagaaattgagcagatagaatttcgtgtgagtatccaaaagtatattagcattttctttacttactgaccatcatttttttgcttatcactattttgctagatgtgtagtattttctcgtgctacttatcaatgcatctggcagtttgctctagctctttcagcagtcttgtatgcgatatgtactattcatttatgtaacttcccccctcatttagtgataattgcttttatcattatggttggtactcttttcccgtgtagctggtgcagctatttcacatctatttgcaggtaaaattaactaatatcagggccactcttttgcctacatattatttgaaaacgagtccaaagaaaattgttcccgtcattctgtatttgagctgcactgcatgcctgcacatgtgttaggattttctagcttttacttgtttatgtaattatgtgcctttgttctcttggttttatgcacttatgcagccccattttgattgtttcaattcaccgttcaataattttaggttcaattatgctacataatgctctatgtagaatggtttcttttctttaatatgttatgtatggtttggacattaattttctgaggatggggttgtaagcgtttatgattatagcaaaaccttaacgctatgcttgtttcagatgctgtcaaaggcaataatattgcccactcaaatacatcatgccgggatatatggacagagtatcatgaattaggatggggcggaataaagcagttgcagactaaggtttcctgctgctggctccataatagatctttcttcgttttgttgctccaaggatgatgcagcgtggaagtgttcacttttcgtatgggattgctgacaacttggatgatccaaagtacggccactacaaatactggtcaaatcccttggaaacaaagtaagagtcttttgccaacattctcatctcattctagtatgttctgtttcttgtgaaacatgtgatttaggtttatgtggaacatgtagttttggaatgtaaagtatataattttctggcctctgcaccaagtgagatgcacacatccattacaccaccaagctaaatgacaaacgtgtttattgtgaatcaagtacatttttttctatctgatattctgttcaacttttttcatacgccttataatcctttcatttgcagattaccaaatgcacctgaaatggaaatattttcaacgtatggagttggcattccgacggaaagagcatatgtctataaattagccccacaagcagagtgctatataccttttcagatagacgcttcagctgagggtggggatgagaataagctgtttgaaaggcggggtttacctgtttaatggtgatgagaccggaccagtttttagtgcaggatatatgtgggcaaaaggctggggaggaaaaacagcttcaacccttctggcagcaagacctacgtcagagaatcagccattttccaccctcaaatctcctcgaaggcaagggcacccagagtgggcgcacgttgatatcatggggaattttgctttaatcgaggatattatcaggattgctgctggggcaactggtgaagagcttggcggtgaccaggtttattccgatatattcaaatggtctgataagattaaattgaaactataaaactttaaaaaagcatggtagttttgtaggagaattatttgtttcctggccaaaattttatgagttttgattcgatattgtaatatgattttttttacctttcccttaagctcttaattcagtagaggctgacttgatttgtattattttgtgatttgagcggcattgtatattaaaatgtacagatgtattcatgggaattgtgttacgatttgaagttgagtactccccacattacaaaatatcaggcatatttgctctttacacggtattaagtactatgttaaccactccttccgttctaaaatgttgtaacctaagtaaagataaaattagattcattcagtacaatgaatgttcaaattcattgtaatagggtgcgttatattaggttgtaacattttgagacggaggaagtaacctttttttactatcaactactcactctcaaaatagtatattttgtctcttaatatagcaaccttagtataggacatgacactattataaatttggataagcctcttatttagatttatagtattacaatgtttcatgtctcgtattggattgttatattatgggacaggaaagtaacatatggtggcgcgcacacctttaaaatacaaattgagcggcaattctagaatacagatggagacatctaataaggggttaaactgtactcgctggctcatggcactggcgtgccggtgcaccgcacaaacatcgagcaagttaacacctaagattaacaaatgaccaatgtcagagtcaaatatgcgagggagtgagcttagttatgaagatgagacaacaatggatgctagcttcagccttcatgtgtagaattagggataaaaatggttgaacacaaaatcatttatttaaaaaaaatacaggcatttgggaattttcatatttaaagaaatccactttacttgactggactattccattggattaactctaaaatatttttttcttatttcatccctaaactaaaaatggttcgttttactacttaacaacatttgtcttctttatttttctctatacgaatcgtattataagtagaatttttttaagccataaatgacatcattatcaaatttcaaaacatttttaaattagtgcttccaacctatataagcactgatattttttcaaataaaatgttaagaggtaggttataatggatctaccaatcaaaaaaaatcagtgcaaatacaaattatatggagagataaaaaaataagcaatattgctagggaataaggtgaaccactttaaatagctcggctgctcgggggtgcaaaatgagcccaaaaaaaattagagtgttatgtgctctgcccaactaattcaagggagtaaaatgaactttatttatatgaaaaaatttgctgcaagacacccaaagtttatgctatttactgaaggatacagcaagaacacacttttgttagagagctccgcaaaaaagtggtatttggatgttggacacccgtaatattgttttattatatctagaagaaatggagagagaaacatccgcgaaagtacggatataccctctctccatctgttaacgatcacagttaattcacatctctacataatccacaccacagttaatccacatctgaatctatatcacggttaatccacagccattcatcagtcgagttgaaagcagttggcccatagagaaacttgtctttaatgaatatttctttatccatttcttttggatataataaataataccgtaggtgtttcataagccaattaccatttttttaaggtgcccttcaatagaaatgtattttccggtgtcctctagcaaagagcgtaaactttgggtgtcctatcaccaaatttacctttttatatttataattaaccaattcaactattcagtgtatactataatatggtgctaaaggcatagcaaaaggtcaaacttaatgttcggtcaaaatggcaccattatatagaactaatatttatttggtcacgaatttccagaaatgtttccataagtagatctgatggtttgatagtaggctgatggcaaatgtactcgatataggactaggaataaggtctgggggtgtgagagtctgaccctcacaacatacggacttatcttccaaaatatagcaacctggtatggtgctaggttgcaatattttgtggcggagggaataacaaataaacatcatcatatgaaaatattttcaaacactaaataatgttagtacatacatgacaccaaacacatatttttaagtttaataatcagttgaagttttcaaatgttaactttgtggaaggcaaggagaccttacattttaaaacagatggagtttctttttaagaaattagatgcgtggaaaacaattttgtaagaaattggcgatggaatttaaattcgtataattattgtaatgttggtaacaggtttcacataaatttgtagtataaatgtatgtaatagatagatattcataatgaatatgtggttccgattacaataaattaagtagataagtacatagaatgcccatttatgagtactttgctatgcatgctttattataactaggtaaatacatacatagcctatgcatgagttttttttccatacatgtttagccgccgtcaatgttttccttgttaccctccatctcttcatcatcgtctttctcatcagctcaaaggctttagtaaacccttgaattttctttgccaaggtttcaaatttttgtggaacacattgtggcaaatttccacccagggacaagggagcaatggtaggaaggggactggagggaaggaggccaaggggaggaatggaaagggaggtgaagggaggagtggatgggcttggaggggaggagcgccatggccgccatggatggagctctcacaggccccgtgcgtttgggagtttaggtggaggtggtggtccaaaaattttatgagttttgaatcgatattgttgtgtacttttttcacttcccctcatctcttaattcagtagaagttgacgtgatttgtattattttacaacttgagcgcactacaacaacaccctcatgtagaggcacttttgtagaggtgttttgtaaatttcctctaaaattaggagctttatagtgtatagacactttttagaggcattttaaaaattgcctaaaaaacttttactctagagacactttaaagacattttcaacatattttattaaattttatcttgtagatgcattctttcggtattttctgaatgtgcctggtttgcaaaggcattttcttgaggcattatttactctataaagacttgttagaatgcaatgtattactaattaagggactaaatataagtaacacaagtcacaaacctacaaggaatcgcatgtggttgagttgattagtgcattgaagatacaaatgatttgcccaatagatcttaagttcaaggattggcaatatcaagggaaaatattttattatatttttttcccgtttcatatgttcgtggtacaatttaatgtctctaggaaatacctctactgtcttcattgggggtaaattaaaagtgactgcgctcctcccacagcgatttagccaatttcagggcagcgtattcgactccgccgctatccacgtcgcccgcgctccctcccgcacgcgatgtggggtctgctgtgggcccgcgtgcgcgcttcccgcgcgttgcctccgcgttttcccgcgatcgtgcgctcttcttgtggctgcttgcgtgggctgcccagcgagcaaggcgcgctggcgttcatctgattttcacgctcacagagcaagcaagcgaggcccaatcaacgacgacgctgtggcagacaagtcatatcacctctcgcttgttttatacaatgtcttttgtttgtagagaaaattcatttggaaagtgcctctatagtgtccaagacacttattagatattttttttcatttggaaagtgcctctatagtgtccaagacactttttttttactgtaatgtccaagacacttattaggcatttttgaaaatgcctctacagacatttgaaaagtgtctatactattagaaaaatgtttgtacaaaacattttcttagtgacggcagtatatattaaaatggacttgaaattggcattgtcgcataaatcatgtaatgttaaataaaggatatcatgtttctaactataatctaaaatcatagcacaattgcatataatagattcctgtagtattcaaatgaacagatatggtggttctaattacaaataagcaataagaaatagatagcccatgataagtatttccccaacacgcttaggattacaaattaagtagatagatagctcctccacgatttcccttgcgtgtttagttctcatcactgttctcatcatcgttatcctccatcacctcatcgttgtcttcgtcgtcttcaatgtcgatgccatcgtccgcttccggtaggctatgcacaatctcgtctatgccttgcaattgctccagcatacttgacattattttttttggtaaaattgttccttttccttgcggagcttgaaagctttagtaactccctgaactttgccaagattccactcagtgatccgtttcttcaaattgttgttgaacttgttctccaatctagcgatctgaagacataagcaaaaatgttataagcttttgaactagcatgtggttcgaaccttacaagaaatgcaattgtatataaattgaaaaatatgtagaattcaaatgcatatgcatcatataacctatctatatggccatatattcaagtcattagccttgcagaggttttgcagagcagttgtgccaacactcagaccaatatgagcagcacttttttgttttatgtgaaagtaggattccaagtccttcttcgtcaatgtcttaactcgtttgcgctgttaaactaaaacatgttagcacaagaaaaaaaactgaaggaaaccatgcatgatctgtactatattttccctggctaacacagtagacctgatcagggaaagtaaacatcttcctcttgtcagtagctgctgtttggtcagtttgcacaagagaagtggctcatttaccaaggaagaattactttccactgtaggagctttgccatgttgatttttcttgggagcaggtggtaaaatggccaaagatctaggcacatctcccccaggatgtcctttgggcacaccatatatgactactcacaaatgaaagtatcattgcatgtatacatgtgattagtttgataaacaaatgttaatatccatagaaaatataaacgaaaatacccatataattttatggagaaagagagaaagagagatcgatcaattaatcgataccattttggccggagtcatagaagactcctcgccattggaagttctcctttaatagaatgaccagcttaacatatctctttattaattggaaatgaatgggcagcaacatagaacccatcccaagaaccctcaaaccagtatttaccccgaagaacatggttccacaacgtatttagtagcggatccacttttccttatctattaatgagactatagctttcttttgcctatgagctagctaaagatccatcgttatcccttccaacaagggaggcggaatcaatggtcatgtcaggtttcatattcaaagagagatgtcaagcaagcgccgaatccgtgtactcaacttgcccgacccgcttcttccactagacctcgtctttcaaagagcagcagccctgcaagcctaatagaaccttgtttcctgggccaagtcagcctataagtaagtaagtagggctgaagactatctgtttgttagtttttcaatcttcttccttctatgcttagagtaagtggaaatgacatccttgatcagcaagtaagcaagcggtagtttagtctccgacaagtgaggccgaactagccctagatcagttctcatagtgggggaatcagagtcaagttaggcacagaagagggggttgacatcattcgtcgtgattggatcaatcaaactactccacaagaaatgccaagggactccctttctcatcgcccatttcttcctcatctgttgctgccttgagtgcataaagtaggctcaacttctttggtttctaaagatcttgtagtagccgaaggcaaaccagtctgcttgttagattgaattgaattttatataacctatgcagctaaagaaaaaaaaatcataatggtctaagtggacctctcaaaggtataaataattaactaaataagtatacattagtcttactagttcggtctttttctttttctttttgttatgatgcccacatttcatacttctcaattcttatttagtaggtatacatgtgattagtttgatagataaacgttaataaccatagataatataaaggaaaatacccatatgattttatggagaaagagatatcgatcgattaattgataccattctggtcggagtcgtagaggactcctgttgtatccattcggaacgaagtgtaccagtcattaagcatttcagcttgcaactctggggtttctcctgacacactgcatgcattgatgcatgcgtacgtgcatatgttcagaagagggaggaacatgagttagctatcgatctcagctgaacatttgtttgtaaaaatgagtgctgagagggaagttggtgtacgtacttgatgcggtaggttgattgcacggaagcctcggcatcgggcgagttgttctgcaccaggatgtgatccaactttcccgtcctcgccggcgtgcaggacgacgaccatcttccggtgatctggccatcaacagcgaccaaggattaatcaagaaacatggcgagcgagagatggattaccacttcgcacatctacgtacgttaacatggatcagttagaagcaaaaggtaaagcaagaccaggaccaggaccagggttttcaatttcgaaattggattttatgcgcggggggggggggggggggatttcggaaaattctagcaaatttatttgaaaatttgactgaatttgaataaaatttgaccaaattcacaagaaaatgcaaaaaaggggaaattttgggcgaggtttgagtatgctggggggggggattttcggaattttcgaaccaaaatttcaaaccctgccaaggatcgattcaaaaagaatggcgagcagagatgtatatatcactttgcacgtacaccatgacatggattagaagcaaaaggtaagtaagaacaagatcccaaggatcgattcaagaaacacggcgagggagagagatcgatttcatcgcgtatagctatagggatcgatgacgtcgaacgtaccgttgacatggatcagcacgcgtagctgcctgcatctcttcctcaggcactcgatggatcccaggggcaccatcgggagcttccggatccggcgccaccgccggcggtaacaccatcgctcgggacgttcgatgatgtactacaatgatgcgccagttgccatcgatctcgcaacgtggtgaggggagagaacgaacaaagggaaatgatctaagagagcgcgaacggactgtgcttatgtgtgtggcggcggctgtggaggaattggggaggatagagacaccgacgggcttaaataggtggggattaagtgggtggcagcgccgtgtgagcgcgtccgctcaggcagccttccgctcgctctgcacgtgtgttggcgcgttgcgggttttcccaaattttcatcgagcacgcgacgacacacgttcgaacgattagtgcattgaagacacaagtaatgacatgaggttgagttgattagtgcattgaagacacatatgatttgcccaagagatcttgagttcaaggattggcaataccaagggaaaatattttattctatttttcacattggtttcatatgtttgtggtataatttaatgtctctagaaaaatatctctaccgtcttatagatatttgataaaatgtatctttgtttgtagagacaattcatttgaaaagtgtctctatagtgtccaagacacttattagccatttttttcatttggaagtgcctctatagtgtccaagacacttattaggtatttttgaaaatgcctctacagacatttgaaaagtgtctctatactattagaaaaatgtctctaaaaaaatagtggtggcaatatatattaaaatggacttgaaattggcgttgtcgcataaatcatgtaatgttaaataaatgatatcatgtttctaactagaatctgaattcgtagcacaactgcatataatagattcttgtagtattggttctgattacaaataataaataagaaatagataaatattttcccaacattcttaggattacaaatttagtagtacatagatctccacaatttccctagcatgtttagtactagttctcatcactgttgtcatcatcgttatcctcgatcacatcatcattgtcttcatcgtcttcaatgtcgatgtcatcgtctgcttctggtaggctattcacaatctcgtctatactttgcaattgctccggcatacttgacattattttttggtaaaattcttccttttccttgcggagcttgaaagctttagtaacaccctgaaccgctttgccaagattccacccagtgatctgtttcttcaaattgttgttgaacttgttgtccaaactagcgatctgaagacatgaggaaaatgttaaaaacttttgaactaccatgtggtttgaaccttacaagaaatgcaattgtatataaattgagaaatatgtagaattcacatgcatatgcatcatataacctgtctatatggccatctgggcaagtcattagccctgcagaggtttttgagtgcagttgtgccaatacttagaccaatatgagcagcacttttttgtgtgatgtggaagtaggattccaagtccttctttgtcattgtcttaactcgtttgcgctgttaaattaaaacatgttagcataagaaaagactaaaggaaaccatgatatgtacaatatttttccttgctaacacagtatacctgatcagggaaagtaaacttctttctcttgccaatagctgctggttggtcagtttgcacaaggagaagtggctcttctaccaaggaagaattactttccgttgcaggagctttgccatgttgatttttcttgggagcaggtggtaaaatggccagagatcttggcacatctcccccaggatgtcctctcggcacaccatatatgactacacacaaatgaaagcatcatcatatgttacatgcgattagtttgatagacaaacgttaatagccatagataatatttctaaagctggcagtttactgcaagcttattggtccctaattagttcccctctaattgtttgacacatatccctaaaccattggtgagtaaaaaaatctaaaaaagtccagccaactaataccattaggtgcaccatgttcacaataaatatcatttttttctcggtgatttttacttttgagagggccgtggtgatttctagatgaaacgtaatacgtgagtatacagtactacttgtaggttgcagatgtagttgatggagttcaccagcatggcccacagaaaagtagaaggcaacaaaaatatatggcctggtctaaaatataaacaatatagtgtgggttagaaatatatgagcactaatgatagatttgtgatttatattacctttggggtatttttctgcaagtgttaaaaatcatgtattatataattcaattcagtagacaattcaattatagttttacacaaacaaaggagccttaaacagtttggatgtggaaaatagtggaaaacagtttggatgtggaaactagtatattatgtcacgctttcgcgcgactatgacctatcacttaatttattaaatatattaaatgtatttacataccgtttacatatatagtaattagataaaaaatataataaaaattaacaatgtaaacatggaacatggctaaggaaagacggaaagtcaagaaaataaatttagcaggaagtatagttagaatgaaaattttattctctttattattacatgaaaaacacgtgtgagcacatatcactacactacacacccttaagataaacttaaagagatggtttcaattcaaaatgtactcgtatccgcatatgtgtagtattcatggtaccaagatttgaatcctggtagtaactagagtcatgcatcccaccgccacactaccggtgtttctttataaatatatttatttgatttttaaacaatattattatgacaaagaaaacatttaaggtaatttcatgcaaacttttcatttacattttaaagtaaaataaaaatcaattaaatttatatagttgctaaatatttgtcaagggaaagtgggggagggataaaatttgccatgcgcgcatgggaatcgaacccccaacgtcccattcacatgccatcctcgctaatcacatgtgccctcatgtgttttttataattatttgaaatttttgtataagttatttcattacaattgcactcaagttttggatggattttccatcaaaagttgtatagctggtcccttagttttattattatttttcatcgttttcatcactgccttcacaccatactctccactgcatgacccacttatcctccatttatattcctttggcgctcccattatataggacgtgcatgtacattttgcatgtaaaatttaagctgataattaagtttaccatcaccaaagaaataaaaggatgaattagggtcaatcaaattcagcttaggataactcattaaaataatttgtcatgtaggtgttcgtagttaattgccagatgcaaaactaattgcattaaatgaaaaaacaatcctaaactgtgcatatttgaggaatgcaccttgacccctttctacaataaaataattttaactgtttttaaatttattttttcatgtttatttacaataatacagatcaattacaatgtgcggcattgctgtgtgtaatatttgttatatcatactttaatttagcgctaaaatgtgtttttagttggaaaacgaatatttaggctgggactttcacaacaatggcctagtaaatatccaagaggatatgtggaagactcttgaagactcttgacttttcaccactcctttatagttttaccgggacttctctagatctaacgacaggtagtagccacgtactatatgttttgttgcatcctatgatccatatttttctgatgatgtggcctaacgaagttgcaatttaggtttcacttttcacgtatagagatacaaattatttcgggtttaattcaaaactagattctgcaaattgcgtggtgctaaattttaaaagaaatatatttgatatacaacacttcaattctatttacataaatacaattgtatttcctaaccaatagagttttaaaatatgattggatttcatatacaattgctagcctttgtttctatagctacaattttattttgtatctatgccattataatatagatccatcacgatctagggcgtcatcgtttggcatattcatatgcttatcagccaaaatttgaattttcaacgttaaatttggagctgattttggggttttttcatcgaagtttatttttcagcctttgcttttagatcgctaagaacatatatataaaagttttattcacaaattgattttcgtttgcaaatatgccatttggcatattcagaaaatatgccaaacgatgaggctgctaatggtgcaaatatttttatttcttagtgactaatgtgggaatttcttacatccaaaacaaacatgataactttttccgtgctatcttaataatataataatatgttgtaaaacaaattaacatgctccatttgaaacatgtctaatttttaattgtgccctacaaaatatttacggggctatgaagtgagcgcgccaacaatccaacatgcacatcaatttcctagtatgattttatggagaaagagagatataccattctggtcggagtcgtagaggactcctgtagtatccattcggaatgaagtgtaccagtcgttaagcatttcagcttgcgactctggggtttctcctgacacactgcagaagaggcaggcatatacatgagttagcgatcgatctcagctgaacatatatgtttgtgaaaatgagtgctgaaaggggaagttgatgtgtactcgatgccaggttgattgcacggaagcctcgccttcgggagagacgttctgcaccaggacgtgatccggcttcccgtcctcgccggcgtgcaggacgacgactgccttccggtgatctgctcaacagcgaccaaggtggattagcacttcgcacgtacaacgtacgttgatcgaacatggataagaagcaaaaggtaagcaagaccaggaacaaggatcgattcaacaaacatgcatggcgagcgagatggatttatctcacttcgcacgtacaccatgagaaggattagaagcaaaagggcaagccggaccaagatccaaaggatcgatcgattcaagaaacatggcgagggagatagatcgatttcgtcgcgtattggctatatagggatcgacgacgtcgatcgaacttaccgttgacatggatcagcacgcgtagctgcctgcatctcttcctcaggcactcgatggatcccacgggaaccatcgggagcttgccggatccggcgccgccgccggcagcaccaccgttcgggacgttggacgacaacgacgatccgccggttgccatcgtcgatctcagcgtggtgagggccggagagagaacgaacaaagctaggggaatgatcgatctgagagcgcggacggacgactggccttgtgtgtgtggtggctgtgtggaggaatttggggaggatagacacgccggccgaggggcttaaatagctggggggggggggggggggattaagcgggtgtgcgcggcggggtcgtgtgaacgcgtcccgctcaggcagccgtccgctcggcccgcaggtgtgtcggcgcgtccccaaatttttcatcgagcgcgcgaccggcacccgttcgaacgacgccgcaacaaaggctacgtacgtcgattgcccgttcgttgggccagaaaatacaccaggtgccatggacttgtcagcccaaaaagaattctcgactcttttgggtgctgcgaacagaaggccctgggttactaattggcccacgccgagacacacggtctgacatcgatcagtatcgatcagtatgcggcctaagggctaaggccatttccgatgggatttcattttgtagttttcaaaagtaccctataatctaataaagagatgtttaggttaatgaataatacaagtatcttcaatgcacaattttcgtttcatggtttcatatgctattaatagcaattaatgattgaatgatgttatgaatctaatttgatcacagtggggttccatttccgttgcaagggcatatgatgaaatgataatggcgacgaagcttggcaacaataacatctacagtttctctctagggacgtgggtgttgccagtgcaggttttggcgtttcaggggctttggctgatgtctaaagtgtgagcttggtgttgctttgctcgttttggcagtgcctccaataatgtcgtgattgccgtagagttggagctgctgggtcgctaggtggcaagctcggcaacgatgacacgtgccttgtgatgtcaacgttgtgtgccgcttcttcagcatcttgacgtcgatgttcgccgttggattccgccattttttctttttttttttagcttgtctagatatttactcccgcttaatgaaatataattggcagttctcctgccggtttagtttcaaaaaataatatgatggaatgattcagtctcagtgagttttattctttttttcaaggcataggcaagtgtgtaaactaagttttatcaaaactaaacttattccttctctcttaataaatttactgatatgctattagtttaccctatacaacatatcatttaatgagattgaaattcttattaaactcactgggaatggtctaaccagttatgccactgtcttccatagaccacaccctagtggacggggagaggagacctaaccatcaaaacggcacgcgctgtagatgaggaaaatatgtggttgaaaccgcacgtgcagtgaaaatcaacaaactattataaaataaaaactcgacgtatgatatttattcctatcatcatgtgtaaaatttttactcgtgattaaatttaaatataaaagttatttacaatgacgtatacaaatattagagtactggttttcaccaagtattttcatctgtacgagcgtccattgaggcacgtttgttctctcgacgcatgtgtactgtggtggcgccccggcgtacgtgaaagcgtcacgcgacccaccccaccggaccaccactccatctaggggtgaaaacggatcggattcggacggatagcagtcatgccatatcctataccatattttttaatcggattcagaggcggtgcggataatgtgcagatgcggatgcggagcggattatttcggatgtcggaaatggtgcagagtcggtgcggactcgggtcggaaacggatgaaaataatcggatgtgacatgtatatacaatcgatacaacatctgattatctgtacaatgagcaacaatgagataccaatatcacaattcacatgatcacatcataatataatgtcaagttgttaacgattgacttgtcttctgtccaaaagcatctaatcgacacatatagtattgacatcacgatggcaggaggcgtcgccggcaccgagacggagacaaccaggtgaccagcacaggaggtggcagcggtggcggcgacgcctccgcctctggggtggagacggtaggccgcggcgccggggtggagaaggaaggtggcggcggcggcggcggtggcgccgggctggagacggtagggcgcacgctgggtggagaagtcaggcggcggcgtaggaggactataagaagagaagtctcgatgaaaaaaattgacacgacgtcgacggagtcacggactgaactcctggatagattgatggataaggtggacctgaatgggctgaatctttgcacgatgaaaatgcacatgccaaatgggccaaattgagtggttatatgggttaaattgagtggttatatgggttatgaaattcggattatccgccaaaatgtttatcggataatccgcttaaaatagtggataatccgtatccgccagatattaccgataccatatccgcatccgcatccgcatctggccggatatctaaaaacccttaccatatcctcacttcggacggatttggagcggatcggatcggataatatccgcttcgttttcacccctagctccatccgcgcgctccgatccgcacacgcgctcgctcgctggcttccgcttaatttgggtgccccctccgcgtcgatctgcctctccagccgccggccgtacgtacgcctgcaaccgccgtgacgaacgaactgccgaccgagcgatcgatcgatgcgcgtgtctcgtcgcagttatagcggctgctgtcccatccaatcttgccgctggggagctcgccatttatttctcccgccttccgtgtgttcagtccaaagctagctaacgactgactgaggctgtgtttgtaaccccatgttcccgacctctcttcatcgttttccgtatacacgtttttcaaactactaaacgttgtgttttttttaaaaagtttctatataaaagttgcttaaaataatcaaattaatccattttttttaaaaaaatagctaatacttaattaatcacatgctaatggtccgttccgttttgcgtgattactgttacggatgggaacatgcatgcccgaacacaccctgaatgaacaaatcatccatggatttcacttgaaaactgtttcatttcatttcgatttttcggtacctagaatctatactcttaaaatcggtacctaagagccttttattttattttggatagcataatacctaccggatgacgtgttagaatatatctgattttggaacttcttttttgttaaacctttttaaaggaagctaggggtttatcccattacctcatggctttatttttagatactaaacttactggatttgtgtagtgtcttatgcaaagacgcggagatataaatcatttttattatcttaaaaaaaattcaattcttaggtggtgcatgcatgatatagttttggacgacataccacgagcagcagctagtcgtcgagcacgattagctagctatgcatcatccacatgcatcaatctaccgaaacgctagctacgaacgttttctgtcagtgtactgtacacctttttggcgcggtgcattttcagaggtttctgcatatgctggatcgtgtcttcttttctctgacgctcgcaaggttaccagaaaatgaggtgcgtgcgatcgattcaggtaggtgtaaccaacgcaatgcacaccgcgcggactacagcattgtccctttcgcgcgcggccatcctgtccagatcatatgctccagcctccagcacacagatcagccgtccctgtcgccgctagatcatcgatgattacctctactaccacttcgaatcttcctctacatctgcatgcaaaaatatatgcaataatcagtatctcacacatacaatgatacaaagtgaaatacagatattaatgagaggtaactatgttcatttatatatagtcctgggcattcgtatagctagctagagcaattaatgatcgagctgaaactttatcccaattcaagagggaatatccagctaagctagcaatgcatattcagcactgatcgaactaatcagtgctgcaactgtgttgctcaatcgttgcgctctctttaaaaattgcaggcacagctgcgttgccaaggcatgcatgggcacgatcggacatggaactgttctctgcccatatcgatcggtgctaaggccgagatcgatccggcctccatcttaaacaaggacacattcggtgatccctgtgtcgtacatttccctggcacgccgtactgtacagcttgatcaagattattccatctctgatagtctgatgagatgatgatcgtgatagaataattgggctaggcccaacttataatattaaatctcaaaggcccataataagtattgaggataataataccacctcaggatttaagcgaggaatatctcaacctaaatagggagttattggaggctccctgttgaccagttgaggtgggggtcggaatgccacacacgcgcgcgcgccgggccgagggcgtgggcgtggctggcggcgtgcgtcacgtcactatccttttgcagccactaacccacgttcccacgattccctccacaacagcgcgtccacgttctttctcctgatagataaggaggccgcgagtccgatccggtttcatcgcttctttcccggtgttagtttctccttctccgcgcctaagttgctctcgcttcctcgcttcttatctcttgcgcgcacgagagattggaaggagcagtgcctccgaaaccacaccttcgcctgagatctgcaccgggtaggcgggtgatcaggtttttggggagtgcctcccgcacgactgctcatcaccatgtctggagttgccgccgccgctgctggaggagatggcggaggtggtgcgccgccgacaggagccggagctggtgcgccaggaggtgccgtgaacgacaacaacaacggaggcaattctgcctcaccatccagcggagagccattctcggggtataatcttctcctcctgttcctgttgttagcgctatttctgttcccattgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaacatttttggattaaaatatgccgattaattactatatttccaacattccaaaaacctgataggacattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagttgtatgtcatggagcagttctatgactataaaatggtcgatgaccgttctgtagtagaacaagctcatgagattcagatgctggctaaggaacttgagaacaacaactgtgaattgccggacaagtttgtggcgggtggcattattgccaaactaccaccttcttggtcggactttgccacttctctaaagcacaagagacaagagttcagtgtttctgatctcattggctctttgggtgttgaggagaaggcgagggcaaaagacgtccggggcaaaaaggttgagggaggttctagtgccaatatggtacagaagaagaaccctcatgcatcccacaacaacaagaaagtcaagcttgatgtcaaacccaaggctgcaaccaattttaagaagaaaggcaagggaaaggcaaagggagactgctttgtgtgtggcaagtctgagcattgggccaaggactgtccagagcgcaaagacaggaagtctgccaacatggtcattagcgagggcggaggaacatcggggtatggtaaaatattacctacagttctctctgtttttcattcacctgattggtgggtggacactggtgctaatattcatgtatgtgctgacatttctctattttcttcttatcaggtcgggagaggttcctccttgttgatgggaaatgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcacgactctgtcatatgaatttcggttgtatgacgcgcttagctaacatgagtttaattccaaaattcactttggtcaaaggttccaagtgccatacttgcgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcaaagagtttggaattattcatgagaggacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagtataaggaagtaacaccattcgaggaatgggaaaggaagaaattaaatctctcatacctacgaacatggggctgtttggccaaggtaaatatacctatagccaaaaagcggaaacttggaccaaatactgttgattgtgtgtcccttggttatgctatccacagtgtgggttatagattcttaatagtaaactctggagtacccgacatgcatgttggtacaattcttgagtccagagatgctacattctttgagaatgaatttcctatgaaacatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacactccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccaattgctcgcttgaccacgattcgagtactacttgctctggcagcctctcatggtcttctcgtccatcagatggacgttaagacagctttcttaaacggagagctggaggaggagatctatatggatcaaccagacgggtatgtactagaatgtcaggagggaatggtgtgtaaactgttgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatattgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaacccgaagaatagcaagggatcaactgagatactctcaaatcattggttcattgatgtacttggctagcacaacgaggcctgacatctcatttgttgtaagcaagctgagccggtttgtctcaaatctgggagatgatcattggcaggctctagaaagagtaatgcgctatctaaagggcactatgagctatggaattcattataccgggtatccaaaagtactagaagggtatagtgactcaaactggatatctgatgctgatgagataaaagccacaagtggatatgtgttcacactttgaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgaacagttcaaaggacaacatgaagtcatctagacacatcaagagaagactgaaatctgtcagaaagcagaaaaacttcggagtgatagcattggactatgtccaaacggctagaaatctggcagatcagtttaccaaggggctaccacataatgtgatagacagtgcatcgagggaaatgggcttgatacccacctaaggttgcataatagtggaaacctgtccattgtgatcggagatcccgtgaatttcgatggtgaaacaaactatcgtgtgactgaaagaagagacccttgaaaagggctcattttcatgatgtgcttctcttcttttctgcatggtaggatggcttatgccttaatgtgatccgagtggcttttccaagcagagatgttgacctgcagaacatctcagaaggaacacacctatatgagtttgactgctagtcacagtctatgaggtttgggcgatctcaagatactcatgaaagacctggagtttgacttatatgctccaaacagaagggatgcgaacggcagcccagtaccagtcaaggttctgagtgaaacttgatcacacaaaactgacaattcaaggcatagtccattgttcagttgtgggctaatgtagctatttcctaggtggaagttcaacttaacagtctccaccaaaaccctggtatatcaaacaggcacaacattgagaacatttcttatgagccttaaaatttggtggggattgttagaataattgagctaggcccaacttataatattaaatctcaaaggcccataataagtgttgaggataataatactacctcaggatttaagcgaggaatatctcaacctaaatagggagttattggaggctccctgttgaccagttgaggtgggggtcggaatgccacgcgcgcgcgcgcgcgccgggccaggccaaggctgagggcgtgggcgtgggcgtggcgaggcgtggctgactggctggcggcgtgcgtgcgtcacgtcgctatccttttgcagccactaacccacgttcccacgattccctccgcaacagcgtgtccacgttctttctcctgatagataaggaggccgcgagtccgatccggtttcatcgcttctttcccggtgttagtttctccttctccgcgcctaagttgctctcgcttcctcgcttctgatctcttgcgcgcacgagagattggaaggagcagtgcctccgaaaccacaccttcgcctgagatctgcaccgggtaggcgggtgatcaggttcttggggagtgcctcccgcacgactgctcatcgccatgtctggagttgccgccgccgctgctggaggagatggcggaggtggtgcgccgccgacaggagccggagctggtgcgccaggaggagccggagctggtgcgccaggaggtgccgtgaacgacaacaacaacggaggcaccatccagcggagggccattctcggggtataatcttctcctcctgttcctgttgttagcgctattcctgttcccattgttagcgctatcgctatactatgtgcgctatgttcttgttcctgttcttcatgatgcctctagcatgttattgcgttactgttatgttcctgttcctgacattcatgatgcgcataatatgctactggttatgttaagatcactctacactgcttatgccatgattattgctttaacattttggattaaaatatgccgattaattactatatttccaacggaacggtgtcagtggtgtttaggataaggtcgagatacatatatgtgcctgcagcttcggcgaaactgatttgcaagtattatatacatgcagatctatttatacttcgtatcactgacaaatttttgtagtactacctgctataatgtaagccatatgattagctagtgtggggtactactttagcatcaggccggcaatggactgatcgatgctaacgaaggcttagtgacaaagcatgccctgtcccagacaacctgctaacaagtacttgctgtactttaatttcaccactatttgtgtactctgtggttttccctgctaatagtcataaattcataatggcatttttttttattctgtcttcagatgacccaccatcatcatcaccatcctctcgatggtgatctgttgatcgattgtatatatacaaaatcctagtgcttcagatagaagctaagcacatctatgatctatccaaagaggcacacacatagttcaaaaagcccatgaaaagaatgcaagaaaagaggtgtacatggtcatggagaaggaatattggtcggtggagccttatctagctagtgatgcattagccaattggggatatcaccgcggttggtagcgagcatcctcatatacattaagcctagctaaccatgcacagaagtttggtgcttattaatttgtttgtttggtgaacaatgtattcgatttggcccagctaggttgacacatgtaggactatgttgtggcgacgtcctactatctcacttctcaccagagcaaactatccagttcagtggttgaggattttgaaatgatcgataaatcttttttcaacttgtgcagttgtgctatggactaaaatccccccttccttaaagcatgagagctatggcacgtggatattgtggtttgagaggataaatttccggttttagagtttggggtgctagctaggacgttggtttaaagcacgggtggatccgaggcctgacgaccaaggtttattagcgggtaacatcacagtaatagcttctatatttccaatgtttaattaactacataaatacttgtccatatgctctagaaaatttctgaacccgctctggttcaaacttttgtagggttttaatagaagcatttaaatttttgtaatttttatgtaccttttaagcgagttggaataaatgcttcttgtaggcagaggtaattcagaattgatagccaaaatgacctaacggtaagaacctttttggtcaacactaattgtgcatgaaaaccaattgggagtttccttcgctgcttctgaacaacaattgaacagggttgcaactggcaagacatttctgaagatcacaaaaacaaaatgcacagctttccaaccaatcttccaaggatttctgaactagtacaaagtacatagaaaaaaaaattagctaacacatggtcctttgcagtttgcaccaatttgctcactgtatgctacacttgcacgggatgacgggagtattatattcgttcagacattgttagtgcgttaccttttgccctccgatcatatgatacactgattttattgtactttgaatatattattatacacaaattttaattagtacaaacataatacaaccggatgagatgatacacaaggaatgcagatagataattcacattttttgcagaaattttatggtttttttgcaacttttttttcttttttggcttgaagttgccactgtttatgaactagcaagctgctctctgcgcaatataatggcgcggttggtcgcgaggctcgtcgtgccgtacaccggcagctcgtcgccgtcggcgccgcggaggctctccagctcgaagagatcggagctcgcgtcgctgccgtcctcgtcctcctccacatcggcgaggctccgcaccagctcctccaccctgcgccgcaccaccgacgtctcggcgccggggcagaagcgtacggacctccgctccgacgccttggtgttcgacgtcgtcgtcgccgccgccgacatgcacggtggctgcggaaccggcggcgatgccggcggcagagggacggccgttggagccttgggctttcttgggaggcgcgacgaggagaacagcgccttgacgacgcacgcgaacgtggccggcgacgggccggatgacgacggcggtggcggcggcactgtgcctcttggccgcagccttgctccagggaaacacggccggctcttcttcttcttcttcttcggtttgctgttcggtggcgcggcagcggcggcggcggcggcggcgtcgacgtcctccggctgctgcggcggaggctggctgtggcgtctccggtgcgtggtcgactccgtgtcggtggtcgacgcggacgagcaggtgaagctgctgtagctggacgacgacgcgtccgacgacgaggcggtggacgacgcgtaccccgagtgccgcgggcgagccaccgactcgcgacggctcctgcccgcggcgcccgccgcctgcttcgacttggcccaccagaactgcggcggcacggctgccgctgccgctgccttcatctcctccgcctccgaccgccgcgcgtcatcgacgacagcacccgcgccatcgccaccccctccctcgtccagagaacggtagatcgcgtcgagcagcgacgccgagaacgacccgcccgcgccgccgcgcgccctccgcggcggcgccagcgttggcggcgcgttcttgccgtggcattgccgccgctccataccaaacaaagtaacaaaaaccacccaaatctcagcaaaatatcaccaaatggcgcgcgcgacaaagggatcaggcaagaaattctatatacgccgaggagatcaagacgtgcgcggaggtggaggattatataaacacaagctgcaggggggagtggagcggtggtggcagctgcagctgcatgcgttggcatgtgcacttccgtcccgtggatctcactcgttcgtcaccaacctgccgcgaattattggcagtgagtggcttgctattatcacttgagagaagttgtgagatcgcgtcgttttcttggtgaaagatgcaattgacggacgagcttgactagaactctgtacctggattctgtcagactgtcagggtctcaagagaacttccaaaaccagttaaggcctgatttagtttctaactttttcttcaaacttctagctttttcatcacatcaaaatttttctacacacacaaacttctaacttttccatcatatcgtttcaatttcaatcaaactttcaatttttacctgaactaaacacacccttaaacttatggaatgggaccaggagtgaacagtgacgtggcccattccggcggccccctgaccagctcagcttgcccatgtccttcactgacaaattttgtagggccccgcggtctaaggccatttctaaatggagagtcttcagtgaataatttcatttcgcggtttcatagattagtcatggcatttgagttgagcttttctatggcacggaaaatgtgacaggtaattaggacaaacttaaacaatgaatttatttgaacttctaaaagaattttttatataaaaagatttaaaaacacgcatcatttaacattttgaaagcgtgttaacggacaatgaataagttgtaggttggagttgaagaaaagaacattcccctaatagcgatgcatgggattagatatggttggatgaaatgaaatattctagcccccaatgctagttttaaccaatttcatagttctgtaaattgtgtacacccagtttcatctagatgaaacttttccctccctttctttataattatattgccatgtcactatatttgcttacatggcatttcatttattgagaatggcttaaggctatgtttgggaggagaagttgcgaacttgtccccatgtagaaaacgagatagctcaagcatatgattaattaagtatcagctaaaaacatgagaaatggattaatataatttattctaaacgcaacttttctctagattttttttaaaaaatagaaaacacatcgtttatcagttcagtgaaggtgagtgtgaaaatttgggagaagaatatgggaaagtcagctaattaacacgttctaaagttgcaggagtctgtttgtcctgtcatggtagccgagaacgctaatcggcgaccagtcgcgcgccccctcccccgcgcaactggacgcgtgtcgcggaggtggcgcgggcggtgcggtttttattttttccgaacgatttttctttcttttttttttggacggttttctttctttttgttttttctgtttttttttctttctgtatctttgccgtgcggttttttttgttacgcacgtttctttttctgtttttatttctttccatatttttttagttttttcggttttttaatatgtacatatacaaactttgtatatacgtatacaaactttgtatacgtgtattttctgggttttatacctgcgcataccaattttgtatacacgtatacaaattttgtatacacatatataaagtttgtatacgtgtattttttgggctttttttacatacgtatatcaattttatatacacgtatacaaagtttgtatacgtgtattttttagctctttattcatatgcacacaacttttatatacattntatatacatgtgtatatttttaatacattaaaggttcatgcatataaagaattatatatatatatatatatatatatatatatatatatatatatatatatgaaaataatatgctactacctggagtagctactccctccctatgcgccctcaattcgatcgctactaatgccaatgactgttaccgggtctaatgaatcgaatactcccgcccgtttttatttttctcggtggtcaacagaaggtcgtttatcttctacagtagatccaaaaattgaacgaagcctcccgagtttgttgtaaatatgaaatttgaaacttgtgtttgtttatccaaagcgagaaagcaggatatttcttgcgtcgttaaggaagagcagaacattatcgatctaaaattgttctctgcatttggagggttcataacccaactgaagtcagatttgtagcctcgccggcggctgtgttacagataacggtgaaagccctggcatggaggattccagttccaaggtttgctatcatattcatctgttattttttcatcttttggattcttttcctgatctcgattcctttcttgatcgtttctgctcctaattcgctttctttatgttttgcatttgcagcaactttgtagtcctgcagcaggtgcaaatgtatcaggtggtggtggctctagttctgttttcatcagaaactatcatgctggtgtaaatgtaattaggcggtaagaaattaagaagtcatgttctgctcccagttctgctgccgtacgccatgttctgctacatctctaccaaatctgcaacatgttctgctcctcagaaatcagatagcagatcatgctctgctccaaatcagtgcatgtccatctctaaacccaaaaaaagaagtgaagttctgctcctagttctgccgtgtgccatgatctgctacatctctaaacccaaatacaagcacaagcagaaactacgatccatgttctgctacaagcgcagaagaagcaggaatgttctgctctcgtttctgcacgggccttgctctaatagtagattaaatcgtttgaaggaccagaagctattctattacatatccatagtttaaggaacgggagattagcttctgctgcatgcgcatgcatacttctctgatgcagattagtttctgccattttttttagttgatgctctgccaattttttctgttggctctaataaatatcttctgctggctagtagcagaaaatcaatttgaaaagagcagatcatcaacaatttcatgtgccgccaaacagctgatgttctgcttcctttcaaacagaatttctgctcgatcttctgctctctttccagttctattctgctcctaattggatgagcagaatatcttctgtccgcttaaattttttttcacgtgagcagaatatcttctgtcagcgtatttcattttcatgttctgctcctttcccgattcacattatgttctgccaacgatattttcaaaacagttatgttctgccatttttttagctgacgttctaccggtttttaaaattggtttgcatgcaaccgatgatttagaaattatttgaactaactacatgctaatattttgtgcaaatattattggattatgggttattccactaacccgatccaataagcggagggagtaactactcccggtagcagcaaataggtgtcccccctctctctctctatatatatatatgtatgtatgtatgtatgtatatgtatatgtatatgtatacacgcatatatatattgtctatactacgtataaactttgtatacgtatatacaaacgtaaaatctatttggagaggcctctcgttttttccttaaccagcgacgccagaacatggggagaaatctactatagtgtactacatgcatgctttttttttgagaagtctattacatcacatgtatgttattttcttcttcaaacaaagttttctctcaaattacttatccgatctataatccgattacatcattgtgttcgttacaattaaatcttcacaacaagatcttacatgattatattacgatgaaaaaatatttatatttgtagattacttttattatatatgtaagttacttttatcatatatataagtttaaattactttttagatatataaaagtaaattcaatagagtctaaaagtaattaacatatattataaaactatcttaaaacaaaacggaagtaattttatcacgacattataagtaaattcgttgtagagataaaaatatgactttatctagaaataaaatttaatcagcatatatcaacacacgtaagtttaacaatttttaaaagtaacttcaatgttaattgaaagtaacttttgaatggttaaaaataactctctataaatttgtttaatcatcgattgtttttttccttttattttagctgtgtagtcacgtccaatgaaaaaaggcattcattaaagttactttctttttttataagttatttctataatatatgtaaattacttttagactttattgaatttactttcatatgtctaggaagtaatttagtgaaatctaaaagtaatttagatatattataaaagtaatttataatttttcatcaaaatataatcttgtgggatcttgttataaagatttaattgttacgaatacaacggtataatcggatcatagatcggatgagtagtttaagagaaaatggtatttgaagtatacgtggatagtgtctctaacagatggagtgatagctggtttatacaaatcagctaccactagttgtatagtcacgtccatatataaagtttgtacgtatgtgtagatagtatatacatgtatatatacatatagtagtatagactagaggatatagtagtatatatacactagtatatactagaggggggcaactgatcgcgcgccgcgcgactggtcgctcatcagcgcccccaacatggcagcccgtttgctaaaaaggaaggctgagttgtaaggtggctaatgggcctatggtacaatactggcccgtcttgaaggcccatgttgactcgtccagtccagtccatccaagtctatgcaactggcaggccggccggccagccacgagcccacgctgtctccaaaattttcagctgagctgcatcagatgcatcgctgttctttgtctgcatgttgctaattgtcactttgttactgcaaaatttcactacaagtgaacacaaacttctgttctgttctgaattctgatctagtgatctcttgtattatccgcaatagataccaagaatccacatcaacagcgcgaggctttgatcaagctgcgctctctctgcactccgggcgtcgtcatgggcagctcgccgacgaacaccggccgcacgccgcacgggctcgggctccgcggccgcctcgccggcctcttctcctcgccgtcaccctgccaccatcagcactccgacgaggtagccagccagacatgcatccaatgaaatcctgattaatcgacgagatgatgtatgtagcttgcggatgtttgatcgtgtgctgcaatggcgaaggtggtggcgaagctgaaggaggaggtggagaagcagcgagatctcaaggagacttacatggctcggctggagagcacccaggcgtatctcaggttctgcctcgaggtcgcccaggtgcacgacttcttgcacctcgtgtccaactccaatggcggcgacgacgagccgcaccgcgacgccggagatcaagagccggcaacagccgccgccgccgacgacgacgacgaagatgctgctgaagcaccgccctgtgacccctacttcgccgccaccagagacctcgccgtgcagcacggctggtccgtcgctcccgacgaggtgcgttcgcgtgaaacatttgtccatcgatcacagcaaagcttgatctcctgtccatggactcagatcgagctgcacgagatgatcgggcgagggtcaacggcggatgtgtacagggcgacgtggagggggctcgacgtggcggtgaagtggatgcgcgccgagttcttcgccgccgccgaccagcgcagccgcggcgaggccttcttcgcgcaggagctcgacgcgctgtcgcggcagcggcacccgcacgtgctgcggctgatggccgcgtgcctgcgcccgccggcgagctgcttcctcgtgacggagctgctgaccggcgcgacgctggcgcagtggctccacggtggggacggtggcggcagaagcagggagaggcggcggcagccgtcctcgccgccgccgccgccgccgctggtggacagggtgagccgggcgctggagatcgcgctggcgatgcgctacctccacgagcagacgccggcggtcgtgcaccgcgacctgaagccgagcaacgttctcctcgacggcgactcgcgcgtgcgcgtcgccgacttcggccatgccaggttcttgccggacggcacggcggcgctcaccggcgagacgggtacaacaccgatcttgccccgtgcatgttcatcatactaattacacttcaaccaaaaaatttacagtcgctgaattaactaatttgttttgaattttgataaatcactgatcagttttacattctagggacttatgtttatatggctcctgaaatcattcgctgtgaaccatacactgagaaatgcgacgtgtacagcttcggcatcatactaaatgaactagtaaccggggagcatccatacatagatacaggttacgggcctagtaaggtaaaatcttcattatgctaatctgctccttcaggtaaacaataatcggttctgttcttggctgacacaatgttgtgtttttgtagattgctttggaagtagcagatggaaaattaaggcccaaacttgcagaaagagacgtaaattctagcgtcctgaatgatctcatttgtggaacgtgggatgcagagccttcgaaaaggccttcatttgccactataacttctgcactccggaaaatcaagcagcaacttatgtaacacaaatggcaaaactagcatctttatttattggggcattggttattatttcacgagaaaaaaactgaaaggaatgtgatgtataatattactagtctactgctgctgctcttgctctgaacttttttttctctctgatggttgcatcacttgcactgctctgagtttctgatttatgataggacatgacacactacctctacatgttgaatacctcttctgtcccaaaaaaatttcaatcctaactatgaatctgaacacaagctagagtttgtctttttttagacaaagtagtatagttttactgcagttactttcaaacttgttatccacatctccaacttatgtccaagctaatgccacgtaagcgccacgtaggataaagactcggctaagatcgccatgtagacgccatgttagccaaaactaccaaggaacattgtttgcaccagttttgatggttggaggagtcgatatacccggtttttatggttggaggacatgaatcatacttgggtgatagttgaaggagtcaaaagtatacttttttccttttgctggagggaccagcacctcgaagcccaacagaataatggagagtgggccaaattcatctatcgcaaacgggccttcttgtgggctttaagcccatgcgcgtagatgtagtagcgtccgtacaagtctttgtactacgggtccagccctcaaagacccccttccccgacgccgactccgccgccgccgtcgccgcgccgcctcgccgccatgcccgccgtcaagtggtactcaactctcacctctctctctctctcttccgcgccgccgcggccagccaggccaccccccctaatcgatcgatggtttcccctcggcgcaggctgatgcactggcacccgaaccagggggcgacgctgaacagccagatcctggcggaggcgtgcgcctgcgcggagtccctggggggatccaaggacgggaggtggaagacctccatcatcttctaccgcgcgatggcgcgggacggcgcgtccgccgccgccgcggggggcgggggccccccgcagcagcaccccgacgtgccccgggagctcctcggcgtcgcgctgcacgagcgcccggggctctacttttccatcctccgcgcgcaccggctcgtcctccaggccgactccgcgtttccccaggtcatggagaagctccagtcctacaaggcccgcgtcaccctcaacttcgaggtcagattgctttccttccttttacctttctgatttgttatttgacgcccatgtttaggtctttttaggttggtaataacatgaggattctaagctgaacatgcaaaatactgctttgctcctagtagctactgaattgaatatggtgttgtcttctgattgagtattgaacttatttttgcttgtattgaacttatgtttgattaaataaatttcattacttatctgagaatcttaagacacggtactaccatgagtatgttgtcacacgagaaattaagattgttgtctgggggcaactgatgctgaattgcttatcagttggatcaagataaattaagattgtattactgtaaaataagatctcatagttccttgaaatgttagttagaagtttacaacagaaaactgtctcaagaaacacaatgaattgtgcttaatttggttaacaagtttttccgttacaaatggggttcaagacttcaagggagacataagttacatggattgtaagaaaataattacaccttagtgaaaaatggaactgtagaatcagtatctcttaactcttatcctttcatacttttctcaaaagaaagagtagttcacaaaggagagaaccaggtgtgtggtactaattcatcatatgatttctcacacaaatagttaaccagcattgattgatgccaatgtaaatgtttatacaaatgaatttgattaagagctactaataatgctccattatctaaaaaaaaagtaataacactccaggtgagaagtacgtccaaaagagaaaagggctaaatgaaaaaagacgagacatgagatgacaaaaggtaaatagaaattatccaaagatctctttgcttatttaccatcacaccgtaggttttagatgcaggtgtggttgattttttttaaaaatctcttgctcaacttgcgcattgcggtgcgtggagcttcgtgaggcttctgctggaagtctttctctctctttttttgggggactgctaaaagtctcttgaagccaggttctggtttaaattctttgctgggtctttgactagaagggtgcgtaaatccaacagtttatactgcctgtcgtagcattggatggtgcttaatttatggcttacgtggctcaatcaagatttgagaaagattgattctttcactactttagataagcctttagtgatttaaattatggatgattcaaaaactgttcctcaagtctggtgaggttgcaagaaaccttctccaccacttcttttttttataataattttcttttatgattcaaccacttgccattagggcttctaatctcaagagtgggtgatcaacaaaaatgtttgaaaaatgatcatatatctcacatcgaagctactcgattattttgtttttatgttggcccttcattttttttctagataccttacaagttctatctggtgctttaatcttggtagtgtttattctaccacggtgcgagtgttcattgtctcatatgcaagttcagtttattggatccacttgctattaaactagatgctttcatctgcagggatttcagtatcaactgggtgacttttgcctgaggattggaaaatgtgttcctaataattcggaaacactgaggggaatcatgatggaggtgacattccttttcattttcttttatttgttacacttagcctgctggcctttaaacctatgatatattgtttgctcttttttagtataatatgatagtcaaaccaaatgcagggaagcaacagtataaaatttaggtttgagtaagtattgtcacagattaacagggctttgttgcttagactttcaattcgattcttgatgttctggctcatactagccctcgattactactagtattcaacatcagtattggtagggatattaaatgaatcatgcagtaagtgtgttgagcttgacaaaattatcagacgtgcatgctgacctttgattgtctctccattagtttgcaagcaaactttgcaacttactgtttgtgtcttgctgctaaggaactactaagtagttcttcacagctttaaacttagaagattcttgttgtcatttctgggatatttatgaaagtcggtgcattatttggacttgaacactaaatcgtaagcatataaaaggtctgtacttttgtgcatgtagttctcacttgaattgttaatcgtaagagagagtgaaacttgataggttctcctgcattcatttggctccaattgttgtacttatgagtaatccttattttgcttttgttactcaatattgctagcaagtttggcatgatttttttttttatttttgctttttgtgcaggtagagtattatcccctatcttccattgaaaaatccagggcagtaatggaagacttctttgacatatggcaggaaacagttgctaagaagtcattacctggtcatttcatccacgtagaatctaacttttcagagtatggtctttcagatcactattctttccagcacactgccgttcagtacgcaacttgtttgcaacaacttatggctgccgtgaggccccaatgacatccacaaggtgtgtctcatgcggtgaaatgttattggtcttcaaggactgaggtagtgataattctgaacaattgagtagctatgacctgtattatcacgagttcttattgtcagtagatccttaattttgtcgatgtggactaactcaccaaactaggcatggtaagcaaatattgctaccctaacagcaatggtgtggcaagtttatttagcgccactgttcgtagcatgattttacaacttgcaacatggttgaagaaggcgctactccctccgtctcataaaaaacaaatggatgacatatcctagtactatgaatctagataaatgtatgtccagatttatagtaatgtgtcatatcg

SEQ ID NO: 32846 - DNA, 2021 bp, Oryza sativa
acttttcgttttttatttttggcggaattattttaattaaaacaggggccaacctttttaaaaaaatagtgaatatcccttatattaggggacagaggtagtactagaactagtggataccccacagcttgatgtgggatttgaaaaatccttcaaaagcacttaaaaacaacattaaattaaaggccagacaataaaaaaaatacaaactgcatgttaagttactaaaatgcctgaccgcagaacatgaacagagcaaaaaccgaaaaataaaagccatgctatagttaatggtcctagtgaaaaaaaaaacacttctcccgtaaaaaaaaccaacctcgtactccaacgaatctggatactctctatgtccagattcgtcatactaaagttggtttttgctatacatcactagcatgtttttttccaaattgcactcaaatttctagcctttggatggacgtcaagattcgtgctatgttatcgggcccacagtcctttgtcaggataggatccgttttgttttggcccgtttccatccgaacccgatccacatgcatgtttttttttaacttccacaactccaatggctccaggcaacatcgttgaggagaggaggtgaatctggcgacgagcggcaagcgcaacgccttcaccgacgggaggagctaggacagctcgcgcagcaagtccacgagtaggatgccttcaccgtgacttgttattttaatatgtagatcttgtatgtctctacacccttcctaaggaggaaggtatgacataacaaggtgaggggggctaggacccggtcaggtcctgggctcctccctaacttgttattttaagatgtagatcttatatgtctctacacccctcccaatgggggatgtatgacctaacaaggtgagggggccctgggacctggcctaggtcaggtcctgggctcctccctatcttgttattttaagatgtagatcttatatgtctctaaacccctcccaaggagggaggtatgacataacaaggtgaggagggccctaggacccggcctagatcaggtcccgggctcctccctgacttgtaattttaagatgtaaatcttatatatgaattttgtatgtttcgacactcctcttgaaagaggggtgtgctacatagaagggcttaggggacttcgggacccgacacggggtaactctcgagcccccttccttgccacgtggatatttttaatcgctgctaatcaatgtgttttctttatataatgagaatataacctcgggtcctcggggaaaggggtaccctggttcccatttcaccgacagcaacggaaccaacggactaacacccaacaccatagacgacggcagggaaccatgatgaaaccctaattttcacttctcttcaacttcaccttcagggtggaggaactatatatatagagcaaggatgagtacttacgtactcaacacgtcatgggaacataggtgttgagtgaaagcatgaaagagaggcaagattgttttgcaaattctttatttggaaccattttgaaaccactaagtggttttcttctttttaagtttaggtcgaaaagagacttgtttctcgattccacttaagagacttcccaggtcggttcattaattcttggctcccaaagccatttcacttgattaagcagctccccgagccattgtcagtttctcggacttctcactgcccccatagcacaacaatcttcttctactcagtaagcatagtctatgatgccgcaaacatcccgaaacacacaaatccattcctgaccacctaggtcatccatctgccacaaaggttgattctggtaatgagtctcaatccacaatacttttcacaaagcacaggcaaacaaaactacgcaattggaaacacttcacatctgtagagggatatactttacccacacaacacgaaacttactccagaaaatagccggtgtcggaggtttgtgacaaagccctttccaaccccaccccagg

SEQ ID NO: 32847 - DNA, 5055 bp, Oryza sativa
  unsure (1)..(5055): unsure at all n locations
caaagagtagtacacaaatatgttgtgtttagttgacttgctttgaacattgacttggaaactgaaatactacgtacgtacttcaggaatcagaattcgtctgcaaaatttagttcttctatttcatgatggttttaggataacatcatatccttgtccttataagaaaaaaataaaattgatagaaaatatctccattccacagataagcagaggaagttcttgtaagtcaacattttttttctcattcttttgtaatgttagttggttttattagtgcttgcttagataaacttggacccaaatgtcacctccccattagtttttcattaaatcgccagatgaagccaaagcaaggccgatgatatatatatccaatgaaacattgtctgttgcataatatttatgacctactcctagatggagttgggaatcaaacaacaattagtgaaagctacatgatatcttccacacaaccatactaatttgagttaagaagtaaactaatatgtccaattcttagtttaggacatcaccgttttgcacaccttaattaattaatgataagcccctggccaattattggccaatgcctagctaaagcctaacactaaagggcagttgcttcacggataaacagtgatgaatgctagtggtgactaaggttattgttgctctgtcaggaccacttatgaaccttgaaaatgaatttaaaatgttatgctttcagtaatatattctagcatgttctcagcatgcaaatcatgcttgtaacaagaatatcttccttcccttgttattaaacaaaacctaaaagttgtcatccatggataagagagaccaagtggtcttgattcttgaaccaatacaagggtaaccccaaccacctaccaatcttcaattctgcccctgaactttctgcacccaaacaggggagctactgggagaaaaggggacaagaggcaaaatgccatgcaactactcaaccaaagctggtcctgatgatgattaccattggtaatgatgtgtttacactgaaagcatatgtgttcaagagagcaaacacatctttttagtaaaaggtaaagcccattggcactcactgagtgggattcctgcaacctttgcttccttaagccaaacacttgggcttgcttttctaccataaacaatgtgaaatcagaggtgaaaagttgtaggcgttggaaggaaggccatcctggaatctattccttccgagaggtagaaagcaagaaaagttaaacagtagtcattggtttcacgcgtcatgtgaccaaccaaattacatatcgtctgaaaagataaaccggcaaatcatattggctatcattttcatttatagtttcattttatcgatgcttgttatttgttcaaggtctaatacgtacttgacccgtgtaagtagtattaattctctctggtgcagagaagcatatatgttgacttcagttgagtgtcctgctggttagaaatgaccaactaggcaactattagcttttttaggctttagcaataattcctgaagtattatgacccatttcagttaaaatagttttttttattcagtgtggtatatattagctttaaaacttttgtcatctcattgaccactttagtcatgtagcactgtgcagacatcacatatgacagcagtggtgactggtgaggaaaaactgagatgctagctaacagtatatgcacaggtcctacatgataacaaccaatagccttcagttataagatggcatatgtcgttgcgtgttgcaagctacaccccttggtgttggataaaaagcaccaagggtgttgcaagaaagtgactagcacaattcacgaaccgctctaacacatgtcaagatggagataatcacaagaagaaccatcaaatggcattcagaaaccacctgcagatgtccaacatctcatccatctacatgatggataattggatatcatccgtgcttgcataattggatccacttgatgtatatattattaaacaaaaacaattcatgtcaaaaagatcttaacaaggcagaatcggcatagtttggctaatctgggacgcttttgggcacccttgaagtgcagttttttttgttgggatggctattcttttctttatgtgtgcttcgcagacgaagaatagggccgggggctccaggttgtggatctcgttcttgattggcctggcccaggatcgctggcaactgtagcgatccaatgtcttgacaggctgcgcaaagcattccggcccatgtgatcgagttggaggatcagtttacatatggaataagtccacattgactcccttaactagtgaccgaatctgattcgtatcattgaaccgtaataccggatatctcgacccccaactattaaaaccggtacaatttaacttccttgacggttttgaagggtggtttcactgatgtggcatctacgtggtagtgttaacctggtctgtggtattggcaggacgcttaggtggcattagaattaagaacatatatgtgagccccatttgtcattcacacaacaaaaaaaaaattgtgaagctcattgacatgcgaggcccacaacgtcatcccctctgtatctttcttcctcctttctctctctctgtttcttttactctccacttcggtagtctccataagcggcgggatctggagcgatggcggtggtggtggatcagttaattaattaataacttattataatcgtgatttcatatcaactaattatttgataatccggggctattaattatggcataaatcatatgggggtgatcgagttggaagatcagtttacatctctctgggcgggtagctatttaagaagttgaggacgggggcgtggtgtactggtgtgcaggcaaggcaggctgcatctcatgggtgatctggcaggtcctgagttcttagaggcccagtgcaaaactaaacacatgggcccttaatatacaacgtaaataatagtcaataaatattaccccttaaattgcataacaacaatatttacataaaaacatcatacatattaccttaaaactttcttcaggcatttctatgtgaaatcattgatgatggtgccaatatcaatttcatccaataatttttttaatgcacaaaattgccaaaccatttagtctttctgttaacaactaaatttggtaattcaagtatcggagatggagatagaaccgaagcggaatccaagatagagatcgttccggaaacagagcgagaatcggctaaagtccaaatcggctgcgatcaggatcggcagagttcgagtcggactaggtagccgattgagccgattccgataatgtgactcggtattcgttatcgggttgagttaatgtgcttcatatggattgccacgcacggattgagtcctgagaaggcaattgtatctattaattaggatattttatgtaatttttttagagataagtttgggcaaaagtctgccacaaagacttatggtattttagaatttgttagaggtaagagtcgtgtccgacaaggacatgttttgtatctcgggtataaatatgacccgaacccatgtaatcaaataacacacgttcaatacaatctcggcgcatcgccaccctttttactttcgtttactttcgacgagttcttgctttcggattgagctgcattggtttcgatcttcaactagaggtaaaacttgttatggcggcttgcgttctcaggattaatgcttccatctttatgatactctaatcttgtttatgtaattcgtcaagttatcatatatcttatataatcttagataatattgttatttaaccttcattcggctaatatctatcgttggaaggcagccgatcaggttaaatatcaatgttgacttagattatataggatatctaccaccctatgaaacatccaatgacttgattgtctagatattgtccttcttttcatacttatagctgcatcaattgagtttgaccttataagtcgtgattagaatctcaatccctagcctgtttttggttgccgattagggtaatatcggggtttcagccgatcttacctgatttaactactttatattttatatgcttgattgacatgttaaatccgccatttctgttaagatcttgttgcatttaggtatattaagctttctgtttgatatattttgtttactttaatatcttaatatagagtggtatcggagtattagccgatatgtgctagatctatctgatcggctatgctatgaatgcttataatctccttgttaatatatatttcgatctaagtgatttatactgtctcggcacggcgaccgatctaccccaatcacttgatttaagtatatatcgacataaggattatataccattaatacctacagccgatcgaatagatttagttctttcttacttattcatgactgtcgatcgacttaaatatgacatcagctcaaaaataaatgacacgtcatcggcgactggccgatcggctatcgtttatagatttaaccgctatttttctgtctttatttcttgttgattgcaggatcaaatcaactggcatgctcacgaacctaaaggcaagatttttttggacctgcaccaaagcgaagcagatcttccaggcctcgtgtttttcgcatcaaacactttcttcgacattttagatctcaatagtttctttaataatttcgacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32848 - DNA, 3410 bp, Oryza sativa
gaaaatttgtataacctaccggtatgcaacatgaatgatggaacccttgttcagctgccggcatatgcaactggtgcaggaagacagtaagcgcgtatactcattatggagttcatagctcaagcagccatataagttcccacttgatgcagcatgggtgcctgagaaaatgcacagtagctagtacatgaatgtaggacatatatgctgtgttactcaaggaaaaaaagaccaagcacatccagaccatgatgacaataataatgccttgccaaatgaccccatctatgagaggacactattaagttatgtactactaacattagacgcgttatcttaggttgctttttaaacggattttgggctaggctacttgttcatcgtgattcgtgaacatgttttctaaattgttaaacatgtgtttcacgcaaaaacaactttttatataaaaatttcttaaaaaaatcaaataaaaatatagtatttttaagtttataataattaatactcaattaatcatgcgctgttgacttgtctcgccccaccaaaaatctaagccaaggagctgattcgatctaaagccttgcaaaagaggaaatgacctttctcagttggaaaaagaacatttagatcaaaccatgattatgcacacatacttaataccagtcttaagatatatccactggtggagaaaccatctttggtcggtcgaccagattttacattaaaaaccgggattaaaaatatctttagtcccggtttaaaagctacagggtacttttcaatctttagtaccggttggtgttaccaaccgagactaaagatttatttatagtcccggttaataacaccaaccggaaaaaaagatcgccatacactttactcccggttggtaacatttatagtcccgttggtaaaaccgaccggaaaaaaagatcgacgcggagatcggagaggtggcgcgatcggatcgaggtatctcctctcctttaactcctctctcctcctctactcaaccttatctcctctcatttttaactcctctcctcaaccttatctattcttcttgtctctattcctctccttctcctctctactgccaggcagacgcgagggcggcggggcgcggagggccggccagcgtggcggcggctagcggccgcacggcggcagggctcggtgggccggccggccagccggcgcgacggcgacgcgcggcgaggcagcggctttctttttttgtattattttttttgagaatctgggattgttgtgtgatgtatttgattggatctgagattgttgtgtgatgtatttgatttgtgtgtgatgtgaatatgtgatgaattttgtagaagttgtgatgtaatttttttaaagattttgtgatgtatttgagtatttgagatgatcgatttgtggatttggaggcaatttgaggacgattgatttgggattttggggacgggatggggtgaaatcaatatatttaaaaaataatgaagaaaagaaaagaataaagaggaaccggaaagagcaaccgaattagcctctttagcccggttggtaacaccaactgggactaaagatgctttatctgttaccaaccaggactaaaaatgaatttttactcccggttttttcgtagtcccggttatagggggttacgaaccgggagtaataaccatttctccaccagtgatcctccatatctgagaccaaaatttaaaagtgtacaaggggataacagtcaattaaactattttataacaataaacagtttcacttcctaccttatttagcctataaataattaagtactagtacaagataatgctccgaaatcgcactgctggaaactgtctctaccgtaaagttaggttagaaactaaatgcgccagccccttaacagattcatcagattatccatgaatacattgaaggtcacatctcaagcttacatgttacaatattgaatacctccatgtgctgttccagggacaccgagtatggcgaatctgtcaggtgttgggtagtggaggaagaacttgaatagtgttagttggttggcagcttacaggatgacagtttaagtgcagttaagccccaatggcaagataaaccggccggtatattacataaacttggatcataatatttgggatcacaagcatccattcaatgaaggtaaaaaactatacgcgctctctagactctagtgctcttaaagaagaaaaggcacacagaaggacgaggggagctttggttgggaggtacagagaaggttagaatgacaagtaatttaaaacagatagagtacctattttctgctaattctaaaaattgcatgagcttatatatgaaaaagtttataatttgtatagttacttgcaattctcatcaaatacagttatctaagagtatataaattatttctgttgtaaaggaagtaaaaggtaataatcatatacgtacacgagatcgagcgcatcaacaggctttctagtacaatcaagggacgaatggaccaaaagacttgagatggatttcctatttcttatttttactttttttatctgtcatttaaaacaacaaccggtaattactccctcggtccctcaacatttgacgttgttgactttttaaaatttgtttgaccattcatcttatttaaaaattttgtgaaatatataaaactatatgtatacataaaagtatatttaacaatgaatcaaatgatatgaaaagaattaataattacttaaattttttgaataagacgaacggtcaaacatatttaaaaaagttaacgacgtcaaatggaacggaacggagggagtacatttttccaattatatataagtgaaatattgacaactaatggtaccgaagtgcttgtttttgacaaataaattacaatatcaattcgggatgccaactccaaataccattaattatttcaattacactcctatttttagcaccgttgtctttgatccacgtttgaactatatattcacataatacaaggtcatattacagtttattggatgatatttttgcatcactgcaaaagtactctcagccagaggaccctacagcttttatatgagcatgatatattgtccatccttaactgacaatggcaagatggaaaatcctatgcatgttaaggcacaatttgacaaggcatttcctatataaaggtagccaagtttcactatgaacaacacaaccataataccatacaaagccaagcctccaaaaactgcctcagagctgaaaaaaagaagagatacatagaagatggctcttgttattgctgatgaaatcaaggccaaggcggaggtctactatgatgatgagatctgtcaacaatgcacaaggctcttgctcaaggaagcaggcct

SEQ ID NO: 32849 - DNA, 1612 bp, Oryza sativa
  unsure (1)..(1612): unsure at all n locations
ctgtcgtcggctgagctccggcgagggccgtggaccgtcgatgaggacctcaccctcatcaattacatctctgatcacggcgagggccgctggaacgcactcgcacgcgccgccggtaagcttctatacctcttatactgccagtaaattgtaccgtaaaagttgtctttgtcgaaaacactagctacttagctgtttaattaacttcgattaactcaaattatcaaaatttctcaatccgcaactccgcaaggtatagctaagatatatacacgtaaatttaattacgctttaattaccagcagagaaaaaaagaaagctaggtatgcatgagcagtgggattaataattaattgggttgggagaattaagcagcaaacttaaccaacaacctgtttatagagtaggttagccaggacagaattttcctttccagtgcagcttagccggcgacgtcagtcacgagtccaatcatttcctccactacctgtcttcaaaactatgtgcgcctccgaccacataattaatcactatagccatgcacagttatcacaaattaaccaatctctcacacaactgttgattaattgtaacctagccatcacgccatgtgtctcacaacatgtactactactccaactaatgagtcaatcaattaatcaactgtgagatggatgctgattaatagtggagagagagagattattgatgaaattttaattgtgcatatataggtctgaagaggactgggaagagctgccggctccggtggctgaactatctccggccggatgtgaagcgcggcaacttcaccgcagaggagcagctgctcatcctcgacctccactcccgatggggcanaccggtataatcaaataaattaattagctcactcgtcattgattaatcttatagaatctagtattcatgcatagatcagaaatgttctcagctacttcctctgtatttttaatatatgacggcattaattcttattataacctttgatcattcatcttattaaaaaaattatacaaatcttaaaaatataagtaatagttaaagttcattaccgataaatcaagccacacggccacaacaaaagaaaatatatttgcttaaatttttactgataaatcaaacataatgtaaaaagtgaacaacataatatattagaagacggaggcactatcgttctaatctaattggctgacttcagtgaagctttcattaacttatagtagtcattaactaattaaatcccttcttaagacctgctaattaaccaccatgctcaccatccagcaaacctcgaggcgacacgtgtcctacactgtagagaagaatgaagactagcttagcttagcttagattaattagctgggagcttaatttgacgcctcgtgatgcagattagactcgtgtagacgccgctagcaagctaagctaaaagtaaaggaaggacatgtcacggtcgtacagacttgtgacgtggacgtgacgtggacttggccgctctcaacacatgtcaactcgtccctgccatgtacaaacgcacgtacgtgacgtgacacactaattcacacactttcagaattttaatcagccaaca

SEQ ID NO: 32850 - DNA, 18793 bp, Oryza sativa
  unsure (1)..(18793): unsure at all n locations
cctctttcgatccctgaaggggtttttgccttctagatgtctaggggttcaaagaggaccagaggagatatatatgtgtttggatatgttgatatatgagctgatatatgccttactatatatatactccagaattgcactgaggattacatatccaattcagacatgcaaaccttaccagttgcaatattgtaaattacatgtccaattttgtagtttcatcttcctcatcataaaaaaattatgttgtgtcatgtgcatctactttgttttccccatgtcaactagattatttctccaacacatgtggaacagtgtggaaaatacatcctcatcaacagtaataagcacagtgctaacaaattaagaaaaaagtcttttcatgtgttctccaaaaccctaatcacacttgagaaaagagagctgcaacaagaattgatagattgtacgatccatcgccgtcaacaaatgtggaacgaataaaaaatttgctttgggagctcatcacagctaaagtctccagaacaaaaaccgtacatgacattattgcagcacttgatcatatcaaacgtatggaccagaaaggctgcaggcacatgtatgtcatgtgtaagctttttcaaactgagtactgtatctaattaacagcagaaactgaaaggaaatcctatgaattcctcaaagataatatcaattttttaaacgaaagtcagctttatatagactatacaggggttaggaagaaagtctatattcagtacctcgactattcatatagtttgatttccattgctcaacaatattggataaaactcacttgtccattattaaaactatgaaaatgataacttggctaggcttatacgtggctttatgttaatatatatgcttctgggtggcgaaccaaaagaagaagacccattaggttatccatgtagtactatgattctagtcttctaggcatattctccccgcctcaatttttttctgtttaaaaggaaagaggacttgagatgcagagaatgtagcagatgagattgctaagaaaatgatgatgaggcaagccaccttacccaaaactttttacaaaaaagggggatgtcgaagagatgaaaacccaagttctctcctacagctgctcgtggcaccaaaagcctcagggatcgtgttgcgtgacgctaaacaggactagctgtgagcgaggccaaggacctaaccctcaatttaggcgaaccacgccgtgtactcgggacactagctcgaagcaggccttgagcacgctatattaatatggtaggacgtggcacgtctctccctcgtgtcgcacacctgatcttgcatttaatgcgaaggatgcaaatccgatggccacgcgcatggagaggagtggatgacaagacgacgcatgctgaccgtggaacaagcatcatcacccctaaaaagttgggagcgtgggttgtcagctgacataggtccttaacccggtgtactcgttgttagaggccgacgagtgggccaggctagcgccacccttggtttcgtcaccaactcctaggccacgcatcgagaccaggtgcaatgggctagcttgtagttggccacccatcatcgagcgatgggactagcctttcctaactcatgtgtacatgaagcccacttgtaagcgactgcccaatgtggtgcccctcgggctataaggggattcacaccttgaaaacccattaaggatagaaaccctcgcgagctttagagaaagaaacaatgcactttatgcatattgcagtaaataatccagttaagaacttaataggagtaggcttcactgctccctgctattggagctcgggctttgactagggaacattaattatctaagaattttttttttcagaagatcagtgcatttattgagaagaagacaaccattttatataaagcacaatattttattttgagacaatattcctttgactaagaatatctataaaaataagatgttttaaatgaaaatagtcatatattatgatagttgtttaataataaatctagtaacatcaattttatatgattgattttttttatttttatactatttcttgtcaaagttaaaaatatttgacttgacaatattataaaaatacttatattttgagctgaatagaatatttggctaacggggatatgaccatcattcgcaagcagcttacgatataaaatggagagagcatatatatatatatatatatttggtagtgatcattattctcatttggaaagtagtgtgtgaatatttaatactagcctccaagttggtgcagtgacagctagctagcaaatggtgtgaaataaacccacggctgcagttcatgcaccggcggccgccgccgccggcgtgcgagagatcgagccaggcggtgggccccaccgtctcgttgttaagtagctatctcgcacgtgcccgaaattcgatccaaagccgatcgagaagttgatcaagcaagcgaagctggcgattgaccgatcggatcgagtcgtcgtggtcctctggtcggcgacacgtcagctagccacgtcaccggtagtcacgcgcctatcacgggggatgtgggccccacccgctctgccgtccacgtcagcttcagctaccgtcaccggccgttagataactgtccgccgtctgttaatgcgtgattagctgcgttataggttagtgtacactacaccaacagtgtgcgttgttccatctgaacggttgctacggccggctacttggattttggatagtgctattgctataagcctacaatatatagtatcaaatagtatataacacgatgcatgatatatgcatttaaatctcaccaaataatgctataatagtatcgaattaatatatatatgtgtacatatagtagttgcagaaacaacaaatttctatataatagcatctccatccgataatgaccgcattcagttgttcacaacagtgataataaaactaatgattactctggggactagctagtcggagtcgacgttgtgcacgcacgcacgtttagttaattaatcggtcattacgtcacaagccaacaatagaacttactactccgtaaatatgaaaaattgtaatacttcccttttcataaatataaaaaattttggacttctctattcaccctaaaatgtaaggaaattttgagtgctacatttttctaatctatcttggttgttgcatcgctaaacttagataattttcaatcaagcgagctcttaaacatcaaagtagtttttccgcaacattaaactttggcaagcaatccggaatcaaatgtgttaattacttgtgaacatagagagcaatattactacatccgtcttaaaatatactccctccgtttctaaatatttgatgccattgattttttttaaatatgtttgaccgttcgtcttattaaaaataaataaataattattaattttttcctatcatttgattcattgttaattatactttaatgtatacatatagttttacatatttaaaaaaattgaataagacgaacggttaaatatgtgctaaacagtcaacgatgttaaatactactccctccgtattttaatatatgataccgttgactttttgataaacgtttgacctttcgtcttattcaaaaaatttatgtaaatataatttattttattgtaacttgatttatcaacaaatgttcttacataagtatttttatatttgcataaaaattttaaataagacgagtggtcaaacgttggttaaaaagtcaacggcgttatacattaaaattaaaatacggagggagaggaagtataataattttagatatgcacgtgcaggtatatagattttagtacgagaggaatttattatggatgatgatgaaaaagaggggaaaagtagcatggtattacgtggcggtcggcgagcggcgacgttgggccagggccagggcggcgatcgactgactgactggtcgatactcatggttgtgtcgtggtcgtaacttgcgtacaaaagtctgaccgtttacctaagcagctggcactgatggcgccacactgctacactgttatttttctttctttctttctttctttctttctttctttcccacagtttattaggaggagctgcgtaccactggcactgcactatgcatatatactttactaggatatatgtactgctcactcttccgtctcttaatatatatgtattttttatgacttaagatttataccataattaactaaaagaatatcggtgcgtcacaacatgtaaagacatttttttcaatggtacaataactgttaggagctaagaaaaaaattgaaacattacgatcactacacactataattgaaaaaacttaattataagcattgcttggttttgggccgaaagtctgttcattcatttctttttaactaggtgataccccgcgcattgctgcgggaattttaaaaaaatggttacagaaagaataatagtggtacagttatagtatatcacctctaaagcaaataataatactgaaagcttgacctatcaagcttagtgatcaaacgataacattacgatgaagtatcagaaaaatatttaggcagtacatgcaaatcttgtcatgcatcacttttacctaactcaacagatgctaatctacatacatatcatatggaactattgacttacttttcctgtagaatagtacatatatgttcaacgaaaatcatgttaaactcttacgatgattgcattgatatcaaaaggaaagactggttaatgaaaaatgacaaatggtctgtgccaagactgctaaagtaaacaaaattgtctgtcaagcaacctgtaagtgacaaacacgatgagaaaattatatagtgcatttagaaattttactattgctcacacataatttcattaatatatctcggaacagatttgttcaacctcaaagagtgcttgttgtgaatacggttgatatacctattgtaacggagaggctttactgctagtaaaatttcctcgtaaaagaatgagtaacttattgaataattaaagaagactaaactactttttttagagaggaggccatacggcccggatttttttgaaagccacacacggcagagcagaagactaaactattctagaaaataaattagtgaattgaacattgaacaccaaaccgaccgtttcttgtaatgtgtgcgaagaaacagaaaggtaagggagtgattttaccatagtttgcaatagatcttatactgctaaaaaatacaatgtcaattcaaagagggaaaaagaccaatatatttgctatcttcagtggcgagaaaaaaaatcaagtatagacattagagcacacacataaggcgatagaaaaaccaagctcctgtattctttaaaaaaaacacaaaataaattcagttgatattgtagtagtatataagataaaggaaggagttacctgggacaacgattggatcaacgatgacatggcaaatcaatgaaaataacagtggcgaggtgatccagaaatcaggaaagcacaacacatctgtatgttaagaactgcaactgatgaattgcattagcggataatcatgccgatgaaatcatgaaatccattgacaatatgaaatctcgcttttcatagatatgccaatggtgtgaactgtgtgaacaaaaatataaatgggcatatggccacaatagctgaatcaacaggattgaagactcaggcaaaaaaaactactcaaataaatcgacaatattcaaaaagagatgatggaggtcgcaggctcgtagccgaacaggtgcaaagaaggcgagatgctgcacgacacactggcggaaggggatcaggtgcactcgtattaacaaagagaaagaaacggctgagcccctgctggaggaagatgatccgtcggcggcgctgcttcatattctcatgagtcagtgtctgttggggttcaggggcagcggtcgcctgattttgacagtttctaatgtaaatgcttgtgattaagtgaggcgaatgagaagtgattaccatctctgctggtggttgaggatgagggaggggccatttgatttcaccatggatggcgtcagggctcccgacgtttctccccatcggcgcatcgctacatggatcgctccagtcgtttctcccgcgactgaggcgaacgaatgccgcaccactctccccattggcgcatcgctgcatggatcgctcccgatgtttctcccgcgacccaggcgaacggatgccgcaccacacctcgccgtgcactgtccctaccaactcctgcgcgcgaccgtgcgcgccgcaccaggcggttcgccgcactacgccgtcgccgctccgattcaggaagtcgggctcgggaggatgagagagacacatcgaaccctaaatcactcattgggccgcgggctgcgatacactgatatgggtctccttcgctgcctcacgcctgtgaagtccctcgcttcctcacgtctgcgaagtcagccttttcatgaaaacgactgagatgcgatgtaatcatccgatccaacggctgccaattaatgatgacgtggaacactgaggtttgagatttaggagattaattgcacttagtgggggataactttataggaagaagggattagtcccagaacacatgcctcttatctccattcgctcgtcctgcctcccttcggcccaatcgacaagtgaattcgtaggcctagctagcacatgctcccttctctcgttgccaggccagaaccacgcgctacattagcgtcttcaatctccaaaggatagtcctgtgctcctatcctccccatcaaatataatcgaatcttcctcatatctcgaaattggttgagggttctcctctttcagtccccccaaaccggagtgaatctgcattcaatttcgcaaaactctaggataaaaaggatcaggtaagctattggttggtcattgttggcgaccgttaaatagagattaaggctgacgaattaaagccaaattaaaaggaaaaatcatgaggaaaatgatgagggaggagtggggaatcgatttttaaaagcacatagagggcagaccgacgtgacgacggcgctagtgttccaccaggagagaagagcggggcatcatttgaaggcacgcactgcgaagcaggccgagacgagtgatggctaggccgagctctaacgaactgactgagagacgacgacggacagaaaaaagagctacagaagccttacatatttttaattaggtatggatataaatataaacatttttaggcgtgtaatgattctaatgcatagaaatataagcatttttcaacaatcagaagctcataaagataagaaattcaaaattctgaatttctaccagttacgcgattggaagaaatatttttattcatctttaatctttgttcaacaatctagaaatacttattttagaacgacagggggagtcgtttttgttctgtgtatgatatttatgcttttctacacgttcctgaaaggatggaccatagttccagcgacttaaattcattcggcccatcaaactgcgacccaaatacggcctactaaactctgcacaaaaggccttagaatcgagcccagataattaattaagcctatcaccgaagcaaattagaattttattaatttattttttaaaaaaagatttacactcctcccagacaatcttttaaaaaataaatataaataaatttcagcaaattaaggtcgagagatcacctctcactagttagcaagtcctacctatgcggccatccaagcacaagcttcttccatccaatcaaaaacaaaaacaagatggatggtcatcttccttccatgcatgggagcatccaaattaatctaccaagaacaccctataatatatatgcatcgccatgatcgaagcgaggaagaagaagaagaagaagctgcagttgcagcagcagcagcagcaactagtaactaataaagtgatgacgatggatcgtcccaacgtcgccgtggccgcggtggggctgctagtggcggcggtggcggcgacgctgccggcgccgtcgtgggggcagcagcagccagccaacaagctcatcaccagcacctccggctccggcaaagggttgtccaagtggctggcgatgaaccaggaggagtacgtggagaagaaggcgctgcacaccatggccaccgcggaggagctcggcgggaagaagctggacgcgaacctgacggcggcggaggaggccaaggtgacgtgggtgatcgaccccaaggggacgccgggcgacaccaccttcaccaccatcacggcggcgctggagaaggtccccgaggggaacaagaagcgcgtcatcctcgacctcaagcccggcgccgagttccgggagaagatcttcctcaacctcagcaagcccttcatcaccttcaagtccgaccccaagaacccggcggtgatcgcctggagcgacacggcggcgaccaggggcaaggacggcaagcccgtcggcaccgtggggagcaccaccgtcgccatcgagtccgactacttcgtggcgcatggcgtcgtgttcaagaacgacgcgccgatggccaagcccggcgccgagggcggccaggcggtggcgctccgcctcttcggcaccaaggcggccatctacaactgcaccatcgacggcggccaggacacgctgtacgaccacaagggcctccactacatcaaggattgcctcatcatgggcagcgtcgacttcatcttcgggttcgggagatcgtactacgagggctgcaccatcgtctccgtcaccaaggaggtgtccgtgctgacggcgcagcagaggagcaagaccatcgagggcgccctcgagagcggcttctccttcaagaactgcagcatcaagggagaagggcagatctacctggggcgagcatggggggaatcgtcgcgggtggtgtacgcctacaccgacatgtccaaggaggtggtgcccgtgggttgggacggctggaacatcgccaagccggagagcagcgggatctactacggcgagttcaagtgcaccggccccggctccgacgccaagaagagggtgggttgggcgctcgacctcaccgaggagcaggccaagcccttcatcggcacgcactacatctacggcgactcctggctcatcccaccagagtaattaattactacttttgtttttacatcgattaattaattaacactctctctttttcatattatgaatcgctttgatttcttttgcatttttttcaagtttaaccaaattttattggaaaacatatcaacacaattttttaagaaaagaacaaacatattataaaaatatattcaactttacatttagttaaactattttttaaaaatgctgctaaattttttgaaaaaaaattgatcaaatataaataagtttgacaaaaaaaatcaaaacaaagttacattttatatgaaatggaaggtgtaatcaattaattatgctagtacaaattaatatattctaattgttggtgtaacatcaaatagcgggacatcaacgtcatctagctcagcttcaacgtcgagcaactcaaccgcggaagcaccgacggcgagtagtaactcaactgcatcggctaataaaaaggaaagcaattcaactgcagaagcgccgacggcgactagctactcaactgcgtcagcgacgacgagtaattccactgcgtcagcgaaggcgactaattactcgagttcaagtccaccggcaaaaggcaagtagttaatacaagtgcagcggcgacgacggcgccgacgcgatgaatcgcgttcattggggccaaccaattctgttttggaagcccgtttaattgttcattctttgtgtcaatttgggccggattaatcaatcggccggctacttagatgtttcacgtacgtgtaacagttgtattttcttcccatttcgtttgggtcttttatcagtgtacgcatcttcaaaactatagtgaattttacacatgttttccttttgaaaatgactcttgaagacttgtgctctatacttatgttgcaattaactttcgggaacgaaaacgatcaacagaataggcatcttaccgtgattaaaacgggggtaacaagtacatcccacttgttccatggctaataagtcgtgcaaaggtaaggagcttattaactggttagatttcttgtgatggaaccaatccacccgagttcaatgtcaatacaagtaccgaaaagaacgtgtttgcctattgcaatatcgtgtacgtggggataagattgctcactaggtaggcacacagttattctttgcacctctgtctcattaagtttctctagatttcagcattcaaactgtgatttaaacttttaagcacatttgctagaagcaacattgaagccttgatggtgtggtacgtacatttgtttgcagaagacgataatttcttatttgggggggtgtttggacgatccaggggctaaactttaatccctgtcatatcggatgaatttggaatattaaacaaagactacttataaaactaattacataaataagagctaattcacgtgataaatttttttaagcctaattaatccataattagcgtatgtttactgtagcatcacgtaggctaatcatggattaattagtctcaatagattcgtctcgcgaattagtccagggttatagaatgggttttatcaataatctacgtttaatatttataattagtgtccaaacatccaatgtgataaggattaaaaagttttagttctatccaaacagggcctaggctagcaacagcgcctgcgcataagttgagaacatgctagaagaagctcggttccagtttgcaatgggcaaaagaaaaaaaatattataatatatcataacaaaatattttttatcaaatatgtacttaattgtttgcttattttaagatctgttaccacttgtttaaataaaatgttggactattaattccataatattcgaaaataaaaagaagacaaattataaaaactgcaagagcaatagtgggtggcatattccccaccaaaggcttttaaagtagttagattgttttcctttcattcagttactgtattaattgtgtgtatatactccaatgtacgatagtataatttagtgatcagtagtacactacaagtacatagtttttttttctgaggattttatgttcataatatatagtactttctgtgtatgatatttatgcattttgacacgttccagaaaaggctggatcataatagctaattttagccccacaaatacactcttacttgctccatatttcagaatttaagatgttttggttttgtcagaaatcaaatttattcaagtttgatcaggtttataaaataatgtattccatattcatttctcgttggcatgttcgaaattacttcaatgagatgttttctttgtctaccttttatcaatgcagtaatattattctcaccagaaaaatataatgtttgctttaagaaaagttattaggatgtaataattagtgtagcaatataatttgccgcatattctattttagtgcatgtgagatttgttacagcaacaaagtagattgaaatgggaaacggatcgagtagtaacatatagaacgccaaattaattttattaaatctagctaccatgaaatgtatttttataataggttttcttttttacaaatattgctatgttttttattaaattaacttggttaaacatcttacattagggaatatagagtaccagcgaccaaaattgggcgcatcaaatgaactgcgacccaaaatgcaacctctaaatcctgcacaaaaggccttaaaatcgagccaagatatcatcgaagcaaattaaggtcgagagatcgccggtcaccaaattagcaagaagtgcttgctacctatccggccatccaagcacgaacattttccccaaaaatggatggccagccatgtcccttccatccatggaagttccaaattaatccgccaagatcgatcaccctatatacgcatcgcgccatgatgggcagggacagaacgaattagctgcatactgcagcaactaataaacgatggatcgtcccaacctcgccgtggccgtggtggggctactggcggtggtggcggcgacgctgccggcgccgtcatggcagttcttcgacctattcctccccgccggccccagccaccgctcctccggcggagggtttggcaagtgggtgctgatgaaccacgaggagtacgtcgagaagaagtcgctgtacgccatgaaggccgccggcgacatcggcgggaagaccatcgacgcgagcctctcggcggcggaggaggccaaggtgacgtgggtggttgaccccaaggggacgccgggcgacaccaccttcaccaccatcgcggcggcgctcgagaaggtccccgaggggaacaccaagcgcgtcatcctcgacctcaagcccggcgccgagttccgggagaagctcctcctcaacatcactaagccctacatcaccttcaagtccgaccctgccaacccggcggtgatcgcctggaacgacatggctgccaccaggggcaaggacggcaagcccgtcggcaccgtcgggagcaccaccgtcgccgtcgagtccgactacttcatggcctacggcgtcgtcttcaagaacgacgcgccgctggccaagccgggtgccgagggtggccaggcggtggcgctccgcctgttcggcaccaaggcagccatctacaactgcaccatcgacggcgggcaggacaccctatacgatcacaagggactccactacatcaaggatagcctcatcatgggcagcgtcgacttcatctttggattcgggagatcactctacgagggctgcaccatcgtctccgtcaccaaggaggtgtccgtgctgacggcgcagcagaggaccaagaccatcgagggcgccatagaaagtggcttctccttcaagaactgcagcatcaaaggacaagggcagatctacctcggccgggcatggggggattcgtcgcgggtggtgtactcctacacggacatgtccaaggaggtggtgccgatagggtgggatggctggaacatcgccaagccggagagcagcgggatctactacggcgagttcaagtgcaccggccccggctccgacgccaagaagagggtgggttgggcgcttgacctcaccgcggatcaggccaagcccttcatcggcacgcactacatctatggcgactcatggatcctcccgccaccagagtaattactcctctctccatttcaaaacatagggcgtattttgtgttgttaggagataagggtttaaccaatgattgcttctccaatatattatatttgtgccgcaaaagtataatacttttgaagacgaatctaaataatatttcttatgcttcacaaaagttatattataaaagagtaatggtctatagaaaacagagtagtggttggttaaaatcttgttctaacaaagtaaaataaaccctataacgtgaaacatagggagtactatttttacattaactttctttggtatttcgattttggggtaacatcgaatagcgggaaatcagcggcatctacctcgacggcgagtaaatcaaccgcatcggcgatacccaggaactcaactgcaccggcgacggcaacggaaagtaactcaactgcaccggcgacacccagcaactcaactgcaccggtgacggcaagtaattcaactgcaccggcgacggcgagtagttcaaacccacctgccacgaagagttactcgggtccaccggcgacgccaagtgcttcaagcacaccggcaaaggcgagtagataagtgcagcggcggcgcggtgagtcacaacttcatctacggcaattgaaggatcctcccgccaccaaagtgattcaaatatttcggagtaactattaccaatttaattgggcccaatcaattctgttttggaggcccgtttgttctttgtgttgtgttaattgggccggattggtcggccggccacatagatgtgtaacatttgtatttttttcccaattcatttttggtcttctatcagtgtacgcaccttcaaaatggtgaatttttacagaagtttttgaagaagacttgtgctctgtatgcgtggcaatttactttaacgatcgacacgacggcatctaattctgacgaaaacgagagataaccaatacatacacatagtattaggctatgttcggcaccctgggttgggaacccatgtcccacgcacaaaaaagatagcgatccattagcgtgtatttaattaagtattagctttttttttcaaaaatagatcaatatgatttttttaagcaactttcgtattgaaactttttataaaaaaaatatactatttagcagtttgaaagacgtgtgcgcgaaaaacgagagggggagttgggaacctggggcaaagaacaaagcctagtaaagctagcagttcgtacaagagtgtggtaattgtgaattatccagggtctgcataaaatcgagtttaattcttcgtgtggttctgataagttccttgctgtacagtgtataatttggtttttagagaacgacaaatggataaacagcgtgttctagaactgtacatagaacagtgactcaaattaaggatgagaaatgggtggatcagggacgacacatgctatacatctctccaaattgttatccatttcgtctgtgttcagcatcagttggcctaattaaaactgataatcaacaactttaaaaaataacttatggcttatatatatataatcctgagcgatttaatgccaatacgaaccccaaaaaatcaattgaaaaactaaaataaaagttccaattttaacaatggcttatatttaagcaatcggtgcttctcttgctacacatttataggagtagagtatggattttgcagtgacaattaaagccaaacacacaaaattcacgataaaattaagaaaaccacacaaaaaaaaagtgagccatgcatagcgagagccaagtggcaatcctctagtacactcgcagctgtggcccccgcaaaatctgccacgagccaccaaaccccgccacgtgtcgaggtgggccccaccaacgaccggactactcccgcctcctcatccggttcccgccactcctatttatttcccaaaaaaataataaaaacaaaattcgacgaagaaaaaaaaaataaaattcggcggtaaataagcggggcgaaggaagaagaaaatcacggaaatgccactaccggcgttcgtggcggcggcggcgaggctcgccgtcctcgtggccgcggcggcgacggcggccaatgccgcctcctacgcgcggtaccggcggcgccacctccgccgcatccccagccccatcgacgagtccgccgatcccctcgccgacttccgcgcctttccctcctccgacgctgacgactcaggttcgtctcactcactttcgtttccctctgtaaagccctagccatgtaagcgctaatcgttgaggtcaatggattattgcattggggttgggagattatgtatttgattagtctttgtggatgcccagttgggaggttttaggttttatcaatttttgagatggggaattgttggcataatcgatttgaatttaatcaattaatccttatattcaattagttttttgatcaattagtcaatgtcaatacgagagtactgaaaagaactttgtttgcccattgcaaatgtcctgttacatcatacatggggataagattactcactataggcacagttatgctttgcacctctctctcattaattttctctataaattcgagcattcaaactgtgttttaacatttaaggccatcactggctggaagcaacaattgtcaaggcaatatggaagccctgatggtgtggcatatttgtttgcagaggaggataatttcttctttgggctagcaacagcgcctgcgcatgttgaggacaggctagaagatgcttggctccagtttgcaactgaaacttcctgcgatgacaatggaaacgtgcgcgaccagaggccagtagatgcactgatggcatctgctgctggtgatggaggctcccagcaatcttggaggtcaacaggtggggaaaatattggtgatagagagcagaggaaaccacttagggtagccatggaggctatgctcagggggtttgaaattcttgctgagagtggagaatctgctggcggcgataactgcagccacaatgttgctgcttggcataatgttccatgcccgtaagtacatgagtatagaatctctaatgagctaatttatctcagttctgtactccaaagaacaaatctccttgcctgtaaagtcacctagagtcacttctcatcttaactatctctccaggaagagttgttgtctttcaatattgtagcttctttccaagtctagatatgacttcgatagtgctactatgtagtggtgggtcccaaggataaaaaacgaatgcatgcttttaaaaaaagtaattcaagattctagctttccttccaaatgtagatgtctttggatgttgtatgttagcaaactctgatcattttttttcaggcaagaaaggcttagattttggtctgatcctgatgctgagttgaaacttgctaaggagaccggcatcagcgttttccgcatgggggtagattgggcaaggttaatgcctgagaaaccaaccgaagaattgaagagctcagtaagttcatagttatgcacgtgcctctttttacctttatattcatctttctttntccagcatgatgatctcagtaccggtgaaataagatagacatctctttctctaggttaattttgcagcacttgagcggtatagatggatcattcaaagggttcgcgaatatggaatgaaagtaatgcttactctgtttcatcactcacttccaccttgggctggaaaatatggcgggtggaagatggaaaaaactgtcacctatttcatggattttgtgaggtaccttttgagggcagtcaaattgacctgccaatacattctctccattgggaattgttcaataatttattagattttgatagttggggctgtgcaggcttgttgttgatcgtgtatccaatttagtggactactgggtgattttcaatgaacctcacgtttttgtgatgctaacttattgtgccggtgcttggcctggtggagaccctaatgcaattgaagtagcaacatctactctgccaactggtgtatacaatcaggctttgcattggatggctattgcacattctgaagcctatgactacatacattcgaaaaggttggttctacataatgtattatttgcagtgcccttattccagtgattacctggtattttttattcgataatcaaggagttggtttcctctggttttcttattatttatttcttgattaacagcaagaacgaaaggaagccaatagttggtgttgcacaccatgtatcgtttacaaggccatatgggctatttgatgttgctgctgtcgcgctagctaactcattgaccctttttccttacgtggatagcatatgtgataaattggacttcattggaatcaactactatggacaggtaagcaaattatttgctgcttaatgaatggctatgtaagtgaccgagttaattctcccatttccatgcaggaggttatatcaggacctggtctaaagcttgtggataatgatgagtatagtgaatctggtcgtggggtttatcctgatgggctgttccgcatcctgattcaattcaatgaacgatataagagattaaatataccttttgtcattactgaaaatggagtttctgatgagactgatctgatacggaaaccatatatactggaacacttgttagccacatacgctgccatcattatggtcctttcttaacctttaagcaaacatgttttagtctgtgctcatggagatggaacttccaacacttaaacaacataatgttttatagggtgtccgtgtacttggttatttgttttggacaacatcagataattgggaatgggcggatggctatggtcccaagtttgggcttgttgctgttgaccgtgctaataacctagcacggaaacctcggccttcatactttttattctccagggtaactttttcgttttagcaaatcatgaaaccatggtacattgtttacctattatctcagtctcttacgttgtctaactcctaggtgaatttttgtcttctgttgaaatattgaaaactaactagatctactccttgtttctgaagtttaaagttcattcattttcttttatcagagtaattttatggctagataaagcactaaacgtgtctagacctgagattacctccagcattttttttgccactttttacgttcatgcatgtggtggctatataactagcatgataagatgcatctgaactccaggttgttacaactggaaaaattacaagacaggacagaatgtctgcttggagggagctgcaacaagctgcagttcaaaagaaaacacgtccatttttcagggcagtggataagcatggtcggatgtatgcaggtatgtattgttt

SEQ ID NO: 32851 - DNA, 24119 bp, Oryza sativa
  unsure (1)..(24119): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctttcgtacatcttgcaaataatttctgcactccttttcaccaaattgaagattctcatagcctccagcttgcataactagagaactaaaattcttgtttatacgaattcttgcttggtcattcaactctagccttctcttagcttgcaaatcaagtttcttgtgacatctgagatgtcttgctttgctaggacttacaacatgattatggtcaagagtaagcgtactaatgcagaatttctcatcatgaagataaaagttaactttagctgggcactgctgccttgtggaggggttaggcttgaatttatttgttgatgtgtactgtgccttaccttgtctgctacaagcaagtgtgaaatatctcaccttgccatcctcagttttcttagatcctctttttatcacaccgaatcctaactttcgagcataacttaatgtaaaagcaagtggcactatcctcactatcaaatagcatacctttggttggctccaacagtttggttttatctgctaccagagcatttgaatcactctcaacctcctcaattgcaaagccatcttcatctgatatgatatgatcttcttgctcatcatcagaacatagattggtgtccattaccttaatttggcaaggaaaattaaatcgattttaaaagcaaatcaaatatggtcatgtatgtgtttgcaagcatggaaaaacaagagatgttgaaaaacgaattgagaaaattaatagaattgctcatcgggcctagaaaaccagagcctaaaatgtcaggcaaaaataaatcaacaactttctcatacctttctgttagcttcaacgtggatactctgttgtggttgccgcaaaaaaattttccgattaatcttaactgattgttatggataggagacaaaggggattagaatgagggtttacggtgagaaagaaaatgcagaagatgaaaagtcacgactgtgtatagagtaatatcgagaagaggaatcgacgccggaatacggagcttcggctggagttgggcttttaaaaggcccaacaatcacagcccactaagtaaacagctcacgctcacagatgacgctgtcgactagtcgtacgatagtcgcacaaattcgtcgtgtgtatagcattttcgattttcaatagcacatatttgcacggattatatgggaattacaagaacgacctcgcgatacttcggaaacgtatagtccggctgtgagaaaagcttcagtcgtcgcagattttgttttgaagtgaactttaaccacaattattagaacccgctaattaacctgttgggcctggccaaaatcaccacctcctaatgggcccatatatatctggcccattcacatgcataggccttcggtgtgatcagtttgtgcccggcccactaaattcacgtgaatgtatttcttcactccgcctcgttttaatgagtcgagataatggcccattcatattttaagggcctatattttagtggaccggggactaattagagtgaggcattgaggacagaaggcgagagaggacatagactcaaaagtcaaaaccgtctcgagggtaagtggatcctcttaccttgtgtagtcactgaacatatgcacctcacttcattatggcttacatatcagtggtgcaactataaactgcacaaattcagaggagcatcgtccatctcgaggaggagaagcgagcgagcagccaaacttgtctatttcgtgagctgggcacatctagagagatgcgtcgagaaccatcggatcgtaaaagataaaaattacaccttctaggtgcgacaaaaataaagacatatggctatatagagaggatgatgagctcatgcaggcgcttcacctcacaaacatccacgtactagattcttctttgttttttccaaaaggatcgatcgttaaattctccttctgttcaaaggctctctaatttctttctttaattttcatattttccaaatgactagggatctgatcaacagcgctaactgccgatcagcggctgaaactaaggcagttcaaaacagttgcagccggtagctctttacaaccaccatagctacaacagttgtggcagtaagaccaatcgaacatacacatagaaggacaatggcatgtacaggcgaatccagcgtggatgctagggagacttaccgattgaatcccccctaccccgctagatctctattgatagaaggagagggaaagggggagaagaggtagaggaggaagataatgaatggttgaaggagaaaggagatgagtgtccctctaatcttattcaggattcgtccctaagtgcatgtgcgaagtcctttctccttggttacgcattgacaagtagagagcatctcccaccactcatatagacaatcaagctcttcattggatggggcaagttgctaataggtggtccagtttgtcactagcccctggattgttagagtatctgtgagtgaaatgaatgttctattaccacatagtggctagtgaataatgtaaattcttttagaatttttttaggagaacgacggtaggagatctgccggaatttaaattagggaaaaggccgaaacccagcaaagagtttacagagtttacatggactataacaaagaggaaatacagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgtagttataggggttagattttggaaatggcagattagactccaagtttgtctggtaaaaatacattcaaattcttttagataatagtgatgaataatgtaattgaacagtctgtccaattactttgttacagtttcatggcggtggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatgataatgatatatatatacacaaacactccaacatatggacaatcttgcaatacagacttgagtacaccaccgagtcatttggcgcacgatcgatgataataattaatttaataggaggacttgaagacttgctctcatccctgcagctagcgagcgtgattacatatatagagacgaaaagagttgtgttctatggtaatttgccaatgaattcataatttttagcggtagacatttgccggtaattttgtgtcatggtgaagtgtactggtgccaatttttctataaactggcacacatgatgatcctaggtgttggttcttagtttgctagtgatgttggtgcattattcgtgcagttgtgtttgcctacacacgacacacgcctaacattgccattgtattgttcttatatactacccctgccctataataagttaatctagtacggcatgtatcacatatcccgtactaaattaacttattctgggatgatgggagtatattgatttataattttagaaatgaaaagaaagctcttgaatggaaaaatgtacaaatacaaaacattctcacatgacctcgagcaagagaattgaacactatctgccatctatagcagataatgtgataccgttaacactagatgccgcaataacagttgacgcctcttcgttcgtcagcctcatgttgaaaaatgcagggtgcttaggctcaggtagggtcatagtctcgttgcttagcattgcaacaacctctgacgtggtgggccgatcggccgcattctcttgcacacaaagcaaagcaatgttaatacatctcattatctctattgtatgagaatcggtgggtaacaatgggtctacgagttgaagccatgtttcatctttccacatctgccatgcctgcaaggtgtatgatcgcaaaaaacatgaaaacaatctacatgacattagtatttcttctatcgaagaagtacgaaaaaagactttaattttatatactactgaaatcttttcgctttgcattttaggaagattagaaactcaagtcattattatatgatgaaaacttacatggccaagaagattaataaattcaccatatcgatgaaaacttgatgtctttttcccactgacaatctcaagaattagcacaccgaaactgaatacgtcggatttgattgaaaaaaggccctcagaagcatactcaggagccatataaccactgaaaagatgcacatacaaaacattgaagtgaggtaacagtattggcagttttgtgtacagctaatgaattttataataaaatcttactatgttccaacgatcctttttgtattcccttcattatcattcacgctaaatatttttgcaagcccaaaatctgcaattttagggttcatttcacggtccaagagaatattgcctgctttgagatctctgtgtatgacacgcaaccgagaatgcttatgcaaatacagaagtccttgtgctatcccatctattatcgctaggcgtttatgccaatctatcaaagctcttcttgtttcatctgcaaatcaattcaacatagatataacaaagaatatacatttcgcagttagagttagtgaaccaaatcttttatttgcggtacggtacagcaagaagtaataccaaaaatgaagaaatccaagcttttatttggcaaatattcatatattagtattttctcctgtccctggtaacagcatcccaagagcctaacaagatttgtgtgctggagcttagctatgagttggatttcatttttgaactctgtcaagccttgccctgaatgagaagcaagtctcttaactgctatctccaccccatcaggaaatcggccctagagacaagtgcaaaagagatggatgagtgacacgagttaatttgcagtttcaattgacttttgacacttgacaaatattatgatcaagatataatcggccaaagcagagagtgaattgcataatactccatgtaaattaacgaataatatatgtgtataacttttgtcagatttttcgtcttatgtaccttgtatacaggaccaaagcctccttgcccaagtttattttcttctgagaaattatctgtggcctctaatacttgcgaaaagtcataaatagtgaattctgaacttcttccttgtagcccccaaattagtgcttcatcttcatccgcgttcgtcttacctgataaatgtagaattggtttgataatatcagttgatttagctctttatgcattcatgcatgtatgtaactttttttatgtagatatatatctgaccttttatgtgccttctcaatatgatggaagcgatgatacagagaaacaatgcaagtagtggagctaccaaagcagggaccaaaacttttgctacgggctctatagattcagagcaaatggttagtttgttttgttggaagcttggtaaggagataatgaaagtaatttttatctttaattactactactctcaaatatagcaaaattagaactgaatgtgacacaacctagtactacaacgattatgaatctggataaagggattgtccagattcaatgtaagtaataggatatatgtgtgtgtctcctatctaatactaaattgttatattttgtgatggaggtgcttaagtaaagatagtctctacgcaaagatgtcaaagaagggcgtgttttgcttactcttttgttttggccatgttggcagtaatggggcgggctgtggcgctggacttggaactagtgcattcgacgacgacccggagctccacgtcggctcaccggcgaagaacttatccgtgtcatacctcagattacaccggagagcaagaatacgtcccccttgccgaccggcgaagttggccgtcgccagatcgctgaaattctgaagacagttgtagcagatatcttcaaccaaatctggagcacactgtgccaagcagaagagcctccttggaagggtaacggtgttgcttgcatcggcatcatccatgtccacgcggattgcagcgtagtgcttcgtcgtggagagagcttgtgctactatgtaattcatcgtcttgatgaagaattgggtgaagttttttgtcccctggatgttggtgttccagccggataacatgggctccgacgtgatgttcatcaggacgagcggcgcgacgccaactgcggccgaggtgttgacacggccgaaggcgtccatgttgaggatgtcctcgtcggagaagcggagggcgcactcgtcgtagaagacggcggcgtccttgctgagcgggcagagccgcgccgtcgcggccgcgtacgcggcgtcgacgcagccgctgcaggcagaggcgttcgcgtcgccgcggcagagcgcgacggcgtagacggtgtccggggcggcgccgcgggagcccttggcgaatagggcgccgctgctggagtcgccgcttacgacaaggaatgatgaggagagaaggctgtcgaggttggattggtagatgctgttcgccgtgtatttgctgctgccgcagatcatccagggctgggcggcgaccataggcatcggcaagaagaagaagcagcagccaaggatgagcaggacggtgagaatcatggctagctatgctgcctcacgcgtaagcgtaaggtttctctgaatctcttgcattccaaagacagggtcgcatgttaagcagatcgaggcagcgacgacctgtgtggacaagtcactgctatcactttcatggagcgggtgcaatgtatagtacaaggccagactgaacgtaaatgcatgggcccacacgttgaaattaatttagaaggtggttgacatgttaaatcatgctttctaatgtcccattctgaacatgatatattttaataccataaatctaaatataattatttgaattcgtaatattagaatgtttcgtattcaatactatatatactacttttacgagatgacgaaggaagcaagtatataactccgtctccaccatcatggctgtgaccatagatagtttcaccataaccgtggaaccccgtgtgttttggtttcattttgcttttcttactccgaaagcctatacaatatgtgtccttttctggataaggtgttggattttttttccgctgttgttagtactcttttcaaaatattaaaacggtgtgtttcgtgtaaaaaaactttaaatatataagttgctttaaattatcaagtaaatccaaaattttaaatttagagcaattaaaacttgattagttatgtgctaataacgagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtttagggtggaaaataacgtctaagatctcgtttgtttagagatacatatatgtgcgggcgtgccagtgtacctaaatacacaatgtaaacaaaacatagagaacatgctctttattaatcttaaaagatcataaatacaaattcccaatgtaatatatatgtatgcgcgctccataatctgtcattggacagatctgacttgtgcgatgtggtctcctggttcctggggcctcgaaaagctcccagttaattacctccgcaagtctaggcctgcaagagaacctccgattaagctgcttgtggtcgtctcgtcgtcttcgcttcgcgttctccatgcatggttgggatgatgatgtagatgtgtgtgtgcgagcgccggcagcgatccacagcctcgtcggtccgtgcgccggtgttggtagcgtggccttcgtatcgacttcgcccgccctccgtcgtctagcctcgtcggtcttgaacaacatgcatggagttgcgtagctcgaacgacttgacgtcacagcagttgcgtcgagattagattaggaaagggagaaattattaaagatggttgatgtagacggtaaccggatttaatcaaagctcggcatctcatttgggacgaataagaaaaaccaataggacttcttcagcccacgcattggtttgtgcatggcactgtagcagtgatgacatgtcgtcctccgattggttggccacgttgccacaataattaacttaatcaacatgcattagctagcttgttgccatccaacagcactggctcgccgtcctcccgtcgtccttccttcgtactgcagccatacttgtctccatcgtcatccgctggtttcgacgccatgcgtgatacttgacctccggcatgggaatggatagaaatcttggcagtcggtggcagctccggcgatcctcggcgcgctccggcagggcggcttcccgatgacctcctccatggttagcccgctccagtgcggtgaagcttgcaaatcaaggacgtccggcatctcggcgaggtcgcagcttcgggtagatgcatcaccagcagcttgaattagcagcgtcgagtccagggacaagtagcacagcgtcagctcgaacagacgccggcatcgatgaggcttctgtgacgcgtagatgaatcggccaccgcgacttccccggcgacgacgatacgtgcagatggatccctatgcatggatgtgtgcgtgctgtagatgaaagaaaacgaaacaatcttgctagcttttaccttgactagccatcaagctcctctcctgcgcttgctaatgatcggatcaccgcgcgcgccctctcctgccagacgtcgggactccggccgaagtcgctcgccgccgccggtgcgtgtcttcgatggatggatcgccgatgagagttgatggatggatgtgttgatgctggatgggcagatgcgttgatgatgggtggcttgtggatactggatgcgttggtggatcaatttgtggataagttcgtcaatgccccaggctgccgaggggtcgacgccttatataggggcctaaggtcggtgctcgccgcgtccgcgcgccgtttcgtccgcgtcaagttcgttgcagataaggctcgatcgatcagtttgttatttgttcatatccttcttttattttatctcttagcctctcccggtgtcaaatatctgagctctgttaacttctggagcatcggggagatggaggcccagccgcccgcgcgtgcgcagctgggtggcgattccttcatcattatttctgtagataagaaacaatcaatagagataaacttgatttgtaatttgctttgtttctctgctgctgggccacagtccggtgataagcgcctcgccagcgctcgcgcgaagtaactaactcgatcaagtttgttacaaagatagaatcaattggtttgttggttatctcttaattcatctggttttatctcttccgcacgcgtgagcagaagttgttcagataaattgaaaccccagcttatctctctaatttgatcgataagtaaactcatctagccgataaatcaaaactgtggatatgtataatacgccgtgattgtgtcattcattgatatgggctaagcccaggggcaggcgcattaaatttcttaattaagcccattaatcacctcacccttaatcaagcaccatatatttgtgtactgccatgcatgcatgcatgcatgcatgtacgtagttgcttcaccggccgactgacatagctagcttgctcttgattcagtatacacacgcatatatatactaattaacaagtatagattgggcacagtgtgtatttctatatttgcatggcgcatgcacacatgaaatggagagctagctggcctcacatatacctaatgatcatggctatcaggttcatcgttctagccgctgcaaaaatgccatcaaacactcagtccggtctaagaggattaacaaagacaattaattagagtattggaactactgtttgatacacgtgccttctaagcacaaacttttatatataaaagatgaatgattttagaacaaaattttccagataaaagttttgtaatgaaaatttcagaaaaaaaatgcactggggacacactaaatatagcgatctctagaggctactactgacgtgcagtgtcactagtattttttgttcttcctaaacccaaacataatatgtgggttcctggtgatgacatcactgcaatgcagactctgttcacgcccatcaacagtactatgggccttaatgggccagctgttgggcctagcctccctaagcccataatagcttttggtcacctattgttcgaatagttctcgagatattgttgtattttttgtttcctgtgttctttcatctcatacataacaatatagcagatattttgtaaactatatatgcgtacttcctagttaaatgaatgagcagtgtcctgcttaatgtctaaagtctaaactcgaatacatggtgccacacggccgaaagtgatcccacgacctactcttcatcgttttctaaaaaatgattcaatatttcaaactgatcctcaaaagacaaatgaaagtatgataaattggtcttataaaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaggagggcggcgaggtgccggtgcaggtccggcggtggcaccgccaccgccgtggtggccgcctcacagcggataatatccatggtgatattacatctgatatagaaactttgaccgtctagatgtagacacgaccacaatcgactgtccatcttcttcctcttgatgaatcttgtatgcccccaacttggccagtagccattggcgaaggagaatttcttggccgtgcagatcttctcttcgaccaccgcaccgtacgtcccgctgagtagactgagcgtgaatttcgcttcgacgacgtcgtcggccgcggcgccggcagctggccgggcgaggcagaggtagacggagacccagtcggagtactcctcgcggtcgccgtcggggtagtaggctatgtaccaggtgtggcctccggcgtggaacttgctggagttgatgctgttgccgacgccgatccccttggtttgagagtagccggcgatcctcatggtcatcgacccggttgctgtctcgctcacgacggccgccgccgctgccgccgccgaggtggttttgggtttgggcttaccgtcgccggcagacttggaagtggtttgacccatgggtacaacaagctgtacctgccacggaacctagacaaacagatcggaggaggacgacgacgatgagttatcgatatgatgcgtctcatccacggatagattaattttgtagattgatgggaattagaacgagttcgatacggaaggaatcactgaaatatagaacgtctcgatcggaaacgtatgcaggtaggaaactttggattttttttttcaatatagatccgcctctgtttcatctctcactggattttatgcacattcgctcttggtccgtttcaatatcgaagcgaatccgtattcaattccgcaaaacttgagataaaaacggacggggtagctcatcgccgggccatcattggcgacagttaaacagaaattaatttggtgaatttaagccaaattaaaaagaaaaatcatggggaaatgataagtgaggggtgaggaatcgatttttacaattgaaagaggaaacatatgaggagacagattgatgtggcggcggctctagaattatgtcaagagagaagaacaagcggcgaatcgagacgcgcgcggtgaaaaaggctaggatgagcgatggctgggccgagcccaaacacagccaggccgagggatggaggggggagcaagccaaggcggggaggaaaaggagatgactttcggccggaggaggaaagtccaagagaaagagagatgaaggcccaagagggagagaaaaagggagtgtgagaaaaaggccgaatgggctggctcagagacgatgacggacgaaaaaataagttgtggaagccttacgtattttttaactagacatataggtatagatgtatagaaaaatgacgtgtgttgcaacagataaagatgtttttcagtgatataatagctactatgagctaagtaataaattgaaacattgggatatcattatcattatacattataattgaaaaagtttatgaaaatgcttccttggattcgggccaaaagcccattaattgctttcttttcagccctagctcagaccgtaggttttgaccataattagatcaacgcatctcatccacaaatcgattaatttgtagatgtgaattagatcgagttcgagacgaaaggaatcattgaaaaacagaaagactcggaaatttttttttaataatggattaaatcggtctctacacccaaagaatatacacagcataagactcggaaacttatgcaggtaggagtcttacttttattgaatgcttaggatttttccaaatagtcacaccaggatttcgtccgtagctaaccttcgtgcttcttgcgtttcaatgtaaatttctttccttttgactagtgctatattgccatgcccgtgtgtttcaacgggatctgaagattcaatgacgaaatacaaaatttctttccttttgactagagtgccatactgccatgcgttaaaactgaatttgaagatttaacttcaggagttgagtctagagtagagttgtggagctgtctaaagccagcgtcacaactctagtttattttgtgagagagctccacccaactacacttccagtttgggtgaaactgaaactgtttggctgagctccagctccaggagaggtggagctggagctagagttgtaccaaacaggcccttaatgacaaaatatggacaaacggttttatgacagtttttcctacgtggtttttcagctggtgggtcgtgaatgaaaacattagtaattttttaaggggtaatttggaaccatgccattataattttgcaaagtttgagatatgccatcggtatctcaatgacatgtaggacccacatgagtcaatgacatgtgggttaggatggcatggttccaattttgcaaaattataatggcatggttccaattttctctttttttaagtgggtcttgcaaacacgtactatttcttgcatgaggtgttttttttttggtagtgattatttcacttttcacttttcttttcgtgaaaacacttgcttttttcatgggccgtgaaagcactagttttcatttggcttgtgaaaacatgtacatatgcttggatagacagtttttagacggttttttcttagaaaggtacgatgctcatggaggaggacaactctattttcagagtagaccagtagagagagatgagtcctatcaaactctgcagatctgttttgatgagtcagatcaaagtctatgattcacatgttcgcttccggctccctaacaaccgccaacctgtaccccaacgtcgaggccggccgccggcgacagcaacttactcccttcgtcctataaaaaagaatctaggaccggatatgatatttcatattcctataaatctggatgatgtgtatccggtactaggttggtttttttatgggatggaggaagtagctctcattgaccacgccggagcaagaggcagtggtggggatttgggtgcacgctaaatactactccgtagaagagaaggagcagagaagacagctgaaataatggtgaaagcagaggaaatctttcccgggctccgggtctgattggcattgatagatgacaagggtctatagaaggagaaacaagagagcgggagtgtaaaatgataaaggatcggaagcattctcccctctactttcttttactctagtattttttttatatcagaatttaaactatcatagatctgatttaaaattcatctatagtgttatattcattttgattaaattaataattcaacacccatattgatccctacatttttagtaggcaaaactttactttatatcgtcttctatccttttcatgcatcttgtaccatataagccaataacaatttggtcagaatctctaaacattgtgtacgttattaaccattagagatacctatgatatcaattactaacagtaaattcctaccagaaaagatattggcccccgtgtctttctgcttggggcaacaatggtggtgattcaggctgccacaacaccacccgcctccttgcctcctcctccctctctaccgcctgagcgggccattggaaatcgtgtggttgcaaggatggtagcggcagggtcttctccctctcttgttgggcaaccgacaagcagcgagctgcgggagccgacccggttgcgttggcttccccagtggtggcgaaggcagaggcagctgcgcaggagcccaggatggtggcggtgacagaggcgatgaggtgtggtggtggtgggacgccggttgcgctggcttccccagtggtggcgaaggcagaggcggctgcgcgggagcccaggatggtggcggtgacagaggcgatgaggtgtagtggtggtgggacgccaggcatagtggaaaaaaccggaccggtggtgggacccctgtcgccaggtcgcagccggatctaggcctccgcacctagccatgagatggtgtctgcaagaggccagacggtttggtgaccgcgagggcgtccacgacggtggtggaggcggctgcatcaaagtgtgacggtggtggaacaacatcggttgtgttacggacggatatgggcttccatgcatagatttgtccatgcatcggcggttgtttcgatgggagagcgagcatcgacgggacgcgatagttggggcgtgaccatctaggggccctgcaccttgatccccgttggggactacacaggccccatcctcggcaaggtaaatggtgcgatgtgagggagacgaggccaacgcacggtggacgcatgctgacaacaaccgtggccaagggcgagttcgcgtgcatggaatttggggatgtctgagagcagttgctggcgactactctccactctactcatgctcatccatcgatgatgggatgtggagggcagcttggcaatgggatggggcagtgtaatgatggccagctgcagcggtgtggacagtttttcccctacttgtgccttctggtgatgggatgggagcgggcatggcaactgttttgtcaaaggggcacatcaagaacataacaccgcccgttttcttgtcctatccatgtcaattgaccaccacctccttgacctcctctcccaccccacaacgccacctcggacccgccaacatgtgccacattgtctctgcagctcttagctagtacttcttgtttcataataatagtttacaaacataggaaaataatacttttatcaaactgtatttcaagatcattttcaaacatagaaaaataatactcatatcattttcaaatatcgatacccaatacataaacataacatgtaaccaaagtttgaaatgaattatcgacttaaggcaactccataaattccatttatttgtgacttggtagtacaaggattcttcattattgacatacatacccatgaaatataccatttacagtatggggagatctatagacgactcgatatgtgactttggctccatataataacatctagaaagtcttttattcagttttctcttatagaccaacaaagaatacatatgggagcaaacaactcgacatctcaacacacaccttggactccaacttcagaaagcttaaatcaagcaaaagcagctattgtatatattcttgaaaatatggacctgtgtaattaatccgccgctatataagaacgtcatatgagacattcgacactagatcagttttaagcatgttcagggccagacttgatagtaggattctatttggagccatcatgtttttcttcacctcctttcttccagaagaaaagaataacaacaaagcccaacacaggtaagagaagcaggatggcatccttgaatgtgcaccaattccgagtactgcctgccgcgtaggctcccaggagggcaagcatgtccagcaacatggctgtgtgcattggccaaagaggcaatttatgttcatcgcccttggtcatccttcgaagcagcaaaacaatgacagtgatggatgccatgaaggaagtggagttgctatagaaaaaagcattgtaccgacgcttgtcgatgtcgtagaggaccgggttgccagcagagtgcccattaccttcatccctccacaggccaccaggtggttttaggcccgtgaggtaggccacactcgcagccaatattcctgctagcattaagtacttggccatcatgtcggctttctttttcatgtcagcttcctgttgatcttgtgtttgtcttggtgtgtccatcatgccatcttccttgttggtttgttgattttgtgtttgttttgactgatgttgatttatgtttgcacgttgtccacgaccgatgattgccacatagactacagctgcaaaaactaccgtaaccaatattaagacaacgatggaggttcgcagatgcatcgaacttccagcagcataggcatcgatgaggccgaacatgcccgctaccatgcagacaaagagcgcatagcactttatgcccggcccgtacagatttcggttgagaaggagaatgatgagagccacggatgccatgaagcttgctgcattgcaataaaaaaatgccttgtaacggatagggaacttgtctagtaggacagggaagcctgcacggtgcccaaactcatcattttcccagaagccacccggtggggtcaagccggcttggtaagtgagtgttgcagccaagatttcaacaagcagcaacaactcacgcttcttctccaactgatgctcctttatcttgtcttcctcaccctgcttgtccgacttcttttctagtgtggagaagagaatgtgaatcaccacatagataaggacaccaccagccaaggcaactgtgtaaatggaagtgcttgtgtccctgcaacttccgacagcgtacgcgcctatgaggcaaaacaaatcaagtatcatggctgcctccagtacatggcttctaactagaaattcattctgcaacatcaccatgatgactagggatgccacaaaagccaccgagttaaaatagaagaagaccttgtaccgcctagggtgtgttgtcaggagtattgggtctccactgtggctagccccattgtctgcccagacgcctccaggtggatctattcctgcttggtaagcaacgatcgccgcaagaatggcaaggagctgaattaattcacaaggcttgtctagatcattgttgtattgtttacttcccctgtacaattaaatagatagttcaattgcagtctagaataattcttttggtactcgaaattgatgatgtggaattaagaatttctagcactcaaaaaatgtgtacaaaaatgcaagaaattctcaccgaatcaatcccccccccggtcccccatgtcatcatgattgaaatgatagttaacaatgtgaaacaaattaatttttgttcggttagcccaatatgtggccttaaatggctccaatcagtaatcactacatctccctaggtcttgattgaggggcacgaaggtcttttccttcctcttaattgatatgtactcaaactattagaaatgctacagcccccctagtactggtcctttctatgcccatgccagcggcatggatgatcgtagagctatcttcatggaagtagaaagcatgaatagaaatattttttttcaatgatgataagcagcgatggagcaagctagaatttcctcatgcccgggtcgaggctaaaaacaagggaataaaattggcaggcgactgatagcattttaatgatgtggagcacaagtagttgggcattatgaacacatcaaggtgtgaagagcttgagctgatgagcagtccggattggaagcaaggtcattgggtgcagtggcatggactagcaggaaaaaaattataagattatagccctaagagactatgatcaggaaaaagaaaaaaaagcactccgctgcaagttggcgactccaacccatagactcgaggacaagactaacgctatgcgtgctcggttgctatcagcctttcgaagggagaacaaacatgtcgcctagatcaatggttctcgatgagcatgtgctttgtggatctatgatcatgttcaagcaaaactggtacaataaagtatagatgttaatagtgaaatagttctagtgataggctcattttgtaaggctcatgtctacatacttttgggagcaagacaccattgagtccatggaccttttttttcttttaccgtaccagtttctttacctatcaatggttctcagtgagcatgtgctcgtttattatagttttacagttttcaaatatttctaagtaaaatcatttcctacaatacacaatataaatctatgatcgttttccatatatctttacataaggaaaaagttcaaatacccccctaaactttggatggaaatccgtcaagcaccttgaactttaaaatcaaacacccattctcctaaactttgtaataccatgtatattactctctaaggtggttttggatggtgtttttgcatatttgaaggcttaaacgagtggttttgaataactaatatacatatttaaatatgattagttagtaggacatcaatttatattatatagtggtgccatattattattatgttgatactcattttgtaagtgagattgaataaagggtacaaattaaagaagggatatttaagtgaagatcttagcatgtatatctaatgtatatgtcacgtgatcaaactcattcaacttatatacaaattagattaaaaacatcttatcgggttatataaatagtactataaagttcagagagttgtatgtccgttttcgaagtttagggtgctagatagacttttactactagagaactcatcttttatccaatgccccaaacatacaaatacctcggatggattaagaagcgttactaaatctctttagtaccggttctaaaagcccaagtccctagaaacatttttagtaccggttggtgttatcaaccggtattaaaaatacatctgtagtaccggtgttagcaccaatcgagattaatgctgatggatctttagtcccgttgatattatcaaccggtactaaagatgtatttttagtactagtaggtaacaccaacccatattcaagatatttttactaaagatgcctcctgagttagttcaaaaggaaatcatctctattcaagtcaaatgtgtaaggtaggtgggatcgtaacacgcgtgagggctgaagtgagatatcttgagtttgattcccacatcccacatattttttttttgacttggtttgcatcgttagtaccggttctttagtcttgatttttttttgtcacggttgctaactggaattaatgggtatacatctttagtaccggttcagatcgagatctttagtctcgattttttgtcacggttgctataatcgggattaatggcggttttcaactgatattaaaggtgatttctctcctggtgtttcaatcaaagtttagggtgatatttggactctctcctgcatataaatgtactacatgaagcaaggaaaaatgtagggtatgtatgtttttgacctaatgtggttttatatatcctacactttgaccattgtattttatattatattgctcatgatcttgaaattgacatcattggaaaatgtttcgaaatatgaatctaatcataccataatgatttttattaaggacaaagaagttttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacatagccggtgtgcctgctgtccctgcagctcccggcggcgtaggcgccgccgagtcccaagatcgccgtgacggtgagcccgtacagcgggaacttgatgcgcttgaggtcaagcttctcgtagtacacgttgaacgtgatggcgagcagggacgcgatgaaggagatggcgttggagaagaagaagaacttgtaccggattggatggaggcccggcagcaccgggtcgccggcggcctcggtgctccgccagaagccgccgggtgggttgagcccagctacataggcgtcggtcgccacgaagatggcgatcaacatcaggatcccgacggcggcggcggtgtcgttttcgccgtgagggttgggacgatgaagacgatgacataggcggcggtggcggagacgagcgcggcggcgccgatggtggtgaacttgtcatggctggtcccggcggcgtaggcgcccatgagggcgagcaggtcgaccaccatcaccgcccgggtgagcgtgagcagcttggtcccctggtgctggtggtggccggcccttgtgcaggaggaggaagaggaggctgaccaccaccagcgacgccgcgaaggagatggcgttgaaccagtagaagacgatgtagcgccagtagttggtgtcctgtaggatggcgtcgccggccagctgccaccggccgccgccgccgccgtcctccagccacgagccacccggcgggttcagccccgccgcgtaggtcaccgtcgccaccagggtggccagcagcaccaggtacttcttcagctggcactccattggcgacgacgacgacggctgcttgtcgtcgctgctgccgctggaagaagtgaggttttgctggctacttccaccggccaccgccggagccgccattgatctgctactgttgatcgggtgatcgatcgaggtgaatctttgagcaataatacacacgatggcatggctctatgcatgcatttatatagagggctgatcgatcgatcgagcgtgtgtcacaatcatggcatatatgtattacttgatcgtctagtcatattttaggctttattcccttgtcatttttatgccctttgcatttcattcggtagtgtcatgcaagtgacattcattcgtgcacagtgacccttgcacgcacgccaggtttctattccttatgtgtgtcgcgcacatgctttgttttgagctgctgattaaggccgtgatctctcggcacacaaaacgaagcacgtattattgcatgattaattaagtattaactattttttaaaaaaatgattaatatttttttaaaacaactttcgtatagaattttttttaaaaaatatacaccgtttaccagtttgaaaagcgtgtgtgtggaaaacgaaagaggtgagttgggaaaactaggggaagaacacggtctaattatggacgtttttacacgaattatgcaccagttcattgcacaaatcgtgtgtttttccctttcttatgagtacaacgtaaataaagagcgtgtaattttgtatacactagttatagggctagcctaatgggcgggtgatcgccttgggcgatcagcacccccatccctcccctaacacgcacacgtctccccttttatcctcttcctaccacactatgaaatttcaaaccatttaaaaaatataaaagaaatctaatacacttgaaaacatattcatgtgaataaactttacacttataaattataaatatatagactttatgtatagaaatattctatataaaaatatatttgaatccaaattcaaattcgaatttgaagcgagtatataaacttttaccctataaactttgggtatatatgtgtaaactgggctgatagccgcgcgtgatcgatcacgcgttagctttctagctagttatgtcccctgcgttgcaacggttttttatccagtttagtagaaaaaattggaccgagtagaccatcggtttttataaagtgaccgggctttttttaattagaaattggttttttaggatggatgtttttttatgagaggtaagatatgtttaagtagaaatggaggatggattgatagaagaagacaactccctctttaagtagttgtgagatataggtttttattcggttaagagggcaactccctctttaagtagttggagtattttttttttataaaactagagtacttgaaattaaactatcaatgtagatatgttatgacgttttagtcaaattatataaatttatctaaagtaacaactttcataatttattgttatgtaataatgatacaatttaaaatgaactttcagtttcattggtatgtaattcatcaagggaacatttttttatggaacactaatactgtatgatttaaacataacacaatgtatgccaaactaagggccttcaaagttcaaaccaacctttccaccggaaatgcatttaatgtagtggacgaattccggcccatacgtatagatgggctgaggggtagtaggaccacgtgaagaaggaaaaagtccacttagactcc

SEQ ID NO: 32852 - DNA, 11530 bp, Oryza sativa
tgggattggtgcatacaaggagggtttttggatatgcttgctttgggggataatgtggtttgagtggggccggcagtattgatccgttacgccacgccaaggacttatgtttctggctgttcattagcttgtttggtcaaattgggtgttgagagtgatgagcattatgtagtttattatggaaaagagggtttggctgatcgacgaaagcaggaaagtaatgagtctttttgttggcccttttttttaattactctgaatgttttcctgtcaaataaccatctgcactcagaatcagaaaattttaacatataaatagttaccgtcacacttcgctttctctgaaactaattgaataggcacgtgcaacttttggtatgttctataaatgtacatctatatttcctaattatacaaccatttaatgtaaccatcaaagttgcttgataaatgaaaggtatttcttcgtttgattgctcatattgtgcatttattgggagcatgtcgcaattcttccatgtttacctattttttccttccgccaagaactatatatatttattgtgtctctgtgtaatgtgaatgtccagggcgatacgcattcacgtgaagacggattatcaaaaccaagagataaagatagagaaagagaaaaagacaaggacagggaacgccacagggaccgtgacagagatcgaggaagagaccgagatcgggacaaggacaaggaaaaagacagagacaaagaaagggacagggatagggacagggacaaggatcgggatcgccaccataggcatcaccgtgaaagaagagaacacagagatcgctctgatgatcatgatcgccacagaagccgtgattctgaaaggtattctttgttaagggagttctgttttatatgcaccttatttcttacaaaccatgcatccttgcaatgaatgcattttatcaaatgtgttaaatgcttttagatttagagctattcaactgtcttatacatgcctacatgattagtcaaatgcccacaccaatcttgtggtttatatttaatacaggagaagagaccatgaacgggatgggcgtcgcaggcatcggtctcgctcacgctctcgttctaggggcagggatcgcagatctaggtctcgctctcgttcaaaaaggtatgtaaaggaagctccttgcatagtcttccatttgcatcttctttagctgccgtgcacatactatgttttccgtcatggttagttaaattgtttattccatatagtagcaattttggacatactttatatatgctttctctgcatggattattttcctgatattttctttgtgtattatcaaattcagacatgtacaattcgtatttgaatatgtatggcagtatggtttactggcttagtcttcttaatctggttctcattgatgaccggtttataacttgttaaatatgctaattttatgtgttattcagctttactttttaagttttattttatcactaaccactaatatctactaaactatttttctaaagcagcaagcgagttagtggatttgatatggcgcctccagctcaagctgtggttccacaatttcctgctattccaaccccaagtatgctctcatcaactaagttaaacggctcaatttcatttttcttttcctcgtcaatttgtggcactttttctgaataataattttagtgggacatttgaacaatggagttaagaaaaataattttgctgggctggatgattgatgtacatgagtattttttttagaatgaattatatcttcggccgctataattcttcatccttatcactgtataatgccacactatcttattgccgttgccataaactaccggtgaattactagtccattaaggtcgattattgccgtagcaggatgatgcttggtgttatacctagtaaattggtggatatgtctggatgttatacctagtagaactccaatacagttaatatttgcttagtatgatcggccttgagcattctacacataatagtaagaggacaggagaacaagcaaattgttattttatagtagtctacatgatgcatttggagagacattggtgctttaattaaaggataaaaaagaataccaaccagtgggctccgtaagcacccctcaggcacctatctgctgcagatgcacttcatgtgatagttactaatatgaataagtgaataacttgtaagtttccattttattattacttggtaactggaaactgagcaaaacttttttgcttgtgttcttttgttgtttgtctgttttgtgtatgtgtatggtaagaaggcaatcttgggttacttgcccccactgctgccaatggaatgagctgcctactgtagctttaatgtacaaggaggaatcagtgctctggtttgataccatcttattcgtcttcaactagcaagtattactggttgctagcattatgtctattatatttgtccttgcacatattttgttcattcttaggcttggatactgaacagctagatctattttagacccagactgatggtgagaactagtcagttctaatggtggaatttttttccttgctaattgtttatgctctgtactagaaatttattgataaattgcaggtcagtttccgggcactgctattcctggaatgtttccaaacatgctcccgatgggtgttggacaggtaacctgtcagtattttaatgtattataagtgccaaaagaatcatttttttatttatgtttgtaaataatttttatttgcctgtaataataaattttgtttgaagcagttcaatccccttgttatccagccgcaagcaatgacgcaacaggtatgagttgttgtgacatctactgcatctattattgataaggatgtcaacaaaataatgtgttaacacctttttctctcaggctactcgacacgcgagacgtgtttatgttggtggacttcctccaactgctaatgaacaggtctgtgtatttaatcactcattctttcttactgcccatttcccatacccaaaccaaaagccgtatgggagtgcacgagtgtgtacccgcatgcaacatattactgtggaattgttacattagtttcctttactgcagtcagttgcaatatactttaatcaagtcatggctgctattggaggaaatactgctggtccaggtgacgctgttcttaatgtctacataaaccatgacaagaaatttgcttttgtggaaatgaggtctgtggaggaagcaagcaatgcaatggcactggatggcattttgtttgaaggggctccagtgaaggttaggagaccaacagactataacccttctctggcagctgccttgggccccagccagccaagccccaatctgaatcttgctgcagttggcttaacacctggttcagctggagggctagaaggcccagatcgtattttcgtgggtggccttccatattacttcactgaggctcaagtccgggagttgcttgaatcctttgggcctcttcgaggatttgaccttgtgaaggatagggaaactggtaactcaaagggctatgcattctgtgtctaccaagatctcaatgtcactgacatagctgtgctgctctgaatggcatcaagatgggagacaaaaccctaactgttagaagggcaaaccagggagcggctcagcctagaccagaacaggaaagtatcctgttgcaggcacagcaacaagtgcaattacaggtataggtctcaactatttttcatccagtatcagataattttactttcttatgccaactattttgtagctgtattgtgattcttgcattttgactctgtgcttcttaacagaaacttgtatatcaagttggagcactccctacaaaggttgtgtgcctgacccaggtggtttcggctgatgaattaaaagatgacgaggagtatgaagacattatggaggacatgagattggaagcaggcaaatatggtaatttccaacttctcacccgcaatttcctcccttgcctctaaactccggtttagtttgatcatctgctgggctaaaaccccatatgtatcttcttgcgttgagagtttatgcatgttttcggattccttttgcctcgattgatactttttgtttatttagttggtcttcctaggtgttttctcccttttgtttactcacaagtatcttccttaggtaatctgattaaggttgtcatccctcgccctgatcctagtggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattcttattcaaacgcgtgatagttcatgatagtagtagtaaattaacaggagaaatgagggcaatggcatggatgattcatctgcacacccgtgcggtacatgctagacgtgcaaaactatttgcaccaatggttttaaaacaacaacaataataaatacaggtacagatggaacttgaaacagaatgatagcttacaattacatgcagtggatgctatgtttagctaatctggacgtcgccacaaatgctgtgccgtatgcagtatatcaagatgattaatcaacggattatttgctgatcgatatgcttaatccttcgccaatttggatgtccaggggtcagacaggtgtccgcaagagaagggtggcaaccagagattacaatgctcttgagcgattggggaagcttgggcagtgtcatcatgttgggacactcctggacgatcaattccctgagtgttttcaggcggcacaatttgacaggcaaatagttccagctgcagtctgtaactgacagtgtatgcaggcaggtgaagaattcaccaatctttgggggatcactcgatcccttgcaactccagaacataagattctgcaatgccgggcgatcttgttcctgttccttgtcgcaaccgtctcctgtcaaccagcttgggtatatcacaccaccgtaatccctgatgcaaagtactgtaatccccgacggtggacggagcccctcaagaacctcctcctgaagttctggaggttgatgttgcttgatctctgttacaggtggaaagaacagcttcttgtatgactccaacgctttcttcgagcagcgttcgtcagtgccaccccaccgtagcgtcagctcagtgagatataccttgtcagatagcctggctcgaacagcttcctccttgctctgaacattctcgatgcagtcgatgaacagcttgccacgaaggttgttcaggtgctccagctgctgtatctcgtatcctttctccttcctcacgtagaagtgatacagagctcggagagatgtcagcttcccaacatcaggaatgttcaggccataccatgtcagcatgtacctcaggttgatcaggttggcgatcttcagctgggatggacaatgcaagcgagtgttaggattgacagagagctcctgaagatggtaaagcttggaaaattcagccggcagaatcaggctgtggggaggaggtgacatgatgccaagataacgaagatgtttcagtccaccgatgcatggtggcaccctgctcaaatgtctcaaatccaagtgcaccaccctcaactttgttagcttcttcagcacacgctcaaaatcatcttggttcattccctctactgaatagcacatgataagagttctcaagtttttaagctccaaaatcttctctgggaacaatatttcactgtgactcgatgcaaagatgtcgaacgtgtttagtgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatggcgtgagaagtggtcttggtggttagttgtttccgttgtattcgttcctttatatatggaagtaaacagaaaagcagctgagttaagcgctgcacaaaatttgctctgtttcctctgttctgcgaatttgcaggtttagccacagtacgcgtgcgttgtgttcgtctggtttcctgctagcgatcgctggggaaattcctaacaattggtatcagagcacggtttaggaagtggactcgtgaccgcgcattggaaggcgtcttcttgccgcgtcgtcgctcgtcgtcaccgatcgtgcacactcctcatgactccggcggccgcgccacgggcagcggcgggggtgaccgcgggctggtgatccaccgcgtggtgaaagaaggaggcggctcggtgaactacccgctgctgaccaagaccaactacaacgactgggcgctactgatgaagatcaagctgcaggctcgctgcctgtgggcggcgatcgagcccgacggcgtggacgtccctctgcatgaggaccggatggctcttgacgctatctgcagtgccgtgccgccggagatgattggcaccctggcgaccaaagcgtcggcccgggaagcctgggaatgcatcaagacaatgcgagtcggcaacgaccggattcgcaaggcgagtgcacagaaagtgcgcgctgagtatgaatcgcttgcgttccgcggtgatgagaccgtggaagatttcgctctacggctcacaaccatcgtcaaccagcttgcaaccctcggtgatcctgaacctgctgataaagtcgtcgaaaagtaccttcgggtagctcgtcccaggttcaatcaactcatcttgtctattgaaactcttctcgatatctctactctgtccatggaggaagttactggcagactgaaagccgctgaggattctgggcaatcctcgtcgcacaccgccggtgggaagctgtacctaactgaggaggagtgggctgaacgtcagaagaagaaggatcaagaggcaaagcggggtgactcgggcggctctggcggccgcggcaagcgccgtggcgggagagggcgcactggtggcggcgggactgcgagccccgagagcacgaactctggttcggcgcgcaagggagacaaatgccgaaattgcggcaaacttgggcactgggcgaaggactgcaggagcaagtccaagcgcgaagaacaggctcacgtcgcccaggaggatgaagaagagcacaccttgatgttgctcaccggcggttgcgttgacacggtcgacgcggcggcgccggagggcgacacgcccacaccgccccaccaagccgtggtggaactcgtggagatgaaagtatttgcagcgctcgacgacgcggctgaccatgatcccgggcgctggattatggattccggcgcgtcaaaccatatgacgggcagcaggatggcgttcgccgacctcgacacgaacatcacttggaacgtgcgactcggcgatggatccgtggtccggatcgcaggacggggcacaattctctttgcctgcaagaatggtgagcaccgcactctgtcgaacacctattttcttccccgtcttgctgccaatattatcagcattgggcaattggatgagaccggcttcaaagtgctggcggaggatggcatcatgcgggtctgggatgagcagcggcgtctgcttgcccggatccctcgcaccccagggcgactgtacatgcttgacatcaacctggcgcgcccggtctgtttggcggcacacgccgacgaagacgcgtggcgctggcatgctcgcctcgggcacataaacttcagggcgctctgcaagatgggcaaggaggagctggtacgtggtctaccatgtttgtcgcaggttgatcaggtctgtgaggcctgtctcgccgggaaacaccggaggtcgccgttcccgcggcaggcactttgccggtctgacgagccgctggcactgctgcatggagatctctgtggaccgatcacgccggcgacacccagtggcaaccgctatttccttctactcgtcgacgactacagccggtacatgtgggtcgccctcctctccaccaaagatgcggcgccggctgccatcaagcgtattcaggcggcggcagaaaggaagagtggacgcaagctccgcgcgttgcggacggatcgcgggggagaattcacgtctacacagttcgccgagtactgcgccgagctgggaatgcggcgcgagctcacggcgccctactctccgcaacagaacggcgttgtcgagcggcgaaaccaatccgtggtgggcacggcgcggagtatgctcaaggcgaaggggctgccaggtatgttttggggagaggcgataaataccgccgtgtatctgctcaacaggtcgtcgtccaagggtatcggcggcaagaccccgtacgcgctgtggaacggcgttccgccggccgtgcaccatctgcgcacgtttgggtgtgtggcacacgtgaagacgaccaccccgaacctgaagaaactggatgacaggagtcgtccaatgatctttgtcggctacgagccggggtccaaggcgtatcgcggctatgatccggctactcggcgtgttcacatctcccgtgacatcgtcttcgatgaagcggcccagtgggactgggatgctgaggcggccgctgatctcgacaccgacttcgtcgttgagtacaccacggtgtaccatcctggctcgctgtcaggaacacgccaagacgctggggagccgcctgctcgatcttcatcatcgccgcgaacgccatcagactcaccgacagccggccgaacaccttcggtgcatggcgatgcgccggcggttgaatttgtgtcgccaccaactggagcagctgctaatcttgatgcagaccacgacgacgcaccactccgtttccgcacgatggacaatgtgctggggctggccatgctgccaggtctcgctaatcgtgaggtccaggaagagctgatgatggtgagcggagaagaaccggcaacgttcgctcaagctgaacgcgacgaggattggcgtcgggcaatgctcgatgaaatctcttcgatagaggagaacaagacctggaggctcgtcgatctgccttcgggacatcggccaattgggctgaaatgggtgtataaactgaagaaagatgctcagggcgtcgtcgtcaaacacaaggcgagattggtggcaaagggctacgtgcagagggctggaattgactttgatgaggtattcgctcctgttgctcgtcttgattctgttcgtttgttgctcgctctcgctgcgcaggaaggttggatggtgcatcatatggacgttaaatcagcgttcctcaatggggaactgattgaggaggtgtatgttgttcagccaccggggtttgagatcgatggacaggagaacaaggtttacaggcttgataaggcgctgtatggacttcgccaagcacccagagcttggaacaccaagctagactgcacactgaagaaacttggcttcaagcagagcccgttggagcatgggctgtacgcgcgcggcgatggcagtgggcgactgctcgtcggtgtgtatgtggatgatctggtaattgtcgggggtgacagtggcatgatcaagggattcaaagagcagatgaaggctgaatttaagatgagtgatcttggtcctttgagtttttatcttgggatcgaggtacatcaagaagctggaatcatcactttaaagcaagcagcgtatgcgtcgcgtattgtggagaaggctgggctcaccggctgcaacccctgtgcaacaccgatggaaccacgtctaaagctgagcaaggaaagtgcaggatcgctagttgatgcgacagaatacagaagtctagtgggaagcttgcgctatctggtgaacacccgaccagaccttgcatattcggttggttatgtcagtcgtttcatggagaaacccacggacgaacacttggcggcagtgaagcgcatcataaggtatgttgctggtaccattcatcttgggtgccgctatgtgaaggaaggtgaaggaggactgcagggttacagtgacagtgatatggctggagacattgacactcgcaagagcaccacaggagtaattttctttctcggcaaaaatcctgttagctggcagtctcaaaaacagagagttgtagcactctcctcctgtgaatctgagtatattgcagctgcaacagctgcatgccagggcatttggcttgcccggctcctcggtgacctcaggaatgcagcaactgaagtcgtcgatctcagggtggacaaccaatccgctctggccctgatgaagaaccctgtttttcacgatcgaagtaagcacattcaaacaaaattacatttcattcgtgaagccgtggagaatggggaaatcacaccgagttacatcggcacagaagggcaacttgcagatatcctgacgaagccgctttctcgaatcaagtttcaggagctgtgggaacaaattggtatgtttcctgtataatcggcacatcaagcttagggagagttttgttagcagtaatcttgtgtgccacggttagttagttgattagttatctgcatgtttacgtttttttctgaataaacgcatgagctcacgtgttgtgtgatagccatcgtgtggagtctgttatgagggtatccgagtttagctcgttgcccgcgtcttgtgctgggagctcggatcacgtcgtgtggttgtggggatggacgcagctagagcatgcgtgagaagtggtcttggtggttagttgtttccgttgtattcgtt

SEQ ID NO: 32853 - DNA, 9133 bp, Oryza sativa
gttcaagctcataccttctggggaagatgctacagtactggaagcatctcctgacatccacaacaagttgattatagctccaccaaagagctcccttggtcttattcagcacatcgaggttcgcggttgtttgccaaaatctgatatctgggtttctccagagctgacctgccactgtcactgctgcaataggtgatctgttcagcttcttagcgattttcctcccaatcggtatgtattctcgatcatcgaaaattgtactgtcaagtgcataatgcatgaacattgagaagtattgctcctcttccagatcagatattggaataagcctattagagcctagagctgcctctttactctgggctgtcaccaggattctgcttcctgacttcccaacattgagtggagaaagcagcttctcatgattctcatcattgacccacagatcatccagtaccaacaagaaccgtttgcctctcaaattctccaccaattttgcttccaaacctctgcagtcactaatttcagaatgccggctttgcgtgatctcctcgagcatatcacgaaatatatcttccagtctgtaagtcttagaaacataaattagcatgactgtgtcaaagtatctatctttatcctccttttcatactcacaaacatactgtgccagtgtagtctttccagaccctggaatgccatatatgcaaattacagaataacatttcctgctactggagcttggtaaagaatcatcctcacgaagcatacttcttatcatatcacgctcccggtctctaccgaataccttgcgtgtactactcgatgtaatgcttctcctgttcatgttgacaatatcattccaggcaccactgcttgtctgtgttaaatagggagagttctccacgtttgtgacagtgttttctagtttctctattcttttcctcaatttccatctagcaatagcaggcatgaaagaatatactgctgtaccatcctccagctggaagaataaagaacaaaaaaaatgattagaatggaatggtggaggaatgtgcatactttccaagctcctaaatggtgcttttttgcgaacactttctatatacgaatttattaggaaactcttttaaatccatttccactttatagtatcaattcaattcgtatgtacacttgaataattatctttaatcattgagctattcaaccaatttagccattcagcacaaaagaacaggaccatgtgagctacatactgaacttccttaaaaaatatatatatactgaactagttctactctctgacgactgttgtcccctgattaataatagatgttgttttcttctaaattagtgcttctgtttagaacatggaaattttttcttgttacttcaaaaattgaactattagatgtagtaacattagtggtgtctcaaacactaagaccctttaacacattccagcaactattgatttccgaataaaattgaggagcgcgacataaattttaccaagatcatagcccgtgcattgtaactccttttgcatagtgtattagtgttgatgcaaaataggaacattcccctagattgagagaagatgcattgctagattggggtggggtgtgtgtgtgttagggggcagagaagtggtaaccaacctggtaacctgtggctgtgatgccagttgcatcataaaaccaatctcgataagagcgagcaacctcaaaccagttgactgaccagatgaacagggattggcagcatctgatgaaatcaaattgcctggacaagcaactaagccgctccagcaaggagtcagaagctgacccgcagcatctgctacaagaaatcggtagcagcgcagctgatctgctgcgtagcgatcgatacaaaccctgtgcccactccagtagagtggttatgcatctcccaatccagctcgtcttgcaagcgtggatggcatcgtcgatgtgcggatgccatttgctgctgcttccctgtggctcgtcatcgccgatgacatccttctcgatctggtgataagcaatgagatcgaggacgtcttctgcttcgtacaaggcagacttgaccagcttcgccagcgtgtcgagattttgcacggctgatctctccttcttcgctttcctgtgcatcctctcttcctctatctttcgcagcatctgctccagcttcgggacagtctgaatctccagctcttggatctttggcgaagcgtcgaagaggtaggagatgaacctgttcacgagcaagctgatgataggcgacagcaaccaacctagcacggttatgacagagcccatggctgcaatcctccatggatttgccatggaatgcaagcttttcgatctccttcacaaaggggacaaagttaaggagcagtgggaagaagaatggagctctactactgtcttggtagcaatctatctatcagcaaactatgcaaagcatctgtcttctagcgagctcagtacagtgcaaaacttaattaagcagaaatttcacccgaaatttcttgcgaatcatcatttttttttcctgcaagtgtcattactgaaaatgacttgaccacatagcatgtggctaaccgactaataacatagtcagacttgttttcgaactaatgcatatggttagtacattgcattacatagcttccccgagtttgcagctggctgtctgatatgatgtagtgtaacctgcacgtgagtccatgtgacatgacaatcacaacactatattatgactattattaacacaaggatcagtaatacgaagagtgacagcagtaattggccaatgattcctctctgggttgtcaaactaatgttggcctgattccactctcttcaatttgttgtaatgattcgttcaaaaaaaatgttgtagcaatgaataaagaagagccaggctcttgtttcgaattagagaaatatatataaaaaaacagctcgttaaggagtcacattagatcgttccttttggaatcaataataatcattgactattaaatcatagtcatgaggtacagaatattaatttagcctaaataagtactgttggatttgtctattggtaccaagttttttctggcagtctgcatctatttatttactagcaaaatacccgtgcttcgctacggtgtattaaaactaaaaatatttattttcatctaaagttattttcacactgttttggtactttcgctcactagaaaaggtctcaaataatagagagaaatataatagctcataataaattattattgcaacggaataattttaactaaaatcacaataaatattttaacatgttgaaaacaatatatttcttgtttaccagatttaacattaactaaggttttatagcaattaaaaaaaagactaactttctcttggtggctaatttttatttttagttttttttctatgaattagattggagagaaaaggaaaagggaaaagaacagtagatgataaccagaaaaaagaaagctaaccaaagtgatcaaggaatcggacccatgacctgtcggcacaggttttctaggctaaccaattgagaatcatggacgttttgacatgcactgcattatatagatattcacctgaacagcaaagaaaaatatcaccccacctcctctcgaaccttatctcttctctaggagaaattagacattctgccactcctaagagtgggtttcgccacaatgccattctgcggaatggcatcgtaaaataccactttcaaccgatgccaaaccgttgctttgccatattcgccatttcataagattttcaccttttttgcacttcaaccgaccaaaatacccctctctggtttctttctcttctccggtaaacatgtgggatgaggagaagaccacgacggcaggggtggcactaacctcaggctcggcgccgccaccgccggagctctcctcctcgtcgtccttatcttgctctacaaattcaagaacgcaatcttttagctcaaaccacacacaatccggagagctagcgagggcgagcgcgagggttccggctcacctcccgccgccttggtcgccagcgagggcttcggctcacctcccgccgccttggtcgccggctcgtcggtctccatccccgccgcagtcaccgtgccaaccaagcccgagacggcgacgcaggtctcgtcctgccatgagctcctcctggagctagccttcttgggccatggtggcgggcagcctgcgacgcgcggcggagacgacggcggaggagatggtggcgagcggcgcacggtggtcaacgggagaggagcagcgtggtgaccggcgggcgagacgatgcaggagattgtggctcatgacgcggtggccggcttagggtttccttctctttctccgatgtgctggcagcgggcttcgaccatgggggcgggacgtcgctggcggtgagcttgggcgtcggcggcgcgccggcggcacgaacgactcggttgtgacgaccggaggggtattttagtcagcctgggtggaaaaataggtggaaatggagagaattggcctaaatggcaaaacaaatgtttggcatctcttgtgagtggcattttaacgacgctattccggggaatggcattgtggcgaaacccactattggcagtggcataatgtccaatttctccatctctagaatcctccgccttcgcttctctctcgtcgctctctctgtctcccagtttctcctccccagcgacagcgacaaggcgcccgctccctccgtctcgcctccctggccccctcctctcccatctccccctcttcctcccgtctcctggcaaggcgcggcgacgggaaggggacccaccgccagcgccgtttccccacagctattccctccccttcctccaccctcatccctcccgcggcaggcagatctggcggtggcggtggcctcgcgacagctgcgggtggtggcagcagtggctccctccgcccccagcagccgcgggtggcgtcagcggcggctccctccgtcccctgttgcctcccccctcggttgaaatgacggcggtagcgggcgccggcggcgcagctcggcaagccactgccagcggccactcgcgggatgtggccataggaggaggcggcggcagcagcaaactccactcgatttttcattgatttggtttttttatctccgtttgctgttcttctattcttgtatttgggatctaacacggattaaaactttttgtgttatttgacgcggactcatgtgtatatgcttctatttgtgtgattgaattccgattaggattttttttggttgggggatgatagaattccgactgagattttgggtggggggttggatgaacgaaaaatttgggtaccgatgatgtgacgaacagaaaattacgaatttaagattttaccctcgttgccggagcgtgctaggcgaggcagccgccgccttcgtcttcgacgtcctctttagacgagtgatttggaatggccttcggcccagcccaactccctacgtaatgggcccttcttttatgaacgggattgggctgtgttttacaggccgagccaaatgcagtttggaataagttcatataaggtccgttaactttacaccgaatacgattttcgtccttaacctaaaacaagatacaaccggtccatgaactgttaaaaccggtgcaaacgaggttcctcggtggtttggaagacggttttggctgacgctgcgcctaagtgctgatctgactcggtcttcgtcccacgtggcattgacgtgacgcttacgtgactattttatcctagaaaaataataaaaacggtggtcccacatattagctacaccaatttttttaaaggtggagcccacatgggccccacataatcattcacaccccctcttcttcctcctctccccagctcccctttctagtttcttctctgtgtcctattcctccccagagccggcggcattcatcgtagcaccacggcaccctctctccctgctctacctcttcggcttctcctctccccgagattccctgacttggtgccaccgacgaccacatcgagccaccatctgagccccatgggagcactgcatcccaaggcgtcaacgacctgcataatcccgatctataccagcaaggatcctcggatccatacaagcagtgcctcatatttttatccatctctccttccaactattttttctctctatttttcttccgatctcttctcaagatttgttatatttcttctaatctgatctgacatgtgggtctcattattttttaatctgacatgtgggccaaaatattttgttttattttttaaaatattaaattttgcttcgtgtgtcacgttaatgccacgtcagatgaagaccgaatcaaattagccatgtaggcgccatgttagctaataccgccatctaaacggacctatattgcacagttgaaggaccagttgtatctgattttcggttgattgacgaaaatcggattcgttaataagttaaggaactcaaatgaacttattccaatggaatttctgcaagtcgtccgagggaaaagttcgataattttatgggccgatatagatcgacgtggaccaactttgtcaactttgtgggccgatatagatcgatatacatgggctagttagttagccgtggtaatgggctgggcttgggttatactaactgagaatcctttttatctcttaaatatctgtctcttctctacttatctctactattataaaaatttaaaatgctttaactggtactttagtgtgttattcgtgtatgagtcggtttttaagtttgttcgcttttataaatacagatccgtatttgagtcgggttttaagttcgttcgtttttagaaatatagaaggagacgtataagaaatcctttttaaaaaaaaaactcgcatgctaactttaaatgatcataatcctaattacagctcatgattttttagaaaaatatatatctaagtgaattatcatagtgaatttcactttaactaaaccatataataataataaaattaaaattagccttcaactgttgaaacgcacgggcatttttctagtattataaaaattaaagatgtttccgctgatattttggtacatcgttcgtatttaagttggtttttaagttctttcacttttaggaatgtataaggagttgtataagaaatccttttaaaaaacatgcatgttaacttaggacgagagtcggagtcctagttgcttcagaattcttaccaaactataagaaatcaacgtatatgatatgaccatcatcccaataaaaattccaaattagatatcaatactatcaaaataaatatcccatatactttttagaaaaagaaaatataacaacaatatgattaaaaatagtctttatccgttacaacacacgaatattttttctactaaacgaaaacaaagaaatctacgtaacgggagggatcccctcccgtgcaagtacgtatccatgttcccttgcttcccataggcaactgctccttctccctcttacttttagtggaagctactcccgctactaaccatgggtataaaaaataaagattaaataaagaattatcgtaaaattataggtttagtgtcaatttaatcacaaaactataacgcttcactggtggagtaaccatctttcgtcggtcggccgatttccacaatagtcccggttgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccccctgggatctttagtcccggttggtaacaccaaccgggactaaaaatcgtaactttagtcccggttggtaataccaaccggaactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttacaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaaatagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttag

SEQ ID NO: 32854 - DNA, 337 bp, Oryza sativa
tcctgcagcccttcacggccccccaaggctcggcacctagatgggaactccccctcacaggacagacagacaagggaggagggagcagaggggatcacctcggggcgtcgccgtcgacgaggtcggcggcggcggcgtggtcgtccgccatggcgctttgggttggctgcggcgtggaggtggaggggggctcgtggggtttctcttctcttgggggctcgcgacctctccttgtacggagggtgctctctctcgaagccgcttctttagatgggccggccgggcccggcccatctatacgtacggggatgtacttcttcacgggaaaaagtccact

SEQ ID NO: 32855 - DNA, 836 bp, Oryza sativa
  unsure (1)..(836): unsure at all n locations
atatgctagttatatgtgatacttacaatttttaaaagttttaactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtatgtacatacatatcttaattagagtttttaccaacataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatccttagtcccggttgttctcaacaaccgagagtaaagatcttttctttactcccgttgnngtaaacaaccgggactaaagatatctt
